United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 41

SEQ ID NO: 613 - DNA, 733316 bp, Homo sapiens
ttttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaactgtccagataatagagaactgctcaccatcctcagaagcaattcatgtcctgtctcaccctctctaatggttcttcggactcctttttccggagctgagaaaccctaaaacatagcacccgtttacgtctagacatgcacaggtgctgtgaattgaccccatttttgcagttcatagtttattaaggaggaaagaataagccctgtcataattagttgaaaatacattttgaggctgtataaaaagaattataaacatggcacatctgagggcaagtcttttcaagcctctgtggcgatgcactattccctggagcctttagagggcagcagcacactggctgactccagcggatttcagagaggcgaactcccgaccagaaccttcctcctggtcaccatgccaaaggttgatttgccaggctctggcctctcagtctctttcttttcagttctcattctctctctctctctctctctctctctcattctctctctctctctctcattttctctctctctctctctccaaccccttcctcctctctctctgttaaaattatacactctgatgaagtcgcccctcaaccggaaaatgaaagctccaatgaaaaagttagacaagccaacaacaacaaagaaagaaaccagggaaaaaggaaaagggggctggtgacagggaaggacttaagaataagaaaagggcagatgtttcgcaaatatatgcaaagcaaaactgggtgtaccctgaacacttccacagagaaacagaccaatcattgtgcacttcctcccgccacactggtggagctctgcattcaaaaaaagaaaaaaaaaaaaggcaaaaaagcgtggccgcaggcacccgcctttcaacggtcagttctgacattctgactgaacatctctcaattgtccaaggagaacaaaaacattttcatctcctcactgcaaacatttctgttatgagaaaaggctgcttcaagaattgggagtgtgttttaaggagactggcggccgagttagccagcagagccttctggtttttaactctcattgtgctggccccagcaagaagttttaggctgaaacatagcagtgagtaaggctgtggaggatgttggctctttcctaactagaccatattgtatgtggaaagaaatatgcattaaaacatattgatgatatggtaggtattaagcatgttaaatgcatggaaattaaccagatcggcggcatttgatgtatatatttcacactcttttgcacatattgcacacatacagtgatggcaatgctttctgcaacatatggaaaaataaatattttatctgtgtgagctcttagcagtctccagggtgttgagagtgctctcttctttcaccctatcccaattttctctcttcactgggctcccaccctctcttgcacgttaatgtgccttttacttatcagcttggtcttttcctatctggtaagtaatgtgcctgttacttatcagataggaaaaaattagttggaacctcctattggctcatgataatttagaccagtgatgcctcccccaatcttactggagtcgtaacaatttccctactcttttccccaacaatacattaaataggcttagtatctgggcaggagagaaagggtaggtggtaacaaaccaccccaataagggtggtagcggaactgcgctccactacctattagctgtatgtcctgggtagattactccgcatctctgagcctcattttcctcatctgtaaaatgggaataataatacctaccgcttagggttattgtgaggaacaaatgagataagccatgtaaagtgatttgccttgtgctggcacatggtaagagctcaataatggtagttcctctcatagggattgttagttctgtgatattcatcatgttagctttaagaagacatttccgggcaaggggtggtagctcatgcctgtaatcccagtactttgggaagtcgaggcgggcggatcacgaggtcaagtgatcgagacaatcctggccaacatggtgaaatcctgtctctaccaaaaattcaaaaattagctgggcatggtggtgcatgcctgtagtcccagctactcaggaggctgaggcaggagaattgcttgaacccgggagtgcagaggttgcagtgagccgagatggcgccactgcactgcagcctggagcaagaaaaaaacaaaagaaaaagaagacatttcccttcatttcagtaatctgtttagatatctagattttgggtaggggcaaatggattgttattgtagcaaaggcagaaacaatgttaggaccagcaatctcttcctcaacatttgatcttgctgtatacttcctgacatctcctttctgctcacatgtttgtcattgctgtggctacactacaccatgagctccttgaagctgagggttgagcaagctgcacttagcctatagaagcccatcaagcctggacactatggtctattcattgagaccaacctatgggactctggcttatcgtgttttcttgcaatttatcatttctctacctggtctgatgtcctcacatcaatttaagatattttagtgattaaacacattttattttctcaatcttattttttttaaccttggcagggctgatttataatttttttttcagtataatttcctcttaactgtatcagtcaggatcctggcaaaaatagatggcacatgcaaagtttttagctaaagaggatttaatgaaaaaactgtatttggagctgcagatgaggttaagggacctcaagagagatagcaccaggtactagcaatagtagagactgccaggtactagcagtagtggaaagctttaaaccatttaaactgaaggggcaagtaaaatggtgatgaattctgagtccagtcagaattggagttgggaaggagggctgaactaacacatttcctgacctctctcttcccccactttcacatctcctgctgatgtctccttttggccaaattcaaagggaagcccaaggacaagagagcctgggtaatgtagtccagaaggccagtcttctgggtcacacatcagggcaaaagaatggttctggggtttttttgggggtagaatggggtggcaagactaatcaacatatgtgttcttctctcttatactttcaattatactttctggaaggaaagacagaacaaaataaaataggttctgtcttagcttccatgtacctattatgtcgaattgccattcacagagcaagaaaagagaatgctgctcagccgagcagggatttttgtttgttttgcttgctgccatattcctagttcctagaacagtgtctggcacatagtaaatggtcagcaaattttaaatgactgagtaaatatactcacctctgccgtgacagactttatatatatatcatctcattgacttatcacaataatctggttaagtaggcagggccactgagcattattgtgcaggtggtatggggggggtgggtaggtattaaaatttaatatgtgcctccccaacccacttccaagccttgtgactaggcccgaagcattgtcaacccaccagaagagatatacttctgtaaatgattcacattttaattttttatcctctttattgatttttgcacctagcaagtttctgttttattattattatttctcttttatgcattggaaagccaagtttctgaatagcaaagactgcaaagattataacccagtctgtccattctctagggcccatgagaagtaaaagcaggcactggcattctgcacagatgaaatacttcctacgacaggaatacatgctcacttgtggacttctctgtaatctgtaggcaacatcagctcctgatttctaggtctggatctgggttctctgtagcacaggaaggtaagagtgataagaactcttttccctcttaaaggatatagaaacttttaaacccatctgcatcatagtaaggctgtgttatctgtatcagcatagttactctgtgatgaagaaaaactcagaaaactatccagatgtgggaatttctcgggtattccttgcacttgaacttaaggatgaatgaaggtatatacaagtaagttccttgtgtgggtgtggactgaagaaactatgtttgatcttctgtcatgtctttagtccccagtaactcagtcctattagtactatagaacacattcccctccgggaaaggcaggcctgtctatcacctacacagcagcccccatcaactatgattcagttgactggaagcattaaaggtaaaaaagcaacacaaaataaagcaaaactctggcttcatccctttaggtttgatttataccagaatagctaaagacatagaaatatgaatgtaaatatcctacctgaagcctaagagggatgttagtctcccaggtttagcgttttccagtaacatagaagtctgtaaaacaccatcccattacctgcctcataacatataggaaaacttgtgaatataacaactagttattgttttaaaatgtgtaattaagttactttgcatgcagaacttctaaataattcaaatgactggcttttctattggaaaatagcatatattcatctgttatttcagcaatgattaatgaatacttgatatcaaactttcatcagtattttcccataggtatcatatcccctaccccaaattatttctgtacttttccttgcaaggtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgtgtattaaacaaagtgaactaagaagccttttattggagacataatgtactcacagtagtttcaaaatcaatggtgtcactcttcaggtaaattactccaaggcttgggcctagtgcagatgttcattggggcagggagcagagagcggctgcatctagatcagacaaaaaacaaaaataaggttgttaaatgaacaggtgatggtgatggcaattatttattttgataggaaagaactttgggacttgagtgagaggttggttgtttggttctacatctttgcaccagagaatggcgaggtacggaagggagaatggagaggatgttgtccaggctccattttcagtgctttcacctaactgcctgtgcagcctgggacatcaacagtaccctgtcagtgcgggcggagctgattttgtggttctgacttagaagctgagttgtgggtgacagtgggggaaggaagtagaaacagtgtccttcaaccttcccacagttgattcttctagtatccttttcttttttttttcatttattatatttatttattttttattcacacataaaaattgtatatatttatggtataaaacatgttttgatacatgtatacattgtggaatggctaaatcaaactaattaaaatatgcattaccggctgggtgtgctggctcacacctgtaatcccagcactttgggaggccgaggtgtgaggatcacgaggtcaggagatcgagaccatcccagccaacacagtgaaaccccgtctctactaaaatgcaaaaaaattagccaggcgtgatggcgcacgcctgtagtcccagctactcaggaggctgaggcaggggaatcgcttgaacccgggaggcggaggttgcagtgagccgagattgcaccactgcactccagcctggcaacagagcaagagtccatctcaaaaaaaaaaaaaaaaaaaaaagaattacctcatgtatttatcactttttcatggtgagaacacgtaaaacctactctcagtaattttcaatatatactacattcttattaacgatagtcatgaggatgtacagtacatctctggagttattcctcctgtctaaccgaaattttgtgtcctttgactgatgtctcctcagcgtctggcagccaccattctaatttttgcttctataaattaagcttttatagattccccatataagtgaggtcacgtggtatttgtttttctgtgcctggcttttctagtacaaaaaaaagcctattttttccccatatatcatggatgacctctagattcatccatgttcttgcaaatgacaagatttccttctttttgaaggctgaatagtgttccattgtgtacttttaccacatttctgatattcttgatttcatttcagtctctctctttattgcttagttcttaatgtattctagtgacacccattgatctgggcatgttctgagcattccctctgtccttcactgcaaaggctccattttcttccataggctctaaccctgaggacaccgaattaccctattttttcccctatacctcagtctgctattctgccttcttcactggcttattttctttcttctgttctctaaatgtagacattcctctagatcctctcctcaggctttgtctaccccagtcctccctgacctcaacaatcacttctccatggagagcatccacattgctatctttagttctagcttttctacagagctgcacacccacattctaaataacagctggttattggttcattcgttcctttgtccattcattcagtgtttatatagcatctatgaggcacctggatgaatacaacagggtctctaactttgagaagttcacatcgccatcaaatactacacaggcttttctaattcagaaagtttagaacttaattcattgtctttcctttaaaatctgttccttctctagacgtcccatttcctgccattggtattctcttcatccagttacgtgggcctacagctggggagtcatcttcaattcttccgttttttttttcttcctatatccaattagctacccaatcctgtagattctactctgattgtgattcctgaatcaatacctgttttctataccagcccctatttctccctttgctacctactgtgaggacatctatgaaaagctcctgactggtttcacttttccagtttttctttacctcttgtccatccttcacacaaacattacattaatttttctaaagtgcccttctaaacatatcacttctttgcttacagtcctccttgcttattggattaaattcaaacttctcagtttggtattcaaagctgctacaatgtagcccaatctagtttctcactcttatctctacactccattctacgctccagcaaagtcctactctttcctaccatgttcatggtatttcttcctttctttcaatgtctacatgtagcttcttcaagggccatccaaatgccacctcatttatgaagcatttcacaaaggagagtgcccttcttaaatattattagcacattctgtactactccctttgcatattctaccaattagaatggttatttgtgtaatttgtcttccttcttcataagccctttgaaagctgagacaatttttactctgagtaccctatagtgggccatgacttcttgcacgttaagtttgcactaggctgataatctgctgaactgaatttaaaaagaataaaccctcttgccttgagtcatagaaacggggactaaattgaaaagacctaaaagctcatctgcttcaaccccctcatttttcagacgaagagatgaagggaactgacttgctcaaggtcgcatccttgttagtggctgggcaaggataacagacataaaaggccacagactaatatttatcagtgcttacttggcaccaataggcccaacagatcatcagtaatgacaagaccagagagagggaggttggggtgtgtaacctgcaaaaatatattgtgttccaaaatataacaaatttgcttcatttatttgcttcaacaaaccgaactaataaatatgttttatagttaaatgttgtctaaaaaatgagggtggatttaaaaaacaaggaagcaaagttttctaacattaccagcagaaataattatgacaatactgtcaacaccactggggaggaggtgcggatggttaatgggtacaaaaaatagaaagaatgaatacgacctactatttgatagcacaacagagtgactatagtcaataataacttaatcgtacattttaaaataactaaaagagggtaattggattgtttgtaacacaaaagataaatgcttaagaggatatatgccccgttctccatgatgggattatttcacacggcatgcctatatcaaaacatctcatgtaccccagaaatatatacacctactatgtacccacaaaaattaaaaacaaataaaatgttaaaaataccactggggtgataaactcaggctgaaaataagaataaagaaatttctcatgctttggaaaagctgtgtgttcagctggagttcttggtgaaaacatgcagtaattccgtggttaaattcattactttgtagaaacaaactattggcaatctgctattatgccacattaacacttctttttccacctagcttagcctagtactcattctctaggtttgtttaaatgtttacttgtttttctttccttatattactaatttacttgtagaaatgcatagacaattgcctctgagtctgttcaaattttcttgccttgttcttctcttgtagtagaggaaacattagttgtttctcttctctatccttatcctcaaacagaatcattttctctcacccaaagatgaaaagcccaacaaaacatgctgtggggataatagtgtttacctaggtgaggaaaacagacttttccagggaatctcagtaattattacttggccagaaaagctcagctcttaaatgttagctccaatactacaagacctcatctgcatctcccaggtgagcgcttgactcactgttactcaccagaggaaaaccttggtaggtagcattaatcaaactctttttggccagtatggtggagccatgctacgcattgagacatccattaaatagcatcaccccagcagccacacaaacagcaaaatgggctcaagagctcttcattgttctttctaacccatcataaggctggacagattattgacacttcaccagatagaacttacttctccttttgccccctggcaactacattaaaatcataaaggaaatcactcatcaatagtacattgcagtgaaaaattatctggcaaatttacaaatcctttgtgtaattatataaatgtacattttaaatatatctaaaatctgatttacattgtgcattttataattaatacaaccatagtatgtctgtcctttaattaaatccttctttctcagtcccacatcctgctgctataatcttactttcatttttggcaaagtgtcacctagctccatcttctttccccttttgccttagtacacacctgagcgtctattaatcagaaccactgcatggtgtgtcatgttttattgcttaaagggtggttacactctaaaaaagattcggtgagaatgacttcatggggtttcacatttattctcttttaatgactttcatatccagtgtactcggtttttaagtcaaaagataattttgaggggctgctgatgccacaaattctccctagaacctgaaaatccagctgttgtctctgcttcttacatcatcactgtaataaagaatctgctcttggaacccagctggcaagtttcttgatggtgtcagaggcgaacagacagtaggtcacttctctacagcccgtttcattgttggcgtttctgcagatctgtcttggaagcccttagagagcagagctgttatgaaatacactgccacatatcaatgtaaggaactttctgcagatgtctactttgagtatggcctgtcccagtcctaggaaatcacaccacatcgttctaaaattatagatggggggttcatgattaaagtttacaagaaaggtaatagtaacaataacagctagcatttattggatgtctaaattttatcagggactgcaccaggcatttttataaatgagtatgttcttgtttaaccctcatagcaatgctatggtgtatgttttagtatacccattttacagataaggaaaagtgagacttaatgggcttacgtaacaggtcgaagtttagaaagctactggatagtgaggccagaatccaaacccagatctctctgagtctaaatctgtactcttttcactatataacaactgttccaatgcagcatggacacgggacacatttctagttcccgctgtgatcacagtacaaggaagatgcttatttccacgatggttcagagccactggaaagatctgggagcacagactccaggagaaggaactatttcagaaactgccaataagtatagtcccttccctcctcctttctaattgcagatgagaatgtcctctaacagtcttctcaaactctaatgaacaaacgaatcacccagggcttctgattcagcatgtctggggtggagcttgtgatcctgcatttctgagaagctcccaggtgatgctgatgctactggtctgggaccacaggtcttatttctgacactctcctttctactagggttgtttttgaaggagcagttcaagccaaataacttggctaacagttcacacagccagccgactggcttctgattctaggccagtttgtcaggtcatcaggcattacacagaattcaaggagttcttagcatagagcacactgtcaaaaaattgtttttagatccccaagggttttcccctctctctggaaattcaaaatgataatgtctctaacatgtaaagttcctatttttttacattattgttatttttaacaataattatctggtaataattcaaataacaccttccctctgagaaattcaatgagctttactaaccttaattgtctaacagcaattcccaggtgaagataaagctgtctcaaagatcatagtaaatttaaaattgttccacttccctcgtttctttgccccaaatgtagtggtgagttagtggggacgggttactaattggcaaaggcccactatcataatttgaggcacagcaaatttcataaaaaggatacatctaagaaatatttagcagagaggtcattgtggggaatacaatgttagaaaaaaaagagttagaaagtgtaagataagaaaagagaaagcaaaatcaggactagctgatgacctccgatgagacatttaacctctaggtggctcagcttttctatctgcaaaaagaggaggttggttttatgatttttaaggtcccttaaaactctaatagtcccctgagaaggaagatgtgggaattaagtagctcatcaacctgttaaaccattaaacatgttaaggaagtctatttgacttttaactttttagctaattacccgaaacaaattcccaagtctacgtcaccagccccacctctctggaaagtggtgagaaaaccatttaatgaataaggcaccaaagacatcacggccagataaactaatcaggaacaccatcgtcagcttactgatgctgtgataactattttactttttaggttttagttccttaattaaccactagttaatacccatgtccataagaaacacctctgatggcttgaagacccctgggatggccctgccaacacaaggtggaatcacaatcccactgtttgtcacattaaatctatgttaattttctccatagagacctcttgattcctctttgacagttcataaactctgttaatataagttgcacatcccatgccatgagcgttagcattatcagatacagttgattcttgtttaaaataagagatcttttggatcagagtacatgtaaacacacacacccacacacccacacacacaatcatgaatttctggtattaatgaatctggcctggtgatgggaacccctctattatgtcaccggatactggaaccttcttatccagaaagcctgccacaggtcatgttaataagatcgttttaaactttgtaatgagaattctaacatgagcatgatttatgacacagcattttatttggtattatcagagtttcctataccttacctcttacagtgagtatgtgttctgaattaaccattatagtttgtggtaaatggaaaaaaaggtacagagaaacatcacagtggcattactccagataacacactctgtcactgttcccaaagtgaacatcatttccctcttcctgctcccatcacttcaatagtaactttggctattactgactaaatgcttaccgtgtggcaggcattgagccttttcacagataactttattttcttacaattactctttgaagttgggaattatattcccattttatagacgaaggaggtgaaactgatactcaggaaaggtacagttattggtcatcagtcatgaaggcagagggtagcaaagcagagttaagggccaggttctaaccacatgttctagagcttaacctataccaggctcacaatcaccaaaccactgatctgccttcattccactcctcttcatttgtgatccccaccattggcttaggctagattcttcttcatggctctctcatgtcttcttgaatatttcttgaaatttctcaaaaccttctacacttgatttatgttttccctccctgtattaataatttaatccaaaaactcattaacacttcttttcaacagactttatcaccccttttcttagctctcatactccttctaaattactcttttgaggcctcacatttgacatcagatgttccacacccagctattgaactcactttcccagaagcccaaggaacctattgttttcagctggttcattagtaggccccagttggccttaccagatgtatttgtccagtttgatcttgccccatgatcaaccatttcaacactgtcctcagtaaccatgcagatttccttccttttctaactttctatgtgcagtgcctccttttacattcatcaactgtgaatctgtatcaccattctccatttgctcccactctcagaacaaaaggctacacatgcatgctacctggacctatgctcctgcccactgtttccaggtacaacctatggcagtttttcttagtttgttctcctttatgaagtcccattctctttttcagttgatgagctagcatcctagtttaataaaaggatctacaccatgcagtgtggtaagcttattagctctcatctcctctaatatctctgaattttcattattttatttcctcaggatatatcttttcccatgttcccttcgtatcttgaaggttattctctctacttctctttatcttcctttggtttcatcagggatactttctctgtagctgatagcatatcaatttctaatagtactagattaatcatcaccacataccttttttttttttgtcccgcattcaactcctgcccttcaaaaatcttttcagatggtgtatcttaaagtgtgtttcatactggaacttcaagatgcatctcaaaaaaagttcctcagtcaagtaagtttaggaaacactgaaaactatatattctattttcaaactcgcaagtgtacacaggatattaaggtgctggaagcctaatctttgtccaggcttaccggattacagactcccccatccccctttttaatggaacacttatttaacctcagaatatgcttcgggaaaagatgctttaagggattcccctggttccaaactcttaagcctgggctcggaaattcactgactccctatcaaatgagtcctctcagatttcctttccattaatactccacatggtctaaactggttaacttatagggtgtcagaaagactaagcacatttctatctctgagctactgtatataccagtttggctgcttggaatacctttatcacctttcaaaaaattatataggacttttttctccttcagggtccatatataaaaatgtatcctttatgaaattttcccttgtgaagactgctttagcccataatgttttctgccactttttaagtacttcaataaatggttatggtttactgcctgtttgctatattattagcgagggtgtacatcctcttgggtaggaaccttgttttatacactacagagaccccagctttttgagcacagtaggatgttataaccatgtcatcggttaatataaacagaaatggatggcattaagacatgatggtttaaaacccaatttctgtagctattggaatagtttaagatgctaacagcccaggtgaaatgttccatcacaatattgggaagaaacactacccgccatcactgccattgccctgaaaatgataccatgtgtgtctaaggatgtggataaaggctagatacagaagagcaaaggcagctccgttcttaggtgaaagtaagaatttgcattagttaacaccaaatggcgataagattaaaataatctaggaacatcaagtgatccatgaaaggaatcactggaatataccaatggtaaaattaccattcataatcattaaatcatggtaacttgatgaaaagaaaaaggatattttcctacttaaggaagtcagggtaagtattgtctgaggttccactgtgtgctattgtgcctggtatacagaatgtgtagcaactatttacagaatctgctactgccttctagtcacattccaaattctatctctttgaatcagtctggagacacaatacattggtgaattcaaggcagcttggcaacgactggcacaacataaaaccccaaataatgaattccatctttcccataaagctcttttattgacacaacatacaacagcgcagggcaggttgtctcgggctagtgtgtaataactagatgttaaggggccctgagtttttcagattagatgttatctgaagttgggactcagcaggttccctaacagtgaatttttagtgggcctacgactagaagtttggtctcttgatgcttagtcagggagttttattatgtgagagagaaaagtatagctttctttcttaaaactgcagcaatttcatattttagcagaagagaaagtgcattttattagagtataacctgtggagtattttgctaccttcctggatataaagcggtatacaaacaaaaaatttaataaaaagctattttataaataagaatgtttacttgtgtttaccttaaaataggtatagcttgtattatttaacatgtgaaatagaaggataatggtaaaatttcataaatataaaattctgtgtccgtcttcagttaaaattcgtaacagtgtatcagagtgttggttattagtagtaatcaataataagtattttttaaattggaatttttattgcaggagattattgggtgggtgaagctaaatggcctagatgttttcctgtcatgtcaatacttaagaattgtctttctgggcaatttacacatgtgagagtgaaaatgaagggtggcctgcctattgggtgtgtaacaggccaccggggcaagactgctattttctgagagccatgggcagtttctgcaataaagtatctgagtttcttctttttgtagtaaaaataaatagtttacttttatgttctgggtgaagcctgagatctctggatctctttgctggatttcactcttggtgggggcagggagatactattggcaatgctttatatatattgacctagacatgttaaagattatgtggtactttcatgaacactctaaaaatgagttctccctatcatgagttgcatagatgaggagattgaggtggatggggtgaagaggaaggaaagggcagtttaagcgggctagctaatgagtagtagaacttaatctaaaaccaagattttcagcagaaaatgctttttttccccaaaaaatgccatggttgtcaacaagctttgtagcaaatctggggcagagcactagatggagaatcagaagatctgccttgtcttcctggatctggtaagaaccagccgtgtgaccatggccaagtcactaacttttgtgagtcttattgttctcacttataaagtcatgagcaaggaatcaatgaatggcataatacttgtaagctgtaaaatctctctcttgtaaaatggtattgacaataatgtatgctttgcctatcttataaagttgtgaggctaaaataagctgatccatgtggaagtgctttgtatagtgtggagtactgaatcaatgttgtctggaagatttaggaaagggtcccgaatgtgtgtgggaactgacagccagtccacttccattcaggttttaggagaagctataataaagcactggcagcagctcaaatcccactccatcctctcctctcccagcacgctgcagagaatcacttgaggaaagttacttgagtgggtgagccaaatgctcaagttccaacctttctgagtagaagccacagtgaatcctgagccacaacacaggtgacaatcactgttcctccaggtgtgtctgaaacactgggggaccctagggaaggaggtcagacgtcactgctcctgaggacccgttttctcctgtacacagctccagcccacatgatttcacctggcagccccaagagacaaaaaggatccagaattagcaggagcctcctctcctgataacctaagtgctctgattgaaaggcagagggtatcaggagaatggctgtaccgagtcggcattgatttctccagcctttgtctgtgtctggtttctgtctcgtttggaggtggttactgttactacaagcagcatgaatcatgtctctgttaaaaaacagagcttcaattgtcttacataacccctggtaactgaacgtctaataatagcaagccatttccaggtagggaatctgtctacctcccagacacacacacacacacacacacacacacacacacactactcccaatgcttcacagcacagtgagacagacagggaggagacagaaggagaaaggggacagcacaattgaatttttttgtgttttaaaatatattgaataatcatgcatcatgggatctgataaccaatatacttagctgagctagtttaataaactgtagaaaacaagaattcttctttaaagtatttgaaagtatcccaatccataccagacagacaccttctctaacactcttatactgcataaaaaccccaaacccccaaaacagagtggggtgaaaatttcactggattgtctgctagcttgtaccaactagcttcaactttcaaaggattttttttgtcctcttttttgtttgaccagagagtgatattccaaaggttcttggccgagatcatttcataaaattccagagagtgaaaggcaactgaaaacatggctgcagtgttccaccatgcagactatgtaatgtcaggcacttttgcccgagccactttctttgacggagatgactttccatctgaggacttacatttttcccatgagtacactctctggcttgtaatacatgatgaggtctttttatacttgatccccactcagctacccattaaggtggctactgaaataaaaaaaaataataggagaggctgaaaaatgatttttgaaaaatcacaaaggtaggattttctttaaactaccaatttgtttgagaacaaatacaaatgctggataggaagtttaaaagtttatggggaataataatataaatgtataacatatatacgtccatttcctcactgcttcaccttgcccatgctaggaaaaatcacttaaaggctgtattttttgagtgtgcattctcagagtgaagtagctgtacatatcatgtaaattggactggggaaggacttcgcagaaaattacagatggcaatcacatcctgccagtcatttggtctagaaccagagaagaaaaactttcttttctcttttgattgttcagtaacatgaaacagtggactagactagttcaaaccaaagaatgttttagggcacacccactttgaggaccagcacctggctatgctacatgctcttcaattgtttaggcatataaaaaggagtgatgagatggttatatgtcaaaatggctgttctccctccaaacaggatttgattggcttatttgcttttggagtactctccaaatccataaacaaaggagtattgaattgaagaagcaaacaggagaaagaaaaaggctaaaaaggaaaagagagaagaagaggaaggaaaaatactaatttctcagtattcctatctgcaaatctggctggatttgataacaaaactcctactactgttctctaatggtctttgctgcatgccatatggacatggcttctaaaggggatgaattctaggttttcctcacaaatatccaagcacagaacagcagggatcttgacgactaaatcatcctaactcacgacgaggatcacagaggtggaacatggctgttgggactagattcttctgcttatttcatgtgctttgtgaattaaattgttcgtagagttggaaagctggtggactaaatgttttaataaaaacagccatgagacacaacagttttcttcacaaaggctttcccccctagctactgtgaatatattgctgaatggttctgacttctggaagggcaggaggtttgcctcttctctttgcctcaaaaaccaggcttattctatgcatctgggagatgattatacttacccgaaatttcaggatactatgtcagacagttccttcacagtggtgtgtctggcacctaagcaaggacttggtgggccagacacatttaaaatgtaaaagtggatgattatattattttgcattgtaacaatgagagtatttctggattgtagctgacgtgtagatcatcataaccatatgtggcacaacaaaccacacaacattgcatcagaagcttgtagttaatatttttaaatgattgattattttgaaatagagaaatggtggatgcttttttcgacctctttaaataaccacttattgaatgtctattgtcagtgatggactctttcttcacagaagggagctgggctatgccagactctcaccatgttctttctcctctaacactgaacaaaatatcagtaaaacaccaagtacagctggttttgaacctagtaagaaatcagtctgtagtaatgggccatattggtaataattggaactggtgatatcgatagcagtgggaataactgacttacaaaggcacagcagttcaggaacgtctcagggactcagagtgggtaaatgcgtaaatctgctctcacctatttatatgctccaacaaatatctggaactctagaaacttcaagagtctaatatgatcaggccacgtttataggtattataggattcatataaaataaggaggcatacatgttgatctagtgagcgtctccatatttgtacaacactcaggatatgtctgagaacacattttaatttttagaatcagctatagaatctggcagttattataaagcaaacttcacttcaaaaaaattaactgagaagccagatgataatccagatatacaaaacaacattggtgggataagtcaaataattctctaaaatgattatggagaaactgaagaaatgaagggcacctatttatcatatgtgggtccccagccacgtttgtaatctgttgtgtgaccttgggcaagtcatgaaacttctctcgagtctcatttttctcatatataatgtgggagtgttagattagatggtttttaagattctttccagtaataacatttgatgattctaaagtaagaagagatgaaagagtaattcctctttcctcttgttttggtaaatacttgctttctcctgctccgtgcctatgcagtttgcagtgagtattaggtttctggactcaagaagtcaaatagtaaatactgaagctatttttccttgtacacatggacaaatcataggggaataatccttcctttctttgtatatcagtgtctcttctcaaatcagacttatgcctaaggtaatcacgatcattctggtactaataaagatttttcctcatccttcccacaaggccctcacccatgctcatgaaagcttatgtgattgggttatttctatatttatgtcttggctattttttctctttcaacttgtttatgaagtccctggtaagcataaagctgcaaaaacaaaaacaaacaaataaaacaaaacagctctgtttgaataatttacttcagttgaagcagtataagaaaacatcctaacgccgaggggaagaaaacaggtcataaaaataccctggtatcttagaaaagactaaataaaagcttatatcaataatagtttcatatgttattgtctttcattttcaaagagaatggtacatattggctttatagtctggtgtacagacgtggctatttttccccatagctctcaggtcagtgcatcctcaaagccaagaaggcccagagcctgccgagctagctttacataaacaaaggagctacacagaaaacccaatacccggagcttatatcatatcctgactaggcactctggttacccatgactcgctcttttccatctgtgccctgattctctgctggtttaattcccttcacctagaatgccctcagtttgcctccttttactgctcagaattccctctggacacaactcacgactagcataagccccatttccaagaagcagcttagtttgacccaacttagtttgacccagcgaaaattttcatggatagcaagtgaaaattagtccttgtgataactggagtcactgaaaccaggtatctaggaagcactcagagaataccagagaaaaactttcaagggttgcagtgtcctcataggaggaaaaaaaaaatcctagctttaagaacaagcccaatatagaagctgtggtatgtaagagaaaagttgtagccatgtacgggaggaattgtgttaaaacagtctgactttttttttccaataaaggagaagagatcctctgtttcttaaaagaagtttagtcattggatatagcaacatacagtgtcataaagtttaattgcattaattatgaagctaaaatgtctacattttagtagagagaacatggggcatagctaaatggcgaagacataggaatgtgtatacaatttgagtttcacttcctccaaatctctcagttagaggatccctctcagtctgacggtcttatcatcaacagcttcacaaactctgacaacacctggctgggtttaagggatgggccatgatatatcttgagagtaaaagatggaatgaaactcagaaatgctgaatgcttttatatatgtatacaattttatttatgtgtatatttatatatcaatatatacaaacatatatatttgtatgatgtttggcaacctcactcatggtattcctgtgaagtaggcatgtggtaaacataattagcccattaaacagatggtagggctctggcatatctcaccatattctaaaatggtggagctgtaagcagggactaaagagagtgtagtttgatacatggctaactgcaaatctctgtgaattgctactttcctaaagacaatctgggtaggctgcatttggctgagaactggggatagtttaggaagctttaaaaatatacaaagggacaacttttcacattcattcagatatagtatcttcatttttacttactagaggcatttttttttaaaaaacagctttttatcttaactcatctgtgttccaagcaaacttccaaattgctgagcagattaaaaaaaaaaaccctacatgccaagtagaaacactgggtaaatgttattttttaaaattgtcttaacaaagtgcacttttggaaaggataaagttgaaaagacgtttggtactgtaaacacttagctgtcattgtagcacagtgaccaaatacgtccaaaagcacatgtaatgaacttttatccgactgaattatatgaccatggcattgccactctatagtacagcaggcttcagagatcctgttattaaatattctagcctaattctttatcatttgaaataggatctagcagaagtgaaagagttactaaaattaagacttgaatttacaagtgtgtttgaactggcttcaggaagacatgaaacatcaatacatctggagaatagaacttgcaattgactgttctttaccatctggtctcaagaacattttctgcttggaagttgcataagcaatgaaaaaacacacaaacaacttcctgtaccatgtttttggtcacttataatgacgcattacaaagtaaaccagctaaatatgagcaactgcgccttactcgagatgacaacatacattatataactaagatcaatgaaaaagaacatctttattttaagagacctggacttaaaatattcaagaataaacatccttccttctaaggtgtttgtactccttctaaggtgtttgtactgagtagttttggctagacaggtttgtagagtcactactacaaaacaatccctatattttttcaaactgaaaaaggatataaaaaagcaagctatattgaggaataaaatgttccatatattttaaaatgttttttaatgacataaacttgcctttttaagcagtaaaatatattctacacatgtttttcatagaaaacttttacatatctttgttttcttaaacacagtatgttgatgtaatttaatttttttctatgatacagggtcatccttgtgactattcattgttcctgttttacaggaatacacttttcttacttgtggtgagaactggcctcatcccttggctcagcctaacggccacagactgagctatagcccactagccactgccatagccaactggcgtcactgtcccagtttttcagacccatcgcctctaaatcctctctgctaaatgtattttctaatgtgctttggattagaaaatcaaataaataagaactgtagagacaatactgcttgaatgcagggtttggtagaagatttgggggaaactcatttggacacttgaaggtcttcagttacttctttgctcagggttgtaactcagagatctgaactaccagaaagtggattttgaggtattattgtgtaacacagagtgaaacatttatgcacttttattgcaaggcttcttattttaaacagggttgtccagaaatccattcttgattactttacttgataggtctctgatccattatatttcactcccttgatttcctccagcaatgtaactaacataatgacaattgggaagtaaagaaatagcacatttttaggataaggtgagagagtcttggtaactgacttcatcatagtgatggaggcaaaaatatacagtcaagttagaaaacttccctggactgctaatgggaactctggcctgactagacactgggaaaacattaaaaactgtgaagttatttacattaattttcagtgttcagagaagtaacatctgatcatcttttttcctcttctccaaaaggagaagtcagaataattcgcaatctgtgataggatagggattgtatcgaaatttgcctttttattacctctgaaaataggatttctaagcaaactaataaccttaaaactgttgggaggaaggatgggggaaaccaaatgtaacctatatgaggggggggaaacatctttaactactttaacatacacacatctgataagttactgaaaattcttatttattttgaagttagtgctgaagaaactctatctgttaaaacttagaaatctcagttcaaagtacatggaaatattccatgatcacgttttcagctcattctagtcgtctgtctcccagtttatttgaactgatgaaattttacaaaataaacttctttagctttctagagttacgtttttacccatgtaatctatttgttaatttttgtagcatgcttatatgataaaaaatactatgtaagtactgagtttgcttgttatggattatttctggatacagagaatttgcaagaaacttcagtttacagcagccaaggttactgcagactaaagcagaagttcaggcataaacttgtcttctaccagttttccacaactttgctgttgacagcatctgaggacatggttgatgagttctgaaaatcattcacaacattgctaatgtttaggaatcttatagctttgccggacctttccataatcacgagagaaaacctttgacgaaattagaacaagtcctcataccctcccttcctttcttctagtgatttttttttttgtattggaacaatcgaaagattcaatgtttttaaattccatagaagactaacgattgaataattttctcacatctctgtttgcactttcgcagtctggttgcattgatttgtgtctcacaagtagacatttcctttgttggtcacaaatcaatgctacagaacaaacctgccagcacattccacccccacccccaattttttgcagtttaaaaacaaagcacatttatatactttttcttttaaaaattactttcattggttagtaatacactaaaagaagacaaagcctcagagttaaaaatccccgggagaaggagctcctctctagctggtctctgattctctcacactgcctggagcaaagaactgcctagtgggagagcagcgctcgtccgccgtccgctcctggtgtgctctgttaacccaattaaggtcctcgccttcatacatcacaaagctgcccaaagcaacacactgtgatgtcacagtcagatatgatttcatggcaggaaaaaaccaaaaaggcagaaaaggttgaacgtactctgcttttattcaaatcttctaagagggggaaaaagggaagacttttttttttttttttttttttttttttctgagagaaaaagagcacaagctttctgacgtgaatgtgaaaactccgttctgaagataccctggtgcttttaccccaagtggataagcatgaataaagaagcacaaagaaacactgtcatcaatcagaatgctcttgcctacacttagctacaggtggaaagcaagcaggcacgatttgatttacctagattaaaagagcaattttctatcttccttttttccttttaaaaatagccaatcgattttggcctagctattgctgactgtacaggtccattttaatacaccactgattaaacggtatgttcatggctgaaggcactacagcaggaacaaacagaagcagctgaaggaagggggtgggggacaggcgagagctccaaaaaacactccacgaaggccacaactactcggcacttcccccgtagacagttgatatagcacattttaggcttgaaccagctataattctgggagtttgaagcctggaattcatttagctttttaattctgaccttaagaataaaaaaaaatcaaagctatgttttttaaaaaacacaaatgagggaaatattgtgtcctaaactgcaatgacatctgaaatgaagatgtgcctcagaaagatgcttcttatgaaacacttgaaatttcataagttatagaattatctactgaaagaggacctagttgtttagagactttgtttagtgaaattgcatgtaaaagaaacagaaagaaaataggacttttatatagggtgactatatgttgggattcatcaggcagctctcagaagagggagaatatctctactagttctagaaaataaccatcttgattatcatgagaaagtatagcctttatcgaagtctgggtggcaggaaaaataaattagggagggaccttctcaggcaactcagagagagacccaacatccagcagatgtttcttctgagaaagacaaggtccatctaacaggtgagacatcagctgaacaatggatgccaggacatgggaagtggctctgagaatcagcgaactccatgtttaaaaagtcaacccactttttttttttctgtttgcttactgattccttgttcccttctctcctgttttctctctccaattatcatttacttaatttgaaattctggccttaatggggacagaaccgtatccagaggtactattaagataagaaaattcaggaagaaagatttaatgaggggcttaggagtttttggaagaggaaaaggacattagagagaaacgagggaaaaactaagaaattaaatatcagcctcagcacggtggctgtagaagaatagcttctgagagacacagatggtctgcattctccagaacaaaaacaaacaggaagtaacagggccagagccccctctccccttcattcctctctccagtgtaaattggaaaaaaactgaaatgtgttcacatcaaaaagttttccttcaaactctagcaagtgaccacagtaaaagaaacaagagagcgctggttccagcaggtaaaatgctgaaaggatgtcacatcgtgggggtgaggaagaaatcagggattaaatacatacagtttggagaaaaatcaggctctatagctaactaatgatgaatggagcagacaggtggcagatttgaggtccggaggagaggaagggctccattttgagccgcccattttctggaggagaggtggtggccgctgtggaaaatggctactcctggggtgcatagggagacaactgacttagtggagggaagggaagaaataaactagggagtcatccagggacacatcgagttagtgagggttttagtttggatgataacaagctcttaaaacatggctttgactcataaaaaatgtagctgggatggatggctacttacagggttaaaagcaaactgagagctcttctattcccaaatctgaatgctgaagtgctgcctagaacagcaaacatgtacatgcaaaatatcaaaaatacacaaagtgggggtgcagaggaggtgcaggatgcaccagtcacctccttccccacacccttcaacagcacagagctctggcagggtcatcaccagtaaaactggattcttacaagccattccacagagagaaaccatcccaggtcccccatggctccaggcatcagtgaggacagttttcatgttccaaaactaattggacagtaaggagtgtctgtaagaataaaagcgggtgggaatggaggatggaaataaaagggaaaaaaagtgtccttgttgaaagttttaaattacaggctcagtaaaaaactggcattccaccacatccggtctagttaccaaatggaaaaatagggtcattaacatgtttatttgaattacattagtccttctctttcatatttaatttattctgttagaaaaaaacacaacgctctgcatgctggtgaaaggcaggggtgtaatggatcagggagctgaaatacaatgatctttacccattatctaccctgctaaggcttttcagaacttactaggatcattcagggattcttccctcacaagggagggaagggtacagaaagatgtaaggtacagatgctactgagtttgttaaaataatattgaagcacatttaaattaaggagtggaaggacgattttaatatggaaagtttacaaaaagaagaaaagtttgggataaatgacctcttctgagactgaatgtccagatgcaaggttggtgctaggcttacggaacatctccacatgatatggaagttgtagaacattgtgttattagtattcggggtattaaaaggcgaagtctgcaggatgatctcatgaggcttgctgtcatccacaagaggtcagggcaacttcagtacaagcaagtataatgcagtacattcaggggaaaatgaaacaaggtatattttcaggaagatgtccagaaatgacctggctatctttgtggcggtgacatggaaaggacatagacttagtatcataaggccagtccctgctctacaacttactaacaccatttgcacaagtaattcaatcagttttcctcatccataaaatgggaacatgaacagttaccatagagttgtgaggatcaactgagacaatctatgtgaaagtgttctataaagcactgtacaaatgtaagacatttattttctgaagacagtggtgccaagtgtgagccaagcagtgtgccaaatatcctcagaaataggattggaaacaaagcagggaatgctctgacaaagctgaagaggacaaggatctcccatctcagtgtgactgggtgtatcgctcactcaaacctgaagggatttctcaccgggatgctgaccttgggttcatagactaactccacagtaggttgccacccactcataatgagtcatttaaagttcaaatcttacttcatgctagcgatgctagcacagaggcaagcagttttaggctttttttggtcacagatttctgctgccattgtcaaaacagtagccccaacctctaactgcaacctagggcagccagcccaacctagacttgattctggtcacttttagtggaacaaattggctcagaaaacatcgccttctacttcttctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttcaaaaaataaataaataaaaagaataggagaacgttcagtattaattaaaataatcatgacataagatgaagatttctatttataatgataaaatccaggcaaggatatggtaaatgtctataaagaaacaaaaggtctgggaaactgactatggatttctttttcaaattctagtatacgtgaactggaagtcatcttactacttttcaaaagaaacaatttatgacaaactaaagaactactttacacagtaggcaatcaacttataaaattcattaaaggtcgatgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaatggcagatttgggatttgaatttaggattatctacttctgaagctctgctaccacactgctgctgttttctgcccagtagcctgatgtattaacagcttaagatgactaatttaacctgttaaagcgatatgaagtcttgctcttcatttgccttgatatctaaactgtgtgtgcagtagcttcttgtcatcaaatcatgtgctcatctatggctttacattaaagatgtctccagctctcattaagagggaacaaaagaagcaaacagatcacgaggaggtaaaaggcatgctgctatggattattatagagtacctcagactataatgtatattaacagaaactcttctctatcaactaatctaaagactcattcttagttttcctaatctaaactcaggtactacaatagaagtaatatccaagaagtgaatgaatatgatgaattccaacaacctccttgctttggtgactctaatgttgaatgggatatcaaaatggaagatgagaaacacaagaaatagctgggttgggggagaagcacgatgaggagaagaaacattagagaagaatccggagtttactttcccagactctaatttaatctgaatgagctttgtttctccacattttgaagaaaatttaagtttagtaataggagattgtgtaatgcaagagtgttgctagcctaaaggctgtgataacatatcttaggagctctgtgtccctcataacaaaagtaacaaacctttcaaaattatttgtggccttgaaatataatacaaaatacctgtatcttaatttctatccttgtaaaatgggaaaagttatttttatatgaaacaacgaatacataaaatactatatatttatataaaatatataaaatataattataaaatatataaaatataaaatgctatatgatagtatataaaatactatatattttatataaaattattatatatgtttacatgtgaataggagctatttgtgagttttattaaaagtctaggtaaaagtaaagtcatctatactcctttctctggggttctcttccctttccttttgtatatttttgctcccctttctctgccgcccccccgcacccacccaggattttaaccacagatgtaatgggtttctgtaacactggcaactcatagctttcacaaatgttcccttggctagggaccacccaaatagtgaccaaatagtgactctcactggctaatgaaaaatcaatgtggtttgatatcattaggacaaggtcaaaataatcctctaagcagaatttccttacattccctcaacaccaatgtgacaatctcgctgcaaacaaggcatagggatgtggcactgctgaacctggtaaagctatgtcattgttaactgaactaaaggaactatcagtgccaaagaagaaagagagtaagagaaaaatgtcagaaatgactgtctagattcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaatttagggttaaatggagtggggccaagagagagcacggggcttgatactaatgcatctgaactcctgggcgaaataacttaaaacgtgggtctcactgacattgagtcagtggtatcaccatatagtagttgtgctacaagaacaatcttactattcagactctttgaatcacctgaaagtgttcttgccagtagcctcttcccaaaagagataaccaatcctgagagaattccctgattttaagattgcataaatagctcatcaaatccctacaacattcagttgggatatgaaaattacagatatttttttcctcttcacttttcacatggaaaaacagaagtctgcttccattgcagtcaccccatctcctacaggggtgggaaatgacttagccagtattacagattgagccactacctctttgtaaatactatagttgagcatagaatttgcccacgtatggtacacccagggatttaggtggcaatcacatgccagaattttgctttagataatgagaatcaagtcataaaagaacttgtgaaaataaaaattgagacacttaataatatcaaccacctgatcattgtggtcagacatatgataatttcaattccttagcaatacttaaaaaaaaaaaaaaaaacaactaactaaatagagggattagaacctggaagataaagaatcaaacattagaacaagtaaccttggatcataaatattctctgacattttcaatttgcttgcaacatacagggttttgttttgttttggttttgcttccatgagtgtattgtatcccccactttctccccttctagaagctggctaagtatagacgcagacggtgaaactcaatcgcagagtgctgacagagcttctcttagggtctacagaacagatctactgagtctcacatctcttggtcagcagcgacaggtaaacactagctttattttagcagctcagctgcagctccatgggcagctgtccttactgcacataatcagtccctcttttcagggggttataactcaactatcaaaataccaaaatatgctccggtttgaaacttggtgtatagagtcccaagcccaggaatgaatgtggtttacttccaaatttaagaaaatattgagttttgtaggtcatttatttactattttcaaatatgtttgaagaatcttttaaatgccataggaaaatgtactaaaaaggacacaccattttaatacctttggtgattcattctgaatttcagcacaccactgaaagaaccaaatggtggtggaaaaaaagagtttgttttattttcttaccaaatacagatgttttgaccacttgggtcctcatcagtgttcaaaatattagtgtgttgtaacataataaaataaaggcgttaacttctttgttttgttcttttcagtgatgtgcagaatggattaacgagttcttgtttctggccctcgtataactcaaaaactcgtttcaacttaaataaattaagtaagtaattagttcataatatggcctaatcacctctggtattttgaaacaaacaaaaacacaaaaatggctgttgcacatttgcacttaattacttccacagaaaacactcatgtggactttattacaggtgacataaatttcaaatctaagctttgtttgtgatagaaacctgggttatggtattgtgtagacttccacgaagattctgtaaccgtccctactattttccttaagaaaatgaaaccacagtctatgaaaccacattcttgcgctcttaattggcaaaagaaagtgctttatttcaaaaactctggagaatagtttacttcctacagaggctcaaaggacgttaatataaaaggtagtatcatttctggaatttctgcagtgttcaatttttgctcttggagtctgaacagttcttgtttgcatacacgtctatctgggaattgctcttagtgatcaggacagccttatggaaatccttccagatgaatatactcaatagagcaaaaaatcttgctctgtctttaatgtaaaggaaaaaaggacttttaaacaagtgtgtaattgtgagttctagccttaaaggaactttcttggcttggatttcttctaccctccccttcagatacttaataatcaaagtatatgccaagaaactaatgatgcaaaccagagtattgcacatgaacttggatcgctttcccattgtgtagtgtgtgtagtgaccaagattggacccaaaaagtcgatgatagaaaatagacaatgcaacataatcaaggtacgcccaccttgggtaaattcactaacccatttcctatccttcataaatgcatataatgattctcagtatagattctgaaacttctaggctaatctggccatcagctgtgaaaggaagaaggatcaaccttgattagtaaacttccaggtcatttgcttggcatgaacccactgatgtgttagctgcatacctcacaattctttaggtgttatctgatgttaccaagcattcctgatgccctttgaatttcaatacagaaatctaagtacaactaaacatttccccaagctgtgacagccttatggctattactcattttagaactgagaccaacttttcttctgacatttgacctgggagagtttcttctttagctttctgagtcatgcaaatttattcaaattctgtattgcaacccttgtcagttgtggccatacattcacttagtgatatcttacacacaataggctctcaataaacatttgctttccagaatgaaactagccttatcataagaaaaaatggaatagatttcaatagagttataaatgaactagaagaaagactaatagatcttgagtatattaaaaaaaaaaaaatcaagcagtgagaacagttgggttttgatacagtttcccaagggaagtagtagaagtttcattactcagggcattttaaagtagaatagacaaaacactagtggggtatgttgaaataaaatatgcgtagtccgtctgtgaattagtgtttactttcaatataattataagtgaagcaacactgtaatgggaatttttcatacacaggaaagctatggctactatgtttccacatcgaccatatgttgcacatattggttgctgtggatgtgtatccctactgccctctagtggatgaaatgtaagacctacctgattaaccagatctaacaagctactggtttgggggtatatcaatctttaatcatttagggtagaaagaaaatagctgtgttgatgcattttccatcaaattataaaattgaagggcattaaaaacaacagaatcaaactctgtaattaagactgccatttaatgtttgttcgcacacggtattcatttctgtgtatccctgccaaagatccattgtgtaatgttgtcctcacatgacattaaaaacaccagttccctggaaaatacaaaaaagaaaccgtgctgccttgaaatacacggagttcactttcagaaacataaaattaatacagacacagtaacataatttggaacacaaataatggctacaagaaacttgaaaaccaggactgctccttaactctgagcaagcgtattagcagtctatgggtgtgctggctggtagtcagaagagggcaagcaaaatgggtttcagaacagggaagctgatttgagaaaggactgactaaacacatagtaatagggcaggaaaataactctaaacacacatttggtactgtgggtatatatttaatgctgtcacattgaggctgcttttcaagtgtagcacccagatgctgtactcccaatgaagaaagatagggacctgtacagttctttggcattttgtcattaagacacaggacaaatctgaaggccatcctctttgtataattttaattattttacaggatttagactttaatcactaagttttagtctcacacttagcatataaaataattctcctaaaacaccaagaggaaacaattatacaatctacgttgccaaaacaactgacataccaaagagaataaatgaaatccgaaagaagagaaacataccgtgtgcatgctgagtgcaccagggcaatggcccttattatgaatgtgggaaataaattggctaaatctttaaatatcataaattgttcgaagctggtgatatgtgagtagatgtacacttgaggggaggggaactgggtgggcatggcccagatcgctctctgagttagtgacagtttttacagtacataatttggtaaaaaagtattggtttagtaatgaaaggtaggtcccaatggacttctccttgtaaacttaaaaagagcaacagacttatctagatagagctacaaagcaacatgaaaactctcattacctgagtgatctagaagaaaatctaacttgataaatatcctggaagcattgttttcatctcaactagatttactgtatagcaattagcatctctatagatagatatggggaagcccaggagagctgggggtaagcagtatgggccaaaaggaggaaatacagccaatttcctacttagcaccacggacagagctgtcagcagaaagaaacatccttggagttatccttggtgttaaagaaacacaaagaaatcagtgttgcattttaaagatgcttcttatccccattgcgactggcagtctgggttggaattatgttccagtgcttccctgtagggcacccattggagctgaacgaataaaaaggtgtcttgcccgcctgtgcacatacaggaaggaaaggttgatacaggagaatgatgtctccttgacttttgtctgactcttctctggtttttgaaaaatcatagcactctgaagaatactatccagtctttcccatgtcaagacaagtccctgtgcatttcagccttagggtctctagggcacagggattgctctggggcacaactagggaaagggaataagtaaagacaactctaaaaggaagtaaaatgccttctattccatctcatgttatagaagattacaaataagaccctcttcttcctctcagttctggcctttatgaggtggaagtcactattagactctataactgaataacagattctggaaaattagaactatctctcttgcacttgagaagtcagtgggtctccttttctgtcctgctgaagccagatacagacaaatctagagaaccagttttatgaaagaaagtagcctagcacaaattatttggcattaaaccataccatcatttgctaaagacttggagtcaaagcttttctcatttgattgttaataagaagcttatatttctaaaatatcttgattaccagggaacttgtgggttttggctttaatcaattcttagggcttttcctatcttttgtttcttagacctttatgtccacaggatagtctagagagttgaaatttactttttgccagctcactatgcatgttcaccaaatggtaaagttctcactttaaagcccagcaagacaagatgagctctgtctgcccagcagcctttcagaggcattaagggtaagagagaaggtaagtaattcactatgcgtccccatttctataatggggaaggacgtcttgatacatttacaatactcctctggggatatttcatcagttatacctaaactctaatggacaataattgatttgaactttccacttagcacagagctgtaaacagcttcactgcagacggcagcaatgagccgacgttttgtaaagtggagagagattcagaaaacttttgtactgggtcatgccgtagcctaacagcttttgaatccagggaagaaacagtttgtcctcctggttttaatagctgggctaatcgagtttcaagcctgcagtaggtataggttatcttttgaaggcattccattttaacccctcactattatgatgggtttataacctagccataaaaatgtactcctgatttagacatacatcaggacacattcaaaaacataactttctgaatgttaatttcctggtgaaggaaaaaataagacattaaagtcattttaagactacagattttttttttttttaactctgcgtgggtggtgagcctttcagggaaaatattccctctcctccagtgtccctcatctggttgacaccaccctgtctctccctctcactcaacatcactttgtttcgggctgtatcttagtgcaatctcccatggaatggccccaaagactaatctgctacaaggcatgaaacaagcacaagtatagctctgttccatgactttcttttatagcctccctccagccccgttgaacacacaagtagatgaagtttagaagaattctttcactatttaaatcagctcttctgtctcactacggcatgatagagggtaaaatgaagagaaatgaaagactaactacattttacttagaccactacatcgtctgctcagtctatagctttcctattttgttccacactcctggaattctcacaatgggattcaaagctcacctagaagccactcttagacaacaaaggacacagtcccctttggagttgttgctgccacttctcttgtgtcaaagatctacaaaccttgtggctgtgaagtaggactttatgaacacacagcaagaaagtatattttgtgaatatactgcaaccggacgttacccgccttacatgaatttgacatggaatatgaattttccctcaattcagctgataagattgtaagagcaaaggcataccactgtcagaaaatagatttaccctgcacccccaattgtaattccctttctagaaatctacagaaaaaataggatataatcagacattttgtaagatgttgtccagattctgaaatgcattaaaatcaaactgaacataacttgttccacttggtcctgaaaattacattctgtagcttctagacatcaaacttagttctggttttgatgtaaccgctgattatttaggtaacactaagcaaggtactgaaccttacagagcctcaatttttccatttctcatttggggagaatgacacctgtgtgttcttatttattgatggatgagatgaaattatatcataagctactgaaaaaaatggtgttatatatattttgggtcagtcacctttacctttacagcagcatgaccaatgattggcaaagtagtcaaagtctacttcacccctcctgggtagaaggcaacatggaaagggtattttccatcatttggcagtaagggcctagctctacccatgttcttccccaggcaagcccttttctcccataatcaaagggcaacattttaatatttaatctttaaatcaaatatggcattctcaaatttgatttaaccaatgtctaaacttcactgagctttcagttgagccactaactccctctttcactgtcaagcttccatggaacactctttaaccacaaaattttgtacaatggtacctagtgagctcaaatgactttctcactgatcaacaattattagtctgtaaggagtttatactacagaacatcactctggtgtgtcaggctcagctctcatagacttaactaagcataaaatgtgctttacaaataaaatgcttataaaagttaacaaagaagttaacaaaagttaacaaagaagtggatgacttacattcaccctgtgttttataccttggaattcaaagttccatacttaatggaaatggggaaagcttagcaagggttcagagcaaaggccaaagaaccttccttccttgtttgcccaaaatattaaagagataatttgataatggtcattagtaagatgatgtgttaatagatgttccttacctataactcagattaaacatttaaaaagggggtttatgaagtatgagggattgagttgagttataaaattattacatacttcaggagatgttaaatcctcatatgaaatactctgatgttccagtgtaagttttatgaaatacatttgatccctatttatctgtgacaatttagttaacatgctactagagggcaggacaggtgaaccagaagagttctaggctttggcatctcataaaagttaaaaatgatctgtagagcttatcttgaaatactctttcataaaatgtatgtgtatgattcaatgactgagccatcccacatgctaagttgactacggtcatagggaaccaacctcatgtgaactgtttgatcccattattgaccagtctttatcaatgcttggcagaggtcaaggaagtaaatctaacacctataaaacaaataagcgatttccttgtttgcttttgaaaatgccacttactgattttatttttctttacagttgttagcagctgtacacggtcatattataattgtcacataacaaccttaattcagggacacatcttttgaaacaatgtattattcagcaactttgggtaaacatgcaatttaggagtggaaaagatgcacacagacacaagtaatcatagatacaaagcatggtgaatttctgtgccatgcacttcacaccccaactcatctcgcagggaaactagagaaggggcagaaccatttctattatgataattcacaaagggaggccatatagatatgcatgcaaagtctctccccacctctccatttacatgccaggatttcaactctgcgacactgagtcccttcatttagccaattagtccttccagcttcatgtaatgcacgccaaaaagaaggagaaatagaagtgctgacgttcactgctttgaaagttgctattctaatgccaaagctgcctcttgagcaatttccagaatgtattaacatgggagcaaagcgctattcctaaagacagggatcacattatgcaggggagccccgtttaacgtgtcacaattgcacagaacctccatcccctgcacgatcttacagttgtagtttgcatgggctcaagtttacggtctttacttaggtgaaacttaggaggtcttcctaaagaaaagaagcaatttaaaaatatctagtaagcaaggcatggcacatcttttgtaccatggcattgaccaagtccttttactgtcattctgaagaaagctggtcaaggtgtaaagcaaaccggcctctcagtttaggacagagtgaaggattcttcagtttctttctttctttctttttttaaatcaattaagtctaggttcaattttaattattttaatttggcagacatccctagaattttccctccatattaaggaccaagttgaaaaccattacataattgtgtagctgtgtatctgaatgccctcttatgcacgtgattctgatacttagtaggcaacaaggtgtcgctctgaaatttgaaaaaccattaattcttcagctgaccaccctgtttacagctgaagcagtgatagagattttaatatcgccttctcccttactcttggcaatggatttacaaaagccagtttgtgtcagcctggccctctacaaatttagctgttctttgcttaaatcatgacatttgcaagagatgactggacaagtcccccactgaggcagcatagcagaggtgaaggggcacttgaagtcctatttcttctacacgttgtctctgcttacttcgaccacatctgtcttctaggtctccttttcccaatacacaaaatttgaatactgactgagacgatcctgcagggttccttctagcccttttttgcttttttaccctaaaacgctcaaaatgatttctttctatgtctttggcttctataatttataatcttggctcaatcttctcccttcatttatttcctcaatattaccttttgtaactcttaaatatgctgtccctcaaagaactatcttaaggccatagttttttcttcttatactcatgcatctgaagggctgatgcactcatccatcttttctcataatctacctcttttagttagggttaactaagttagttaacttagataacactttctcttcagaatatctctacttagatggctgctagcccctcaaaacccaaataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaaaaaaaaaaaaaaaaattgcctcctcactccaaacatattctcaatggtttgactgtcacagttccctctttagtcctccagtggctttctaccctacttcagatcaattgtgaattatagactcccagcactgaaagccccctccctgtaggtctgcttgtctaacctgtcagcatccggtgccactaaggcccaccttaatccacacagcaagtcgcttttgtcttctggcttccttccgctgagaatacaccctctccatctctgaactttttccacataagcctgcatctacggaataatccctcatgcactgaagaacatctttccttcattcagatgataacttaaacctcacttatgccagagagatttccaagatgattaccagccaactgttaaccctctaaaacaaggtaagaaccactccacccacctttccacacatttcagaaaaaaattatatttttaattgtgtattgtagttgtttataaattattttgatggcagcaaaatatggtatttaatacagtttatttattgccttgcaacttttaagtcttgatttcaaattggtataaaaaacaaaaatgaaaaaagtcccattttgttactttaatatatataaagccatttaagtctcatgctttttgagatctgtcaaccgctatgcacatgataggtatcactaaacacacacttgttgaattgaattgaggaggaaccatcttaaacagtttactcacagaggaggaaggaatcagaagactatgaacataaatattccatagcagcatctgagtgtaacaagaaataataccaaaatgagagtttcccaaatttctctcaccctcttgattgtttaatattatattcataaaactatatttttaaaaacagctttgattttaaaacgttaaatttacacaccaagaagtagacactagcaaagtctcatagtctgatttatttctctgtaatatatctgtcttgagaacatcagcaggaatacaccaaagaaatatgtccctcacgggatcaactatataaaaagacagaacacatcatcagcacaaaaatcattatccatctaatttctcccattctagatggctccagtgagcccctcgatcattactgactagggttaagatagagcttaatggattaattaagccaaagcaggactgcaatgcagaccgaagaggagaaggtcctgacacagatgagacaacaactctgttcctcttttattcaaatgtgcaagacttgcccacccccaagtactacacatttatactgtaaatagtctccaaaaataagatttggtgtctgctgtctgggtcttcccctcagcactcaccaacatctaatacttgggtgttaatcaaaatgtatcgtgtaataagaaattaaatgttaagactttctttttcttcagaaacgtggagaatgattgttaacagaggtaaagcagtagaggcagagcactcgttttggcaatcaaggagcaccaactaagggagaggttattgtttgaatgtcaatgtgactctgagagagggccagggacacagaatattcacaaagagctgaaaggaagaagtgcccacagccataaagtcacggggactggggggcatgcccaaaggcatctgtcgtaatagaaaccttgagatttgttcatttaaaggggattttgaaattcaaatgtaaaaagagaacaagataatccaaagggcacaatttggggcctttttcttcttgtaaaaagaagagaaaatagagagaatcccccataccccccaacaaagtactgtaccatagtggcagtttactctcacttttacgaaccaaatcaacatattaatgacttaaaaaccacgttcacaatggggacaatcagactctatcagacacaacattaaatacgcaggtattaaaagaaaaaaatgcaaactaccaagaaatacctcactccggaaatggtaaggctgacgaaagcagactatgtcattaataccaagcacaccagaaaggcatctatggagctagactgggagggacaggcctcatttgcaccaaagaggaagtgccctgaaggggcccagaagtggggaactgggtagattttagtctttttctttttttggtaggtggggggaatgacagaaacctggcaggctcctgtggaggtctggctgcccccaccatgttgagtcccagtgtctaagtaagtaaagaaatgaaaagacacctatctcaatggttgtcctgaaacagttttaaaagcaagtacaagtccccagcccctagtagaatacaaataatttcatttgtgattcttgcatcaaggaaaaaacttgtgctaagttcaaacaataggatacctctcaaaaagatatgacttctcactagagagaaagaatcaaattctggagtgggaagtgttttttaccttagtgatcttttagtcattttgtaaatgaggaaactgaggacttgccaatggtcacagaagttaattctgtagttggcaattctagcagtaatgaatttacagatagatttggggctatgaggaatccagtggaattgggtccttcaaggccttttatttaaacaattatacatatatatacaaaaaaagatacagggggagagatctatagatatagataagtctgtataaaatatattgctgggtagtaaaaagaggaccggtgttgtagcattttcactaccatggtcaagaagccacggactagattcatttgttcagtgaacaaacagttactgaactctgtgtgcaagtattataaaagtaaaaaagtacgattagacatagtttgtgctgtttcaaaaagagttaacagtatagttgttttatatctacaatacaacctcttaaataatcaagtagtcaaactaattcctattggattaatacaaatcataatcattaattttgaatcttgagagaaggcataaactctgcattatattttagttagacactggaaataatctggaatgtttctggtaccccacatctaaagattggatttcagctattcggtgcatttggatgtttttttccctttagaatccatcctaaattcaatgccctaactcggtagctcagaaacagagctctctaggcattgctgctctccttctgcccagtctctgagagggtattgaggttgaggatggggatgaaactaagaataaggcagagaacgttgctaagtcatgcttctttcagatctaacacatttgtagtcagacctctggccctccgtatccatgggttctatatccgcaaatggaaaatatttggaaaaaaaaaacctccaataaaaaataatgataccacaatgaaaaataacacaaacaaagaaacagtgcagtataacagctatttacatagaccttacattgcattaggtattataagtaatttagagatgatttaaagtacacggaaggatgtgcatgggttatatgcaaatactatcccattttatattagggacttgagcatttgttgatttcggtatctgtgtggtgggctggggtgggatggggtgtcctggaaccagtgccctgctgattggatatcaagggatgactgtacttaatctccaagtcatttcccttacagttatattttagtatatggcaaagcacaatgatttcctttgagatgaacaaaaattgagtagctaaaacctaatgaatacaattagtttaagtaatctggttatggagaaaaatcactagtagtaaagaagtgatcatattacccaagcatttctcttaaaaagaagaaaggagaaagataacatgtgagtgcctactacatttcagtactatgctaggttctttacacaaattagctcatttaattctcataaacatctcccagagcagagattgtttccatttcttctggtaaagaaactgaggcacagcaagattgtgttttgagcagacatacaaagctagaaagtaatttatggcactcatatttggatccaagtttgtccatctacaaagcctataagcctgctaagggagaaacccaaaaatgaaacaacaatgaatgccactggcagtctttttattggatatctactatatgatgctaagttatgtgcccaattaattcgaatataaacacacattttctgccaccttgatgtttaaatatatgagcatgagcaaactaacatttggatccaccatagaatattgatgtagaaaattcaaatcactcatgtatttttttaattttagaagacaatttacctgatgttgcaaagttatcatgcaaaaattaatgctaaaaacataaaaaataccctataaactctttcagtgccagggaacatcatgcactgctcctacaaaaacctggcacagtgaattccctgttaactgccagtagatagggttttatccttaaaaatatttaaaggtgagcacatagtctgcttcatttttactccagggttggcattctcactgcctctacttaccttgttttctgtaaagtgtggaaaggaaaacaagtgaatttttctctcatatatgaaggcctagatgtggggaaaggttgtttaaatgaaaacatggagtttctcctcgtgctaagctggggcatttggagagtcccctcctccctgtgcccctccatccacacaaacatacaccccagttcacgttctagtttcacgcgggataggaaaagaaaacgaaaaacagaaaaagcaggaaaaagtacagaagaagaaggaggaaggataggaagagggtctaaggaagtagtgtagtcttccagagtgctccagaaagtgaaacgatgaaaagggtgagcctcaagagcaaggcacctcccagctctccatggatgaagagtctctatcagctccagaactaaaaccctcagtaggcaggatggtgctaaaagaagaaaaactctggaagggggtcagagacggatattgcagagctttctagccccttctacattacgtataaaaacgattattcaagaaataatgtaattttccagagcatgttcaaatgcaagaaaaaggtgcattctaagattaaatgtactacgacagctaatgattcattatgttaaagttatttattatttacaattattttctatttatgacattgtagtctttcattgacacttgataatcaagagttgacaaaataccatttgaactgctttgctaaagaacaaaaaaagagggattaaggtagacaggaagtgcgtccaccaacaataaaaaggacacatgactcataccccaatattaatgacaaaaatatctacagtgagatcctaaagttctgggtatttgtctaatttttccacaatcagaaccaaaggtaaaaacagcattgacagctactgcagtttggtctgtttaacagaccaaatgctgggatttcaaagattcatggctgggattccaaagatttgtccatgttggaaacagcattcacagtagcttttcggtcaagtggcacaaaggagtgaaaaggtagaaaaggaaacattagcaccaaaaatctctagtcatcttttaccaccttaacatgggttagctgaaggccatggagaataacggatgtgcagttgtctctttcttatacagacagcagagagaggggggaaaaccacacacttatattttgctaatgtaaaagtcccagtggaaacattagcactcaaagacattaatgtggatttgggacactccctgaaggattttgattccattagaaaaaaaaaaaaagacagtgacagatataatcctgctttgatatgtttaatgccatttaaagagaaactgtacccatttacctcaggccaggacaccaagagttcaaaaagtgaaataccatttctcagtgcaaagaaaaagcttggaaaatattatgtgaaaattaatttggcatgcttctttgaaattttagatttctgggatgagcaaatgggtacagttttcttttaactgtttttgaacaccatgtgttgagaagaaaacaacagaatggcaattgctcatccaaaatgctaacttgtggcatggcacagtcaagatggcctgccacagccaaaaagcaggtgtgtgctatgcctctcacttcagtagcatgcacgccacatgtccctgcattcggcaacctcttgcatttgcttttggaacctttctgagggggacagtaaacatgactcaacagaatgtctagctgaggagggactggctctctgagcctgctgtgagacagactttttgaggaagaaccaaaggaaaactggaataatgtatttattttggaattctttggtatcacttcctgtgacctaacaccaagacgactggttccagatcattttgtgtggatgaaatttagcatctaatcaggtcggagagtaatggtgaagcttttgtgtgactggagaggacacattaaatcagctacctcatttggactgaggtcaaggttaatgtagctggtacagatcatacgaacctaacctaaaagcttagagtaataaactcctcacccctcaggtccatggataagcttgaaacagggtgtacaaaaccatttggtgtgctgggatgccaaagcttcttcaatctgacattatgaatctgttattatgttactctaggaattaaaatagttttacgtagatataggtccttttcaactatacaacagtcctatgagggagacgaggaaacagaaaaaaaagattttccttctgccctgtaagaagcctgataaagaggccaagttaaaagtcatgaccacgtctaagctcaagtcaggaaccacttggaatgaaatcccaggatatctgtgctgtaggaatagacaaggtctgaagataaagaagtagatgaaaatcaaaattactattttagaagacaggagtgggacacctctactttattctatacttttaataaatacatcaataataatttattaaaaacctactatgtgcaaatgtcaagagtggggaagaatgaaacctataagtaataaactggaaagaaaaaacatccttaagcttttctgatgtaactgagtgatgttctctgcttctgagtagaaatttatggattcagaaaaggtaatttctttccaaacactcacatgccattgttaatttcactcattcaaatcacaacatttactactataccttttatttctgatggcacattctaggtgttgagggggatacaactgtgtgtaagtacagtctctgtatttattaagcttactgtgcagtggcaggaggaatgagacatataaacatgctctagtataagacagtatgtaatcagtgccacaggagacatacaaataagtgctttagcagttcggaagaagcaagtcctcctggctatagaaccacccctccatagacatactgaaatgactcaatgcacagaaaggaaggatctgtacaactttaagtcaacttacaattgatgtgcattaggggattggagggttagctaggctgtgaggggagggatgtgctcactgtgtccacagctcctctcacactgggtcaccccataattaatgtttatcaaaaacatgcatggataaaagtggaagtcaattgaatgatagaccaggtcaatgggtctgtgttagttctagatattttagatgattattaacaccctgctagaagttggcattataagaacatcattttcttcccacactagtgtaaaaagttcagttttttacccattccagagtgatgggaagtaaaattcagggcttcagtcttccaaatgagggaaatacttggcctgtgcaaaatgctctcggtaggggtatcaaaatgtctttcaaaacagcaaaaaatacatttcctgatagcccctaaggagtatgagttggaatccatgttctctagatgtgacgatggagttcgggagaggcaggtatgctaggatccatataagatcgtatttcccatggtagtgggaaatagaatttgaatgtcctggcttctaggtctgggttcttcctacagaaacatctttttcattttgtattcctcttggacactctagtcctttacctcatgaagagtagccttctgcaattggggtgtgtgtgtgtgtgtttgtgtgtgtgtgtgtgtgtatctttctaagagagaggatagccttactgatgtgcttttgtaaaggattcaaggttgtctggatcctcaaataatgcaattgaaaaaatacggtttctttgattcaatggtgcttacatttgagcagcgttttctttttccattctcaaacacagtatttgagactatctgccaacaataaaaaggtttagagcatcaaaagtgtaggcgaaccaaatcagaattaatctctgtgaaaaccgagattcaggcgcatggaaaaagtttaggaaaaaatccaggtgggaggcaatcccatagaaaggtgtctggcatctttcctgattcaaagtgaggtgtagtaggacacatgtggaagagagatgagcggttctagctattcatatgatccattgtctcaccaatgctcacacaacttgggactgtgttatcagggggccatttgatttatcatgtagtccatgtatcctattgtatgtatgatccggagagaggttaataaagggaagtctaagcttaactgggactaaaatgaggtggcaaacagccattcactcaaacaagactcaccagattaatctgtggagtatccagcagcatttccttttattatcatatgaaaagctgtgcattttattggaaaataattaactctttaaaaaaaaaaacttgcacaccatagcagcaaaagggaggaagataacagtgatcacttctgaacacctggtacacgtttggcactgtttttctttatgcatggatttctttacatatgttatctcatttgatcttcataccaactacgaatgattgatattttgcccattttttttgtataagaatcctaaggttcagagaagttacgtaaatatcctttggtcacacagctagtagggactaagctggaattcaaattggagcagtaggacacaaagcctgtgctcctcaccatgccttgccaggccagacttcatgtgcttttcatggcatgaaatcagtgttgggggaattctgcccagcatctctggttagcagagtgaattgcttttatcatttgccaacatgtcacagaaaaaaacaaaacaacaaaaaaattaaaactcctggctctagatttcctatcaacctgaagtttggcttggttacatattatttgaatatctgacaatcttataaaaagtctaacgagaataaaaaaattcttcatttatgctagctcctatgttagctaaaaatctcctattcctacataacaatgtgcctggggaactctctcactgccagaaactcatctgaaaatgctgaaaagtcagaatttggggcctatatactgactaatgttaccagctgtgagtcagcttgaacatcagtaatatgatatttcccgctacaatttgatttggttaaaatgtgtttgaagttcacccttttattaactggaattaccacctcctgtaactggagggcctctgagaacaggctgctggtgcaatccaccttcccacccgccaacggtgcatttcctggcaacaaatactattaaattgataactacagaaataggtcaaaatgtcttttcaatagttgctaatatttctctaatgctccatagcctccctttgattcttgtgctgacatttttttttgatgagtgcaggagcaacaactgttaaagagaaatgaccagaagaaaggaaagctggctggggtggatggaggtgctcttaggagttcccgtatcagacagaaaagctagatctccctagaggcccaagggccccaaactcagctctgctgttgagtttggtgacccagaagaaaacctgtgtcccatctgagcctcaatactctcatctgtaaaaagaggagactcgagatgactgattattcaaatttgcaaaatgcccagagttcacaggaggtagaagccctgacttatcacaaaacatttgggttttaaatttgtttatagtactcttataatgttacctgttaaggccttggctatccaagatagaaacttattttcatacaaaaaaagtaatattgtgttatattttcgtaagagagaccctttgctatcatactgggttttattcactatgtaaacctatattccctccctctctttcctccaggaacaaagtttgcttttctgagttcacatcacatgtgtgattacagcaaagacagaagtttgaggctgcagtgagccatgattgtggcactatactccagcctgggtgattgagccagacttcaacccttaaaaaacaaaaaagaaaggggtggggtgggtatagtcacattgggaacatagctgattgtgagcctgcaagaagaaaagtccccttgctaaaaaaggttttccagcacttcttctgagatgcaaacataccacggaggggtcaagccattcatgccttcatgctataaccacttcaactccaagagagttatctcagtgtaaagcagttttgaactggagctggagggagggatagggataattctggaacaggggaaggtgaaggaagcaatcagattaactaacacaaggaccctaggctctgctggcagaggagaagatgaagtgggtgacaaggactgaaaagaacccagtctctattgcagtttttgcccagggccttgtctggagctggtgaaccactaaaaaaatcccttgagagatgtcatggtttatcaaaaatgcctttggctcttctgttgctccatggttgtgctgttgctcaacaggcggtcagcaaactacagcctacttggttgaggtgagagtagcttaatctcatataatttaaactcacaaagactatctctccatcagatcccttctgttttccttcctttcctagagcagggaggaaaaaatgtgtgaaagtaagggcaaagaaggaggaggaagaggtagaagaaattaacctttcctcagcttccaagtgagttaggctttgtgttaggtaagcatctctctagatccttccaacagccctgaagatattattagtaataggaagtattttatagggttgaagcagctaactagagctcaaggtggccagtcaggctccttgttacacagcactcttttctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttttgagtaagaagaataaaaggattgatctgagctgaaagcagaagggaagatgaggggaaggccacagaacacatagctagcagtggcattggtgggggtctgagagaggcagaagcccagggccagagctgagagatcagcttgtttttagcatacacggatgtgtttgatcacatgatggttgggaggtacctaggctaagataatcttaatgttaggtgctcattttaaaacatcaatttaatgactgaagcctattttaatgatccaataaaggccaaagccctcactactatgatacaactatttctccctagtattcactccttgccaaaaaaaaacaaaaaaaaccaaaaaaaaacaaaacaaaacttggctgagacagctatagagtttctgattacaaaacaagatcaccttgatcataatcatctcaaggtgcttggaggaaagaaggagagatgagttcttctgaaccacattatgtggacagaaatcttcaaagagtttaatggaggaattaacttttgaggaattgaaaaaggtatcattttcagtaagagaaaaaatgactgatactttcaattggtatgctagggaaagataaattctaggcaagaccagctctataatttgtggggctcaaggaaaaataaaaaaagtagggctccttattaaaaaattattaagaatttcaggacagcaacagaagcacatcaagccaggcatagggcccgtccaaacatgggaccttgtgcaactgcacaggttgtatacccatgaagctggccctagttttagttattgtttttaccaaggtattccagtcccagagctacccagacccaaatggaaaagcacataccacaactctcaaaactctcagttaaccctgtcttcctacggtaaggacacaactgaattctgcaacaaggatcagaaaatcctggggtctgccaacatatttgatagattgcaactgcactggcttctgcgacatttgtcacagtcactaatccgtgtttctgtcacaacctaaggatgcccaggatatcaatgtctgggaattcaaacatattttctaaaaacacaaatttatttaaaaacaacaacaaaacaagcagaagtcactaaaaagaagctgagtcccctggatgaaagtctgctcttaatctctttctggctttaccttgagtaggtcttgggtgtatgcacacaggttcagaagtgcaggtgaattaccacaataactcttttcagttagagaaaaaatagcagaaacagaagaatctggtcatagcctagcagaaactccctcatttcaccaacagtatgctttctccctttcttattatgctaagttgaagcgatgacttcactctccatggaagctaagtttctctttcctggatgcttggaatgggcctggtgaaaagctattggagggtaacatcatgtctaaaaaatgtatgtatgtatgaagaaagtagagatttaaagagctcagaccaacatcaaaagaataacagcagtccaaagtgaaatgaatgtggcctcttttccaatgaccttagggactttatatatacttagcctacttcttgagtggatagaccagtagcttggcagatgcctaggatgtctgtacaggttgaaacttaattccgtcctttctatacatctttgtcccattaaagaaaaatatctaatatagagaaccagttcactcctacagccagaattatactttgacactagaccaattgctacatccttgatttaggattttttaaaagatatctattggcaaagctaatcttttatttggcttaataggtttgtactgctgctctgcataaggccattagggtccataagtagatggaaatgtgtttgaatctctataatcatgcttagatttcaaaagtcttccatttcacagaggtgatgtaggctcagccatcattttcaagtgttttaacaaatggtaatcagcagagaaggtcttacttttttttttttaaaaagtgactgaccttcacaatggatgcacacataaaactctgattcatttattttaaaaccattctcccctgctgtaaatagatagctacgatatatacattaatatatgtgtgcacaatcagccttagcaatactgctgtgaagtagatgaggatagatggttttctatttatttgacaaatacactattacacagataggttaagcgatttgtcctgtaaggaagggtggagctgggggaaaaaaaaatcctcccacatctgctcttacatgataccactatggaattgggtatcctttattgtttttgagtgacttgatctaaataatgggtaatgtaattttcctgaaaaaaatttcactatttctctcattccctcttactttcttcttctctctgcttctcctctgagattattataaactattgataaatgtggttgctctaaatttacacttgctcttcatgggctttgatgggtttcagcttctaaagagagcataggggagaaaaaagcttatttctaaaaggttttaaaaggatagataacgctgggacagtttatttgaattaatgtcactataaagtggatactggtacgagtactgtcttggacccttctctcgcaagagctagtccaaaggctctgaagtgataccatgggaaggaagagctttttggaggcagaacctgctcatcaacactctgctattctcctgggatatcagacaaaagccagagctttctgtgcaccttcctgttgaactgctttaacttggaactattctctacattagggctgtcctctctgagtccctgaccttagatggtctttctctattttggcacatatttgcatatcagttacggtgacatatttgataaataatgggcctcactgttttttggccagtgaaaaactattttgctattattttaactctttattatctcttttgtcgattatttgtgtgactaaaaagatttcttgtctcttatcatgcttctggttactgtttctcaatgtcatctggtaaatgcttagaaaatacaattttattttgataaattctaaacaaaacataattatgaagaaaaaccaacagagacaagtatataatgaattttgaagctaaatataataaatagttctgaattttctgccactccggctcatttagaatgtaacattgctgacaaattagttattcatgctgttttttaaaaatcaggggcaaaattataagtttcaattctcctaataggagttataacccctgcagcatgaaagcacttgagtaatgtttgctatgtgaaactggcttcggtgatttctcctgaaggaaactgcactatcaaaaccttcatcaaggctgcttctgtttaagacccactgcactacgaatgtccctgtacccgtcagaaccttggctggctgtcatcccatcaagcacctcatctgcagttgccactcagacatgtaaagcgtgtgtttggggacgacgcgcggtggaatgagaagggatacagagctctgttgtaccactacatttattgtaagcaaccacttacacggcaactgctttgctcttttatattctaggcaacacaccggtgaatataattcataatgaacatattcaacattttttccatcagttcaatacattattcataaatattagagatggaaagacctggaagattacagagtccaaacctcctttttgtaactccctttcccctaactgttgatggtagctcaaaaaatccaaaccaaaaccaaaacaaaaaaaaccaccaacaaaacaaaataaaccaaacaaacaaataaaatacaaacacacaaggaaagcaacaaatttacaaattttataagtaaagtgaaaagctccaaagctcgtgtttggtgggggttgttgggggcaggatttacactgatggagctcgctgaagactaggagtatggatgactctttgctttgaagacaggccaagggagggaaatgtcagtttcccccttttagataacaattcaaggtaaagcccaagaggcaataccaagttcttggccaagtgttaactatccatctctacagcctgttgtggactcaggactcaggcactcttctcttcatttagaacttgagatattaatgctaatgataaaaagaaaatgtataaatgaatagagagtgaaaactactagagaatgctccctgggattatctgtactatcaagataggaaaactttgcagatgctactgtctctctagaggaataaatgcttgcattttaatattctcagcagctggttcctgttgaatgccatcaggatgattcagccacccaccaggaacaccagtaacagcaagtgcacacacagaaatctgcaaaactttcttctcttgatgccaacaccattactctggcaaagtcaaaatcctttattgaattatcagttctactaaatgtgaccttgttcccctcacaaataccagcttattctcaaataaatggaacttctggctgattaaaatgtaacattccttctgacttgagcacaccctgctgtcagtctctcttctgccatgttcatgtgatctacctctttttcgttttcttgctatccactgaaaccttgaaggactggcaagatccatacatactcagagtccactttgtatgttgctctgcttgctaaacccatacatttaatgttatatctctacccttacatgtctcaagttatttcatcatttccattttttagacattttctatttccacagaatgtgtttgtatgtctggaaaaacagaaatgtgtagctgaactgcatttaccattgacctcattaatacagaattaccatgccatattcaagctagataaaaatgctatacttgccctcttcttcaaatttagaccagattacacactaaagggaagaaaatgccaaagatgacagctagctatcaaaaagatctcactgtctcattttcaggtctccaaagtaaaatctaaggacattcaacacagattcaggtgctctcaacagccatgaaaatatatggctgaagagggaatctataaatgtaatgaatacacaattggcttataacagatgcaaccaaaattaaattcgatatcttgacctgctctccaaagtgaaagtttctagtttaggctacagacagaggtgtaacaagctcattaatcacatgaaccagaaatataagctgacacttctggggatgctgcaaagagcagtcttaagctgttgggggtctgtggggaacctgaaaaatcatgtggctctgacagtccacagcaagcaacaccactgcattttacaatgtatgtgggtcaggcactggccataaccaccactattttaaacttccaggacaggatttaaggatctttgtagggaaataataggtccaatatggacttttataaaaagattcaatatatttttattaggttcctgttacacaaaaatcattgtgttcattgcatgagaagacaatgaattaggtcaatctatgacctcgagaagtatataaatgggaaagaatcagaggcaggggaatattaataagtaatagtagcaataacaataacaacaatgatgagtgataaccttgagctagtcattctgctaagcactttatatactacatttcatggaattcttatagtatcctaggaaggcagatatcgtttttctctttacagacgtggaacgtgaggcccagtaaaattaagtacattgcctaaaattatgtagacctgttctttacattacaaataaatacataaatagcttgcatataaaatgaaatatggcaaggctcattaaaagatacaaagtgttgtagaaataaaggaggcagaatgtgtttctatttgggaatactaggagaaaaggaacatggatgggaaaatgtggtgtgtgcttaggaaacaaggattgttccagtttgtaatgttataaacctgttgaatcatcaatgtctcattagaactcatactttgataagatagtaaaatataccaatctgtacaggaatatttctacaaagaaatacttctttccaaaagatcttctgactacaatttctcaaaacttttcttgttatttattttttggtggcgatagagggagaaaaaatgtgagatacaaggctatggaggtctgggcagcagtgttaactccagagtctctagggagtacaatgcatttgggtgcattttccttcattcctcagaatgccttatcctcatcacacatatttgtccctgccacatccgaggtgaggttactggcatagaaatagaaaccctgagggtctggtttcttccacttcttcaaagtgggatatcacttactttttatttttataaattagttttagtggtcagccttttggcataggagtacatcaagaaaacgtgagttagaaaacttgagttctggtcccagttttgccttgctcatcttgaaagcattttatctcttctctgtgtttaagttttcttattggcaaaatgagtagtttaagcctgaatatcatttcttaatctgttggacaaccccctcatcaaattttttttgataaaaataaaaccttgttttaatgtagatccttctattcttctctatttaaaattcctggttcacagaatgcaatatatagtaccattagtccagataattttgtagagctttactttctctattttgttaagtttttctcgtaaattttgttttccaaatataaaacattgtaatatatatgtattttcaaattctacatggtcctcgaccagatattccaatattccattctgaagagttggttaacccactcacccatattgagatatctaaagccccttcaagctccaagatacagtgattatgatgctctgatgctgacatttgctttgtcaacgcttaaagcagagcttttaaacttcaaacaatagcataacaagttgctataacaattacacttacataaatctttaagcagatgtgcataacagctctttacatctactatcacactggacaaccaaagcttatgatgttgttataaatccttgcaatagtaaattctacagttaattataacctataggaaaaagtactgtccatatttagaattgattgactcttattttccacatctgttaattttgcacccagctatagggctttaaatagctcccataactttaatcattagcccccactcagtcatgacttctatgtctcacccttctgaccttgcccactgagttcactcttactgatgtaatcaaacatgtttcattgtagttgcattcgtcacagtgctcattagaattatcatcattcctacagcacctcagtgcaatgaaattgtgtgcctatgcaatttgttgttattttaagttcttcagctggaattttaaaaatctagatggacaattttattttatctgatcgataaatatatatccagttaagtgcctctgaaaaattggtaagaaaattatttattagagcaaaatcttaagtctagagagatttttgtaaacttggacagcagcattcactgaccttgaatccacaggttcaaaatttattagtgtcaagttagtcttttaaagcaatccattaaagcaataagtataaaatatatatggtttacatttatgtatgtgttgaatttaataaattagtcaggagtcaaggtatttttaaagaaatattaaatctgttctatattgatcaattaactgactttctaacttaaaatattcttttgctgtagttaaaacctttttttctttttaaaacaaacagagtacataaactgtaaggtggcaatgtagttcactgcgacaatctatatattccttaacgtttgttctttttatggtcatggtatgtagaaacaaataaatgtataatagtttaagtccaggagtttttgcctgactaaattctaaacacatagcttaaataaagggttgaaagcctggcatctcatcattactgtttatatgttataaggtttgcagggccaccttataaaatatatagttgtttattttcatgttcaataaataagtagtgtggggtttcagactgagaatggattacagattgttctctcctggttatttttggctttaagtatattgatcattttatcattttcttgttttaaactactttaaacacagcacaaatgttattctcatcatgccagaaatgggtttggaattgattctgagtttccatcaattttactctttgctctttgtgagaagttttgcactgcttaaattcgaaaggatagttttgtttaaaagatgtcacagtacaacatttagagaaccttagctgcccagaaaaactcagattttctgctttacaaaagaataaaaatcatcgaatttattaccctggactttattgaaatcagtgaagaatattcatacaaatacagtttcacgaacttcctctctctctttcttcatgtaagtgtttgacaaaagcatgtatcttctgagaagccggcctgattggtccaggttggcactgtttcagtgtttggcctacggcggctgcttaggaataatttcatctcatcctctctattttcctggactgtatcaaactcagacacgtggtatgcaaaggaaatccaagtcttttaaaaatgctatttcttttggtactaaagccaagaccagttctactttggccaaatgatcttatcaagatttaacaagagatattcagtaatatctccaatctgtgagaagacattccactaaggaagataatttattacatacagtgtacatatatttctccacttggtaccaggaagagacatgatcaaacttattctattggtactgaaaacaatgtaacactgacaaaaattctgtggcaattattcatttcaattaatttaaaaagaaataaacaagtagctcttcccccattaaaacagatactggaaatctattttcagttattgctgaaaatattttggcttccacaaaggcaccttactaacacactactttgccctccactgtgctgtcacaattcagaacttgtaacattttattcaggtactctagactaattagatgaaacaactgcattacagtattaagatgcttttgtagaattaaatgaaaggagatctgcacagttcagatagcttggaagatttgcaatgaatatcaccaaaatcctgcatgtgcaatatatttttctacatttacaaattagctaatgaataagtgtattccacaataactgctaggatttaatttcacacttaagaatatcaacaaacacagagagaaatttagataggtaaactccatttcccttcccaccccaccctagtgctcccctgcactgtttgcatttcagaacaaatgcttcatgtctcttgaaaagcgccaggaaatctcttctctagctatgcaggcctcaattttatgtgtgtagtatgacacaccttaaaagagagagccccacaaactagagtgggacgttaatttaaatacagacttaaggagaagagctccatctactgaatcagttagatcatagtgtgtaccctatagttatcccattcactactttcaaccacttagaggctctggagggaacaggaaagttatagacctgagcaaccatgaaaaacagctttgagcctaatgccatttgggatatttctcggataccctgagcccctttcctttgcccctccaatttcaaagctttccatgttgcaatataaaataaaaatggatgttttgctatatgaaccatcccttggaagtagaaagtcattggttgttgaaggaaatgtctcagacagttgaagagaaagctacagaaagaaaatctctagctggcaggttgggcagcctaggtaagaagggaaaagaagagtagcctacttactcctcctgccttgcaccattgctggggaagcctgcagccacccaggatcagctcttctggcctctccccggctgcacagtattgttgtggcattgggaatttgctgtggcttcgtaagattatggggatgtgcttcagcaagccaaaaaagtcacaaacaaaattcaagaggaaaaaaaaaaagtataaaaacagctgatcttactggagaagctcttggcattttcctacatatgccacaattttctctggtatttcctggttctgtgatcagaaaaattatcgtatcatatttattactgttgtttttttcagggttgctggtggtgacgggtggtacagtgagggcaaacagatggatcaaggagaagcaaagtaaagattacttctcccacttgtttgaaagctttccaagagattgcaggttaaaaaatctcttcttcagaatactgaagatgtatagatatcacatataggaaaagatggccatactctttctagattgggaaagaaaaaaacttctaacacagtaacagattcggaacaaagcaaattgtatcagaaaaaacttaaacgttcatatagctgcataaaattcagcagcatataagacttataaaaatacttcataaattaagataaaatatttgaatataaatgggtgttaagtatatatataattggatgaaagcaatagttcagtgaattttttattacagaaaaataaaatataatgaattaacaaaagttttacagtaatgctaaccttttctcttgtaggttaaaatagaattaatgtaactgtaaagtggattcatgtttccctgtgggtgtgaatgtatatatatacctgcccaggtattactgactgacactgaaaggtgatatgttgcaaagaaattcaaactttgagcattattttaaattgggtatttaaaatatcagtattaacctggcaggtttctttctttttctttctttctttttaatacatttaattttcagggtctgttttaaagcacgaaaagaaaaacagattagaaaagcattgcacatcaataagtattttgtaaaataatccatttgcatttattagaatattcagttctcaaaaaacggctaattggattttcttcaagccttttcaagacaagttcagttctgtgtcaaggataactatgagaaatttcacctcaaaaggtaatttgtttggttagttataaaagcctgaaaaacaagattatctccaccataactataacaaaacagctaatgagtaagtacattctggtaagaatcgataagaatggcaaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagctttaaaaaaaaaaaaaaaaaaaggttgcacaaaagatacatgtgttccttttctggtattattacaggcccacctagatttagctttcgattccagatgagatcaggcatgttcagactagcacatctttgctctgtaagcacagagctgctatcatttcactggcaaattctcgtatccccaaatttatgcacaatagataccctttaaaatctgcaaattttctatttcagtgaaataactgattgagttaattttttttcttaatttacgctgctcgtattaagctgaaaagttaaggcaggcaactcctataaaaaaggaaagttgaacagtacttaccctaagtgtaatgtgcaagccttaatggggcaatttacttttgctctatgatatttagaaaggtgtccaggtctaaactcagctctcgcctttttcccttctggaaaactgagtagactcacagaaggtgcctctgcgaaagatcatacaaatcaacagccttacctgtggccattcagaagactgcactttggtgtgtgtttaaaactatgaataaagtcagatacagcgcatgctcagcaggcaatttaaaaatatttataacattgttgtttcaaaaacaaatttcctcaaacaaagcaaaactcaaatttttttatccatgccaagtttaacgttctgagacaaagctgttttggagttttccgctgaaggaaaaaaggcttttaaaattttttgttgaacgaaaaatagttctctcttcccttttgggtacgcttaaaggggtggaataaatttttctccaagtttcaacaaaattcacctctggctatgataaggcattacaaatttaaggtctgtaaaaaataattttagagaaactaacaagaaactaaaaactatgggtttaaagaatgtaatggtcatctgaactttcaaggcagtcttgcatgtaactatacaaaaattatatcctgatacaaacaggatatattatatgtagataagaataatgtgtatacaaccatatgcatacctagagaagttttatttttcttttgctaactaaaatcagaactctctaaagccgaaaaagaaatacaacaaaaatttaggagaaacccagtaataacatcggcacaattcatctgtttttcatagcaagcgtggaaaagaaggcaatcataccaattgattaaattttgagatatataaaataaaaatttgataaaagaaggtttttaaagtatgaattgcagtagaaatgcctgtttcgttcctggttgaaaatttctttctcttccttgaatatccctaagcattccattttaccatctatcaccaaaccctgaacagctcacagatctcacagatcttatttaaatctcttacttaattcttaagtctctgaatgaatttcagctcctgctctactttccaagggtgctcagctggcctcacaaaagctccacagacacatcgttcactatctctgatgctttcaagcttaacagaggatgccaaaaaaaaaaaaaaaatcaacgattaaaaaaagtttattaaagtgaaactaggagtgcaaatttgaagaagttgcttctacttttatttctctctcaactcagcacaggtgtttcctaacttatactgctgtgcatgctgatgaaggggagggttaaattaaggtgagggagtgggccaagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctcaggtcagatccacgaagaatcccagaatgacagctatcacctgtcactgtactcttggcggcacaactagctgataggagctgcctgagttgggatcaagaagagctagtgcagctttcagtaacagcctgttatcccagtccctctgcccctttcaaagatccccttggtcacatcaaaaacagaccaaaaagaaaaagaaaaaagaaaaaaaagggggggtaccaaatgaaaaattaaaaatgcagggacaacagcccacagcaacaaaagaattcagggagaaaaaatagaacacaagcaaaaaggaaaaaagcaaaaccaaaacaactcttgtcttcaatataaaactttttaaagactgagtttctcttatttggatgacattctttttaaaagtatttttctccttaagcactattaaaagcattaaaaaattctacaaaaatacagaaaagtctgaaagcaattcaagaatattcctaaagaaaacatgtaagtgtaagaagtgagttaccctggaaaattctggatttgccaaaagttcccctacttctaatatctttcagtgagttcaagtgctaacactggccacctagtacttgttttttatctgaggatcattactgaggcaacacatacatagtaaggtttcccgaaaagactccttgttatcaagttacttcaaacataaggcactcacacctcccagccaggagggttttttgatgagcatcacactctgccctgatatgtattacacccttaagaagcagttacataaatgcattctataattatggaaaatgtatatatctatattttcccctacattttccctccccagggatatgaatagattttattttcagttaatagaaaaaaaaagaaaagagtttctgattcttgaaacaactgttgtagctgttttctacttagcaaaacagttatctgtagttaggaatggtacataatatatatttaaggatttttgtagagcttgagaattgttccccttgtttagtttcgtgtctataatgtaccttaaaaagatttctaagtgacaatcaacatataaatgcattaagaggagaactttaagaaagaaaacattatcttgggtttacaaatccaggatattagcataaagatataaatgtacagcatatataaaagataaaattgtttactacattttacacatacagctcacatctgatttctttttgcttttgttggagcattaatttgaaaatgataagcattctgaaatgtttgctacaacacaaattcatggtaaaaatatacatgcataggcaaaaattgaaatggagaacacaaagctacgtggcaatcagaatcgttgacaaaatctccatctagactatattttgcatgaactagtgtatcatagaaggggcaagaaatctctctgggggttttgtcatttacataattagaaacaaaaataaaatacaaatatctgctcccttactaccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtgagtagaaaaaaaatagcataaagtgagcataagaacagttggatttggaaagattaaaagaggagaaaagagcaacatatgcaacttaactagtctttttctttttaattttttcatgtacatatatgtatatattgggatgatggggagaaaagataactggatttcttttgaatgtctttgtgtctttatagagtgaatgttctgttcctgtctctttctttttaggcgaaaaactaataaaaatagaaaaacatatatcagacattaagctcactccccccccccccacccttccctttgtaaagaactctttgttctctagtgaaaatgctgaaaaatccccgggcagctactccctgaaacaagtgcaaaacacttagaggcttttgggctggctgggagccagaaaccctcccgctgtctggttagaagaggaaaaaaagaagagagagggagagggagagaggggaagagggatggggggcagagagagaggaagagagagaggaagagagaggaaaagagaagggagagagagagagagagagagagagagagagagagaaattggagcttcctttaatagacataggaagcagcgtttttttctttcttttttttcaaaactggcggtcaagcgttaagtaactcccgtctaaatccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaacaacaaacacagcaaaatacatgctccctcggtctcctaaaaaaaaaaaaaggcttttccatctcggttgcgacacagtgataaggggtagcgaacatctcatacctggtgtgaatgctaatcagtcaggagttctccttttcccaagacagggaactgtttccttccaaatttattagaacctcctccactgcctctttgaaaaaccttctttgtcaccctctcccaagtcccgatacttctttaaaaaaaaaatggcttcggagctccttctattcttgatattgattctctctctctccccccacccctcctcctctctcctgtctgtgtctcttctgagtggtctattgataagtccctggaggcactgggtcagcctgcccgtaggaaaccagacacaatgcacaaatctccgagtgccattctgccatcagcaagcagaccacgtttaggagagagagagaggaaaaaaaaacagtagagcaagagacagagagagagagagagagagagagacaccaaccgagggagggagagagagactgagagagaggaagagagagggggaagagagagaggggggggagagagagagagagagggagagagaggagagacggagagagagagtgtgtgagaaaaagactgattggaacaggagggagagagagagaaaaggagaaggagagagagcgcgagagggagagcggcactgccagtcaggttaatcatccctactttaattagctgttcggcttagacataaaacaattgaatttgaatgatctgtcagcaggctcggctgaaccaaaggggaaaagcgaatattacaaaaagactgttggtgtgttctgataagcaatactgctcgtactgacaaatcctcaaagggggaactattaaaacttacaactaaacaaaaagtgcaaatacaaatggcactagatagaggtctttaaaaaatggagttttctcctctagttttatgaaccatagatatttatgtgcaggtgccaacatattaggggttttcgtgtaatgtgtgaaagtttattaacgatggtctaggagtgtagcagacagatgctgcagagaacaagacaggtacagtcagatgccgaatctagatcttggagggagaaggatgctggaagaagaggcaccgtggcaagagatcagcacagacaaagtcagtgggcagataggcagacagattttaggcacggcacgatctcatctaaaaaggcaaaagttctgatgcaatattaggtacaaaacaatccatccatcctcctctcccgggtgcactccaaggtacagttaaaatggattaatctttgtgacaaacagagctggcaaggcagacactgaaggcgatttgcagacccagagaatacagagctagaaaaagccccagagatcaatctctccccctcccaatttagtagagaggaaactgaggcccagagtcgacactagacactaggactccaggagcccaccaggccagtgctctttccaccacaccagctaacctagagtattctttgaagatctggcccaacaggtatgaaaatcacccttacctcccaaataagaagattactccacctatatagttagtgcacaaacctccaatttctcaaaatgtttaaatagccaaatggaaatataattacatatataaatacatttccactttatatatatgtgtgtttatgtatatatatatatatggagagagagagagagagaccattttgaatgctaggaacaagggatttaagtctttaattcattctaggagaaaagcagaaaaatataatattgtagaggcctcgtctcagcaagatataacttgtgtcacattttcaagctaatgaaggctagtggtttgatctacaaagacctcaccctgaatttacaattcgctctatgaacatcatctgctatatatcaccaagtgagaagatgtggtttttctcatacacctcgtttctaaaatataggcacattgtgggtgaaagagattgagtctttcagcatactatgtagttttaaagcactgatgagattttccacctggagaattaggtatgtacaacctttccaatatatttcaattgaaaatgagctactaaaaaggggaaactatattttccgcccatgaaagtgatggtatctttttcgggacacatatgatcatgttcactaaggattcccttttgacaatgggtaattgaaggtccagtttttaaatggtgaaagaggtgcttatgaagagaacagtgccatcagatgttactggagagattaagtttcttgccctaaaacaagactcaggatgtgtatgaaaccgaaaactatctctcagtcatgcttcagcaacaacattgctacttagggagaaagaagaaaaccgaaagaaatgtcaggcacgtgggagcccactcaaagacaagtaatctgagagaagtcatagccagagtaatttagtttatttgcacaccaacctctttaacaatggctgctatgccatgcctaaaacacacggcctacagttgactgatttggaaagggggaaggaatcagtgattttgataatggcagatcctttggcaagccccaaaatacctgataggccagagcccagaagaaagcagtggagtgcttagtaaatgtctgttggtgaactgagaaaaaagaacaagagctttggagcaaacacatatttatatataacactgcaaaagtcacagctactctgaaagcctcagttttcctttctgtaaaaggtgatgatattggtcccatagagttgtcttaaggatgacatgaggaaacatataaagtacacagctagtcattacacggtagttattatggaggaaggtgtgtaaacaaaagtgtatattatggatgtgctgagtgtgttatattcaaagcatgtaggttcaagacatgaaagcatatagcaaagcaaggatctaatatacagatctctactagaaaggattggcagtagagattataaagtttagaactaaattcctaaaatctaaacttcaaggatgttaggtcatctggggttgtattatttctttgttcccagattttactatatttcctggctcataataataatgatggccaacatattactaattggcttgccctaagcagtctgctaaggactttacattttaaaatcatactttagcatcacaagaatcctatgaatgaggtactaccaatatccgcatttcatagaaaagaaaactgaggtatagaaagattgtgtaacttgctcaagatcacacgcctagcaagtgaggagctgggaattaaatccagccaatctgattttaaagcccgcattctcagccatggtactaaactggcacacagtaggtattcagtcaatgtgtgttgaatgaataagcaaataaaaaaaacactagaatttttatttcattggagatcagtaataatctgtgcaaaaccacttgagagaatcttgttttcgaattatagaatctgtccttcttctgtagctcacttcaggtgtagtcctttgtcagaaaccagggtgagccatgtccctgcatggtgctgaaaatggatgaagggaagagtgctgaccatgaccacccagggcatttaaatatctgacggcattttcagcactttgaggacagtgttagcacaagggttattaattggcttaattccagttcggataattacatcgtgtctctttaattttcccccgactatgccattcttcacttcctgtcacaaatgtgctctttaaaaaagcatacgaatacacacaaacatatagttatatttaaggtttgcataatcatttagggtgcttttttttctaaatgatcagtgtatagtagctatgtaataaatgaatgggcaaaagaattaaagtcattgtaaaataaagataactagttgaagctttttgtttggcaatgaaacagatttttaaaacatttccttggtgacagaattccaatcacatttttttctcatgggcagatatttccagagctgatgacctgctcatgataagctgattttcttacactatgtagtttccagtataaaaaaataccaatgaaaacttcgatattttagagtagaaaatgagactaagtcctgagtggtagagcatactgaacgtacgggttttcagtgaattattaacccatttattagctctgacttacttgacaggttttttttttttatctccaaacatatcactagaataatcttcaaattatgaaagaaaaggacaacatatcctaatttaataagcttaggaaagtttgacagtcataaacagacacaactccttttcctttttccaaagaattcttggcctttgaaatactgtgcctgcattatactaaagaaacactcccagaaaaatatgcttaaaacatgtacacaaataggtaaatgcacccatggtagaccatagtttattaggcctttttagtgtacatttgtatgaataagtcatcaaatatagggagtgtggaaaataagagaataaagggttaatttatttattatgcaggaaggtttctagatctttgctccttcagcttttagttcaaaattccatgcatattctgcacataataataaatgccataattcaacgtatctcataatttgatttactttcaagcacctttttttctggttcagctcttgaagccttccttcttataaacttcctccaagttattttttgtagcgctctgtaaaatatcatttaaagttggtgttcataagataaccctcatgctatagagagatttgtatcaaactagtccatatttccttttgagaaccagtggtcaagtcccatgctcttatctgagaacaagccacaataaatatataaaacagccctttcccacctgtttgacccctgtaataatgatagcagtctctcagtgactgccctctggttagttactcattccttaagactgagctcttccaggacaaggtctttccattctaccttgtatatttaatgtattgtccagcatcacacctgccatggtggtagatgatctcccagaaaagctggaagcaacaaattttaattccctttgttcttcatgagtaaatacaaatttttctctctgtgtgtcaagttttcaacatgtaaaaggggcatactttatcctaagattagtgatttgatgttcagaaaataatattggagggtatagtatttaagaattagctagtgaaaagcacttgttttggttattttcatagtatcgccactatttttatagcaagaagtacttagaaaacatgttttaaattcaaaatttaggtgaattttgaattcaaaagaaaagtggacaagatttatcctgaatattagagatagtaagcacttggtttttaaatgccatttaggaacagcctgacagattttatacaagcagaaggtatttaggaaattctctggttctctcagtttacagagaagagctgagtggcagagatattttatctgacaagcttaaggtaaaaaaacttggtagaagtgaactagtgctggaacccagtctgtctgtccctggttccacactcttctcactcatactttgaaagatggcttttatactcttgactccagatcccctcttttttggacatattttactgacggaactcttaaattctggtgctgataaaggggtacaatattcctaatgtagtctgataaacacactacaaaggaactatagtaggctgaggaatggccccccccaaaagatatccatgtcctaatccccagaacctttgaatgttaccttacgtggcaaaggggtcttgcaaatatgattaaattaaggctattaaaatgaggagattatcctggattttctaggtggactctaactgtaatcacaaaggttcttataagagagaggcaggaggatcagagttagcagatgtgatgacagaaacaagaggttggggttatttgaagaaggggtcatgcaccaaggagtgcagggtcctccaaaagatagaaaaggcaaataaatggatcctcctttatagccgctaaaaggaaccagccctcccaacacctttactttagtacagtgaaactgatttgagacttctggtttcagaactgtaagagaatacatttgcattgttttaaaccaccaagcttgtggtaatttgttataacagccataggaaattaacacagggaccatcagctaccttgatctggacataatctttcaacacagttgaaatatttcttagctctttaaaaaattattttagcagatatattaccttactggttcaaactgagcttgtgatacaagaacccttaccagtcttcagaaaaatattgactaggataagtcaaggagggtcttttctcctgacactaagagcttccttctaagttgacataaagcaatcaatctaatgattattggttaattgatcagttggctgcagatccatctaatcacatttgcccacctcctgtcttatagtaactcttcactggtggtttggcaattgtatctccaagttaatctacaacagtagttctagttagaagcaaagagaagggtttcagtgtccatttcttgagtgccagagacctgaactcattcagaagtgagtgctctcttgctagacccccaccccacatttttttctgagctttcttaacagaggtcagaaaaaagaagcatgaggcagcttaggcaaaaaacaaacaaaacaatctcctcccccccccctctttttttttgagacagggtcttgctctgtcaccgaggctggagtgcactggtggtgtgatcacagctcactgcaacctcaaccacctgagctcaaggaatcctccagcctcagcatccagagtagctgggtgtgaccacaggtgtgtgccaccatgccaggctaatttttaaatttttgtagtgatgaggttttgctatgttgctcaggctggtctcaaactcctggcctcaaatggtcctcccacttgggcctcctaaagtgctggattacaggtgtgagccactgcgcccagcccctatccaaactttaataagactcttttgccatagtgtatcattgccattcagttaccgcttacattctataggatagtgctcctaaaagagtagtccttgggccagcagcatcagcattgcctagaaacttgttagacacgtaacttattgtgtcttattctagacctactgaatcagatgctcagaggtggatgtctgagtgtgtatattttaacaagccctttaggtaattctaaagcctagctgagaacaattgtcataggacaaatctgtgaggctcatcaaggctaatgaaaaaacacgttggactcagagtgagatcacctgctaatctaggtgtcatggtgactctgtcatttgccagctatgtgactttagattatgttcttagtctatttgtctcatctgtaagatggaaataataataattaataataataataaattgctttatgtgaaaagttaatgtagaagttaacaagatcatgcatatgaaaacactttacaacctcagggttattattgtagaagaaacatcaatttggattgcaagtatcctaggaccacattgttggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatctgctggcattattagtctctagaaccaagtgctaaatttcttgatttgaaagtctacctttctatttatcaggtagcagaatttagtgacagctttgaattctgtatgccagtgaaagtctatggcttgtgggattcagaaccacaattttttatcaatttccaatgacactcagttttagtaaagtggcccatgatctcttgcatttccataccatattctcaaataagtaagaagctccagggagctcgctcaacaattgattatggtcacatattttttcaatagaaaatatgtatatcctggtaggtgggaaggatggtcctgatcaggactgagatctttttagaggttcaagtccaaactcttagtaggttgaagggaactcagatgcaaccagattagacacaactatgattttcatggaaaatcatcagaattttatccaatctctgagtaatgaaaatttgcagtatttctcaacagctctatatatgtggagaaaaccacctcataagaaagctaaccatgtcttttccttctttcatgaaataatagtgacgtatgcctcttggcctgaggactcgtccttcctctgaagactaatgtctgcacgtcaccttttggcaacccctctgtgccttgcaggacagttgtgtagcaaagattctgtttgggttgctgtttcctctgagccagtcacactggtgcatcaggagatgcagctgcaccttttaagagctctgtgtccttaagcaagtcatctgtccttttacatttcatagatttttcatttgtaaaatatgaataatatgtgccttaccaatcttacaaattgttctgaagatcaaaatggatgatgtatccaaaatgctttgtaaactaagaatctcattcggttggtgttactgatgttgttattatttactctttagcaggagagtaaagatatatacagacatattgggtacggtagcttgaatatttttagacatctacgttgtatatgcctccaaggtttccccctgaacttacattaatccctttttcaggttacagctaaggtggtaactaaggatgttaatttcctttaggtccctataggatctctattttgatcatgattagtttatacatgaaatagacactgctgcagaatttacaatgtttccattctggccaactcaactttgaacatattccctaagtaagaacaaattcagtactataacactgaagaaaacatagcatccgaagctggtattgagggagtgaaaatatcttcaaaggctttttcttgattgcttaatataaaaaatctgcttagaaatgtccactagttcaacaagcattcctgaaggaaatctgtaacaaagctactgtgcattaacatttaaaagaacaggaacatgtagtctacctcaaaacaaattattattgcttgaattgcccaaactttgttaaccaaaattgaatttcgcctaagttgaattcatgtgaagagctcataatgcattgttgctatttagatagttgtcatagtatgtggtactcagtaagtcctctaaaatggaagggaaattaactacatggtataatttcaacataagtcattaatataattgtgcgaagaatatctctgaatatattgaactgctatttgaatctttaattgtgcatacaattctaccttttctgctatgcatccttaactagactatatgctccctgaggacaattcctgatttacacatctccaaatttcccgctgccttcagtacagtggtttacaagtagcatttgctttcaaactatctgctgtttaattatattcactttttattggcttttcttggggggcaatttatgcacataaagtgtccatagataaatgcatcattatcactgaggtgaaagttgtgattcttaatttttttaaaaaaacatatacattgggccacttatttttcctgtgtgacactcaatctaattatagaagtgaatagaaaaacatgatctcttttaaaaggcgcactttacgtgaaacaattttaggaattcagcttatgtgtcaagtacagtcattctgcacagtgatggtgatggggaggctctatgtactatggttttgacagaaaatattttaacttaaagccagctacccataaaattacgtaaacataaatatgcactctcccacaaacacatttgcacatctttaaacttagattaatgcaaagaaaagatatattcttttgttctagtggaatacaaatgataaagactaataaatgaataaataaagctctaggtaaccaaatcaatgtctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaaaaagccagttgtaaaatctgtaatataattaattatttccataggtaagagatattttattttttataaaacctggtctgactggtaagtttgttctagattaaggatttagctacagtttggtgagtgtttgttctctgttaggcttggtgcatattaattcgtacatattttaacatttcactactgtattaaattattaataatttgaaatcattagcttgtactgacaccatttttctgaaacagtaccacctgtttcttctaagtttggtccagaacaaaagtctgaaatctaatttgtcaagaaaacaaatgtgtagttcagaaaaaggataggggccaggtgcggtggctcatgcctgtaatcccagcactttgggaggccgaggcgggtggatcacctgaggtcaggaattcaagaccagcctggccaatatgatgaaaccccgtttctactaaaaatacaaaaattagccaggcatggtggcacacgcctgtaatcccagctactcaggagtctgaggcaggagaatcgcttgaacccaggagccggaggttgcagtgagccgagatcgcaccattgcactccagcctgagtgacagagtgagattctgtcttaaaaaaaaaaaagaaagaaagaaaagaaagggataggaatcaccaaaagaaggaggtccaaagtccaatgttaggatgattatgctcatgacacggccatttaatctttaaaacaaatataaaagacaggtattccctgtggcagagctgagctttacctcaggtctgtgtgacagagtctcatctcttctcttatacatcctcaatcttcagacatttaaggtctctgagtatccaggatttcctttgcgacaataattaacaaatacatgtatgtacatttgtgtgtgtgcattatgttttaagcatatatatatatatgcaggaaactcacatctggagtaccagagtctacaggccaggactagatacttagatctctagggaagtgatccaaatatctagttgcagctatgtagatttcaagaatgcagtgaggggagaaagagtatacttaatatatgagtacatatacactatatatatcccatatatgtatgacatatgtaactaataatagtcaaccctcactaacacaatgtgcctaatattattgtaagcacttcacaccccgttactttgttctcataacatctaaggtaggcatcattattattatcatctagttttacagatgagacaagcaaggcacacaactaataagtggcacagtccaagttcctatctgtgatcctgtctttttcatggaccttttcctatctgttgcctccatgagaacatatctgaactttggcctattcttttttaagactttgctccctcttaggagataacaagtagcagaactcacatgttacccagccaatagtgtacttagcttgggaacaaaagactaaatttgtggaaattcctcacatttgtacaagagaacgtcccaaagcaagatactatggcctggaaaatggaagagatagtttgggcaggtggatgttttgggtctcccaaatcacaacacatgtgcaatgcgcaaccatcaatacataaatccaatttaattcagtatatatttaataagcacctgctgtgagcaagggactctgctaggacctaagctctagaaagtagctacaaagattagaagcaataatcctaatatttagaacatgggagaaaagaaataccacataactaaaacacgatgcaaataagttaataccgtaaagcgttgctaaaaaaaatctgtaggtttcagtgacttgaggaatatcatttgctattcagcggtggacactgacaaagttacctgaagcaggcagtgtttgagatggactttggaatgtgggaaaattccaacaattagaaattggagagataggttttaggcaagggaaacagaaagagtcaaagcaagggataggaaagcacaaactgtgtctggggtcaatttgactagcttctagactactcaaaggatagcagtaggagtttgagatgttgtgggtgaaacatgtggaaatgtccattgagcagcaggaaacccacatgtgcagtaccagagtctacaggccaggactagatacttagatctctagggaagtgctccaaacatctagttgaagctatgtggatttcatgaaactgtccacagatttcaagaatgcagtgaggagagaaagacagacaaacttacattttgtgggcagataaagggaggatggatgaaagatcattcagatgaacaggagaaccataaaaacagacgctatagagtgtaaaggtgaagaatgcttcaaatgcttcaagaattagagatagatagtcaaaacaatcaaatcataaacaggatacctaggattgctgtgaggaagaggtatatttaagagctagagtcttcatcactgtactcatctttgaaaggaccacctcttattgctttctaccctttccctaaactcaagcatgcatacaatcacacacataaacaaacattattttttcctaggaaaaatgttggcattattaactctgaagcaaaactatatctggaagtttttagagtagttagcaagatccaaactttatggtttgattttaattcaaaagataactgaatttttatatgcaggttaattattccttggtgggaatgtgaatttatttgtattttattcaggaagtatttttgagcatttcctaactccaaggtattgtgctaaacgctgggatcagaaaaatttccataaatgcttggatggcttttacctgggagcactccttcctatggttggcaaaaagctgacgcctttgtgatgatgagtttcagtcctagcctctaagagtttttgtggtcatgttattaagtgcaatgtttatgtgtattttttctgttccaagattttttttaaagttttgaatatttttttatgtcaccaaaaggtgctttagaagaacaaactaactcaaagccaacacagaaactggttctcttgctttgccaaagtggcagtgtagcatgtgggcaagtaagaatacttttctcaagtatttaaaacaactacagaaatcttattcttcattgtattctctaaagaataaaggtaagaaggaaaatcaggttttgatagagaattaaaaaatagctttagcatatgttcaaaccattaggtcaaaagggactaacaaagccctgtagaaggggacccacaaaagctgcccttgggacttacttattcacttatttgtttatattttttgtatatgtacatatttttctgatactgctttgacacatcactttagctctttttctatatgtatgaatattcttctcctacaacataggaatcttgatgtatacatagtttagtaatctgcattcattctttcaagataaacatttttaatcctacatggtattctattctaaggatataccagcataaaatacaatttaaacaatcacctatttttggacattttggttgcattctgacttttattcttttcaataattctttgtccagtatcattgggcatagtctttgcaatgctattatttaatgaaaagaaaattttggaaactttaacaggtaataccacaagcgaggaaacttaatacaacgaccacaagcaatgaaagaaaagtcaaatgcctcaaggagccagggtggaagagcaaatgagtgaagtaggtgtggcataaaatatggggtgatagggactttgtcaaactggagagaacatggtttgtctgaagtgagcagctgctactcagttccagatattggtgccacatgtggatgcagatctaatgttgtcagatctccaatttttcaagagaagcaaaaaaaaaaaaaaaaaaaaaaaaatctagtttttttttggtgtgaaatctctttaaccttaaaggttggctcaaattattttaaatattctgtggaccaaacatacattttaaaaaattctatctgctagctagatgcagctcataggccactgatttgtaactttctaattaaagaaagggcaagacggtgtttggaaatatatttctaggtagagagttaagcaaataaagttttacttcaagttttcctagtcacaaggaatgtaatgtggagagactgaacctcaatgtgcaaatcttgaaagatgggtaaatactgctccccacttaacacccatgaagaatttaatagaagaggggtctaaaatgcttttaatttcacaaagaaacatgctttaatgatataaaactctaacccagtgcactgtatgatgatatctaatgataatttcccttcatttcccatctgaacaaacatttcccattaacatccacctgcactacttcctttcataaagaggaggtggtatttggctatgttctggttctgattcatgagaaatcagcccaagcccaacatttctgttcttaacagattttggtttttaaatctgtagaacacaatgtttccctgggctgagttctagcatgccaagttttggctggccacagactttgacatctgagtgaaaaatctttcaacaatggcatttaaactgaagaatcaacagacctttaattataacactgcttgtaattccctccctctcttatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctcaagatttagattaaaaacaatatttccacttggaaattaagcattaaagatatagaaaaagggagtctctttttagtgagatttcactaaatacctctggtatctctccataaaatgttaggtgatcatttcttaacagctttttaaaaatgacacagtctcagattaccctatgtttcccttatataataacaaaagacacttttatactactaaagtacattaggaatcctttgaaagtttctgttttagaaactgatgttgaaaaagtacttaatttatatttaacctgcctatctgaatatacttagtggaaaaattagggttaaaaatgtaaatgtggaaaatgtttatttccatgttttatagtagttagttttttatttgcttttaaatatagatcttggttatatgtggaagacaggcataatttcagctcctttttcatcttgaagagaaacctggctctcaatttccaggaaatatatttatttagacctaacaatataccagaattttatgcattatttctaatcttcataataagtctacaagttgggtgtcattaatctgttactgataaggaaattgaaactcaaataaatttaatgcttttaccaaggtgatttagttagtgtctttttgtccatggattttaagtggtagaatttgcatgcaaacccagatatgactccaacggctctgctttctcctttagaagaaaaaaactccttcctgaaatactaacatcttttctttgtgtaattgaccatcctttcttaatacaattggttatcagagctatcatattcttaattatcagtattaccttacgactctaaaattcatctttgtccagtgtatagaattcacatcctaaggttagatataggagattaagtctctgatctcctggagcagacctggtttcaaatcttgtcttttattatccccataaatatgcatgtatttataaaattatgtcctaagtctttgttcagaaaatatgtagtgtctgacattattttgtgtataaaatgctgaaaaggtcacatccaggaaactagtcctgaccagcatacaacactcaagaaaggttctccaaggtagaatcaggggagaatcccaattgaagttgttgaggggagtaaagataataaataatattaacaataataactccatgcattgaactcttaatattcttcatcctatctatatatcatatttaatttttacactactcccattttgcgtgtgagaaaacagaggcttagagatggtaaataactagttcaaggtcacatgactagtggcattttactccagagctttgctttttgtactttgctaaactctctcccagaatatgggaacaaaatctaaagaggtaaattcaaagatcaatattaagatgataaatacaagatgcagccaggaatcaggaattggagtgggaacagatgaggaaacaaggtggtgggtccagcagggttgcatggttgaagtcagcaaatgtctgatatatgggggtgtcatgtcacattgaaagtacagctacatcagggaggtggagcgactgagagaatatgtagagggtgacagatataggactgcttggctgatttcatgtttttcctttacaaatgtaaataaaacattgtgtgttggaggtcagagggcaaaggagatataactgaggactctactcaaaaaaacatctcgcttcatgtgtcattaactgaacaggggaaagaaactcagttgtctaacaagatatttttaaaatatttatttctccaagagggttaaacctcatttacaccttggagtaaattactttaataaggttaccagatcacctaactgaatgtaactaaagtcaagaagctgcagtttgaatggggaaaggaaatggataactgtggaactgaagggtgggagaaggggatgatagtgacacaagcaaggataaaaaggatttccttaggcgaataggagggcaccaaagataattttatgaaaagacagttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgcgcagtggctcatgcctttaatctcagcactttgggaggccaaggcgggcacatcacctgaggtcaggtgttcaagatcagcctgaccaacttggtgaaaccccgtctttactaaatataaaacttagccgggcgtggtggtgcaggcctgtaatcctagctgcttcggaggctgaggcaggagaattgcttgaacctgggaggtggaggttgcagtgagccgagattgtgccattgcactccagcctggacaacaagagcgaaactccatctcagaagaaaaaaaaaaaagatacctcactgctctccttcccttctgtgtggcccaatacagcatgctgttgaccctggggaagcttcagaatgtatgatctaggaaagctgaggcaatgctgtaataacaagagctatgtgaaaggtaaagtatgaaatgtatgatggaaaccaaaccaaagagggtatgttaaagataagcccattaaggaaatagctcacctgttggactggaatctcaactggctcttttatttcacgctaaacctgtgctgagtctgcacagaaggacttctgaaatgcttatatatacaacctgacaggtacaatcagaaacagtacaaggactgcgtgcctcaacaagaatagccagagcactgaaatcaattgcagagcacagacatacttcaactgtggctatgcagacagtccccaggtatggctggtgaacagcacgctttatgtgtgctatgtcccagacttcctggctttcttcccttccgtcctaccccttcggcacacactacatatctttcacattttataaaatcacaggagatttccaaattattgtgtctttcaaatactttaaaaatatattgtcctcctaatataaaggagagaggtggagtatttagctgatgaactgaatttgaaagtaagtttgcatttttgatatatttccttccttatgagtgagtcatgaaaaatgcatattttgtctaaatattgataaagctttagaatataagagctggagtgaacctaagaggttttgtagcccggcaatttccaacccaggatgtgtctcagaatcacatagagaggtttcagattcccagccaggcacagtggaatgtggctgtagtcctggtgactgggaaggctgaggcaggaggatcactggacccccagagtttgaggccagcctggggcaacatggtgagacccctgtctctaaaaaataaaaagtaagtagaaaatacaaatcacagattcctgggccttttccttcccctgccttccccaagtgattctaattctatgtcagttttggctgcttgcaaccagttatggagaccagggatcttgatcaatctcttcatctatctgatgaggaatctgagacccagagaagtaagaggtacagtgatttctctaaggttacacagtgtatgagtccatttgcacactgctgataaatacatacccaagattgggaagaaaaagaggtttaatggactcacagttccatgtggctggagaggcctcacaatcatggcagaaggcaaggaggagcaagtcacatcttacatggtggcagagaagagagagcttatgcagggaaactccccttttcaaaaccatcagatctcttgagacttattcactatcatgagaatagcacaggaaagacaagccccctgattcaattacctccctctgggtctctcccacatgtgggaattgtgggagatacaattcaagaggaggtttgggtgggggtacagccaaaccatatcccacaggaatatgttacaagtgaagatagtctatggacactgtaaaattgaccccattagctatatcccaaactagttcattattttagaatctattttgtgtgtttgcatgcatacagcaatgcttcacatatctgcacaccacttatgtggcattccaaatatggttaagaacaaacaaagtgaaaaagacctgcaagcagccaaaattggtactaaataaaccacacataatcctccaagtctttttaaaagcctcttctcttgcttctctatctagtgaggcataggtgactcaaaatctttatctccaagcccggcccttctgctgcactatagtgtcgtgtctccaaaagcctagtggaccactcacagatacccagtcggcaccttcactcagtgtgttcaaaattaaacgtgtgctttcccctcccaacccttctcctgctttgctgctctgtttatgactctactaaggttcaaaatcatagagatgtgtttggtgtcttcctctcccttgctccccaaatataatggattaattctcccgccacatttcataaatcagtttgccatctctgttcattccctctgcccctgccctagttagtgccttcattgcctttcacctggactattgtaatagtctcctgcctgatcttgtgtcctctggtctctccctactccaatccattttactcactgttgccagattaatcttcctgaggcacagctctgattatgttactctcctactaaaaactttcaatagctccccactgtctcctgaataaagtccaaattccttgccctaataatcaagtcctttcactttctggtcccaatatacttttaccgctttatttcccactacttatcttcacacattccatgctcaagttaaactcaattacttctttgcagaatctttaccctttgattcttccatgcttttctcatgatagagtaatgttctttccttctatctctgtatgctcaaatcctgcttgtttttcaaagcccaaatccagtgtcatcttttctgatgaagccctcagttagccctcctctgagctccaagaataccttatctgtactacttttatagagcatttcacttttcactattaattctagcaaagtagacacatgtctcagctccgttgctagattaaaacttctagggcaagacatgtcttatctgtgtatcctctccagtgccaagtatacaagtgcacgactcacaatatttgtcaagtgaatgagttcatgtatgtactttacacacaatcaaaacatgtttttttgttttattgtctaaagaagattagaaataatgcatcagagaaggaatgaggatcttagagacttgcacaacagaaagtaacttaatagctaaagaagaaaaataaaaactacgaaaagaaggcatgagaactaaagatatagcagtcagagggtaaagaaacacagaagcaaataatcttatagaataaggaccaaatggttaattgagaagcttggaaaccataaaataacattcaaatatgtagcattatttttatacttccacaccctcatcaatagaaacaaatttgaattgtagttcaagataacaaccctgaatcatttagaaaagtttgaattatggtaagtatattcttttttttgagatggagtcttactctgtgaggctaggtaaataagctgcctttattaatgaagaaattcatatttttctgaatattagagaaatattaatttttcccaattaagatatgttcatgatatacaatttagaaaatataggagagtaataaaaaatcttaaaaatcctaaaaaaggtgggattataccatatgtattactatgtatgctgccttttaacttaatatatagtataaatagttcatactattataggttcttcataaacatttactggctcaaaattctatctaatagatatgtcgtactatacttaacacagcactctagagttgaacatctagcttatttccagttttataatacaaatatgtctaacaagatttaccatgggctgacaactgttgaagcagagtgaggaactcatgagagttcactatgatattcttcctacttttgtatatgtttgaaatatctagaacaaaaaggtaaaaaagcatatttatgtcttaattcatttgtgttgctgtaacagaatattataaactggctaatttaaaaagaaaaaatatatttctcacagttctggaggttgggatgtctagtatgaaggtactggcatctggtgagggccttcttgctagatcatcccatggtggaaggcagagggcaagagagcacaaaagccagagagcaagaaggagccaaactcacttctataatgaacccactctcatgataactaatgcacacactcctgcagtggtggcattcattcattcatgaaggcagagccctcatgactgaatcacctcttattaggccccaccttccaacactgttgcatcagagattaagtgtccaacacaagaacttttggagacacagtcaagccacagccatatgataaatatcttgtgcataatggcttttgtttacttgtaattattttcttaggttgcagtttagggctagactgcctggatcaaagtcttaccccatcattacctagttatctaaccttgggcaagctgctgatgctttctcagcttcagttttctcatttgaaaaatgggtataatggtaacttataggggctgttctaaggatcataagagaagatgtgcttctaatcccttccacagtacctagaacactgttagtgtgcaataaatgtcacctttgaaaaagcaaaatactggttgcataattatgcgttgtgcttataaagaaacatcacatataaactgaaaaacatacctgaaataacatgcttaagtgtgcaccatttctatctccaggctaaatgcttatttcaaagatacgaccactgctaaaataatttagatccataattaccattacgaagcattttctatgtggttgatattggccttactgggctacatgtttgatgtgtactatctcatttaatcatcataagagttttctgattactttatagataaagaaactgatgcttaaaggtgaattaatgtgcccaaaaggacacagggtctgttttcaaacacaggattgaacctctggaattcatctctaagctactgaaaatgacctttgttccctgcactttttttttttttttttttttttgagatggagtttcgctcttgttgcccaggctggagttcaatggcacgatctcagctcaccgcaacctctgcctcctcggttcaagcgattctcctgcctcagcctcccgagtatctgggattacaggcgcccaacaccacgcctggctaattttgtatttttagtagagacggggtttttccatgttggtcatgctgggcttgaactcctgacctcaggtgatccgcctgcctcagccttccaaagtgctggcattacaggcatgagccaccgcgcccggtccgtaccctgcactcttttgcatagacttcagtctttctttctttcttttcttttttcttttctctctctcttcttccttccttccttttttctttctttctttctttcttctttccttctttctttctttctctgtctctctctctctctctctccctcccaccctccctctctctctctctctctctttctttcttttttttgaggcagagtttcattcttgttgcccaggctgcagtgcaatggcgcgatcttggctcaccgcaacccctgcctcctgggttcatgagttctcctgagtagctgggattacaggcatgcgccaccacggctggctaattttgtattcttagtagagacagagtttctccatgttggtcaggctggtctcgaactcctgacctcaggtgatccgcctgcctcggcctcccaaagtgctgggattacaggcgtgagccaccacacccagcctagacttcagtgtttctaatctttattcctcagaggcagatatgaattttggacaaagttttggtccaattttggatgtttaactggacctttgggtaaagtacctttctccttcccattcactttaatcagaattatttatttaacaaattttattctagcaaacaattttagagaagaaaaagtagtactccataacaagctgctcttaaaaatgcatatctcattctggaaaaactaatagctatcatggttttaaacaataattttccattggtttgattatcttatgtccactgtgaaacaacagttcattattaaacaattcattatcaaacacacaaacacatatacacatttaataactttaaaacagtccatatttacatattttactttaaatatgtaatctgaaatgtgtatgcatatgtgtatgtgtgagagtaagacatagaccccggaagtctgaatttggaaaaaccctgtgaaagtctgaaaaaggtggttttctacaaaccttatgaaaaattaagtcatagaaggtcacaattttaaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacataatttgttttgttttgaaaaactgctcagcaaatgcatacaggtcataatggcaggtaacagaccatttattgaagtgctgaaacaaatagaaaacaaagtccaggacaccatcacagagcagtacttcccttgtgagatactctcagctaagtaagaattgagtgagacaacaataaaacaaatacccataggcttttcaaacagtaacaacccgctcagggttagcagcatttctagaccttgatggtacaatgatgttctcaacctttgctttcagacactggatcactgcttaagtagcctttatcttttccccctaatttttgttgaagatgcccttgaaattagattatatttgttcctaacaaagcatatgtatattgtggcatcactcttaaaaccaacaattgggcttagttttatgaagaaaaaaaatccaccaacctttcatgctgagatttctcatgctagttctcagcacagaagtgattttttttttttaagttgcataaagcctagcaaggtttaagttttcccagcaaggagaaagtgtttttcagctgttaaatttttcagatgctttttttgaatttggataaaactcaaaaacatgtttgttttaaaatgtaaaccttttcatgtacagaggtttgcatatagagaaatgctattactatgtttaaagatacttgcttttgaaataaggaggtcacatgcatttaaaaataacaaactgcatgttgctttatgaatgtcctattaagccctaacgtaaatatgatgttctggaggagcactgatgcacacgtttgctgataggatcacttacaacactgcttgtggatgtatttccatgtgagagcaaagggtggtcaggtttgaactgaagaacatccatatagtcagctaatatgctttttaaagaccttttacctcagttgcaacacacttctttgtcctaaacctgctggattactcaacttgttggctggactaaagctgacacaatacatatttcaagcacaaaaatgatgaggaacacatagggatgtcagcaaagaggcaaagaggatggtaagtcatcggaaggctggtcatttttttttttttaaacagttcaatgtctttactgttttctgtaatattatcattttccatttttcaaacaatggaaagaacaacaattagtttcatttttaaaattattagatcataaaggacaagtttaggaatattgtttctagcatactaatagatgaagttagttgtaaatcaatagtcttatttctctgttttaaaaaaatagcaaaatacagtattctgaggaaagttctgacagattggagtgttacaggatagtctgaaatctgtttcattatagaagtttggccaatatagagataatatattttaaatggcttaagtatatattttttgtggattgcacattctgtaagacggtttgagtgccttgagatccaagtctttaggtcaagactgaactctagaaatggccccatcgaatctacaaaaggatacattaaaaaaaaaaaaaacctcatttcctgtaagctgctgatgctactcaacagagttgaaactcaggtcacacgcatcctactactctagtgctgccccatttactaatccaaacgaggataaaccctgagagatccgttatgtttctacataaggagtgtacaagcttctcttgaaaatcattgcattgggagagacacagagaaataacagaggtgagaatccctccccgatttgcttgctaaatccgtattcattcctgaagatccagatcaaataccacctgactgttaggccttctctgagaaactctattttgcaggcaagtattggaacgactctatgcgcatctccagtcccaatgcatcctttaaataatctgtttcctctctgtttcttgctgcattacagacatctgtgttacacatccatccttccctaatagtcagtggactcttttaggtgaaggactgtgtctctatgtccctatgctgaaaggacaatgggaagagatggtgctattgatgcccagaggcctgggtcaccagggaagctggagtcacagcaggtttgttcagagggagtaaaccacaaaggaaatgtggctggtgatgatgatgatgcaaagaacggtgggggaaatctctggcctatgccttctactgaccctcttgccactcacaagtgtctcacaagcaccaaatccaacttggaatctagctgacatgggtcagccactgttgtagagcaagggtagggtgagggttgggtctgagggtaaacacatccacaatgtgggagcaggaagatgtctttgcaggggggtgtctaggactatggacttaagataacctcacagggtcaccatgccccagcatgacccagaagggcccagagcaaggaagacatgacaaaggagcctgaagacttgaggaggccttggagctgggacaaggaagacacatcagggatctacatggacaggaaactaaagatgaggtgggctctcagacatctcagggaatttgagctcagaagacaacactgagaagaccagacaccatagtgagtagactgtatctaactgctctccaccctcactttcatattgcatttggatggcactccaaggaaggggagaggagaccacctagcagaatggaggccaaatctgagttacctcatagataaggaaagaaggcctgtgatttttaatgggtcagtcactcttaaattttaagcaaactgtagattttctgaataggagaagatattatcttaatctacacaaattttttgttgtttttttggcagggtttaaaatatttttattcatgacttatagtagaaactacattttatattgtgacccagtaactgtttacacacatacatggatgtatgtgtgtgttctggaggtagaaagtaaccaatctgctcaaattttaaatattaagattattcataattctttaagtagtttattgtttggaaagttatagaccaaggtctagaaattcagcagacctctaacctctaatcaaggacttttaaaaattaagaacagtacctgattttctgatttagtctttgaaatgccagtgctattcattctttgccttattcactcataattatttattcattctccaaacatttattgagagcttactgtatgctttatactatagacctgcagcacaaatataggcctattacttcacagctgctttaggatttatagcagtactggtcagatagttcttaaaaaggaaaagttttcagagtgcaacaacctgttcacaataattcctatgtagcagtgaagagccttgacagcatctcttttactttctcattgtggttctagtttaataacataagtctatttttacttttcatatttaactttaattaaacatgctatgagtgcaatcatgagattttaataaattagactatttgaaaataattttcccataatgatgtcttcctcatatctttcatgatacacaaaaagaatatttgtacaaatattttgttgcttcaaatatgcagaaaactgaccattatttacagtgattttgaaaataaatgagtgaaagcatgcgaacttataaggagagtaaataagcagcacaccattaccatctgagacagcatggctgctcccctcttggtgagggcagtataggtacagcaagcagaagacagatcataagtatttactatcagaccttctttaagtgaatatgtcctattccagtagaaagtatcatataagcatacggcctgaatccaattcaattatttacatggctctaccagtaaatggttaacactgtagaccagaaatttagaaaatgcagaagactgaacgatatgtaagtgactgagaacatgagtctctctcctcatcatgtaggacatgggtcgaggtcatagacttaattggtaggagttgctactttcgaagagtgaaatgctttgaggcttttaagagaattttaagttgattaactttttatttgggggaattatgatgtgagctttattaaaatatcacaattcggcattgtttcataaacataattataggccaccttttcaaaaattgcaagagtagtactaagaaggtcctttgaactaaggttcaaaggaccttcttagtaactcttgtaatttttatgggtacagttagttgtctgcataaagtcattccattttccaaagctgcttactctttgcacaaatgacaaattggcacatgcacaatggcacaggaaaagaagtaactgctaaggtcacatatgtgaggacgttgcagcctttaagtactggaggccaaagttaccagaaacatgggcagacagattaaaattttcccttcttatgtttgtgcattgtttctatatggaaaattacatttttctgagagtatatgtgtaaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccctggaccacagacaaaggtaacagtagctgatctagaagtaatccccatataataatataatagctcaggtcttaaaaggaactttgatcttttaaatttgccaatgccgattgttgagacaggaaataaaggattgatttggtagcttttggaagatggtaaggactcctgcatacagccagtcctgactctgcccctcctgggtcactcagtctattttccctggatccgcatgctggtctgaaagtcaatgcagtctgccaaagtggtatactgttcccatgaaataatccaactgtggtatggagaaatctttttttcttagaccaagttatttttacaaaaatacttttgcgaagaaatgagaggaaactaaaaccctacacaatcctagaagtggattactgtctagagtgcatgttttttattccatcttataaagcctaactcattttagggtggctagtgcagttaaggtgcagacatctcttggttgtttttctggtgcttttacttgcatgctttcctgtttccaaatctgcatccatattgggggttacccacagagagctgttgtctcctctctgaagaacatctccatcttttggtcactacttgagtagagatgagtgatgcttaatgaaatatcattttattacaacggtcaaaaattatggattcatttcttattagattatatgctctgaatgttcaccaccccccaattcacatgttgaaacttaattgcccatgtgatagtattaagaggtggagtctttaggaagtgattaaatcatgaaggcagagccctcatgaatggatttgtgcccttatataaaaggtgtgaaggagctgtctctctcccttttcctcttccaccctttgccatatgaagatacagcaagaggtgcgatcttggaagcagagaggacttcaccagataccaaatttgcaggtgcctcaatcttgaatttcctagtctctgtaactatgaaaaataagtttctgttgtttataaattacccagtctcaggtattttgttatagcagcaaaaatggactaacacattaggtacaagcatttatttgacatttaaatgtaatccctcattttctaagaaggaataagccagaatccaacatcaaaatgtttcaaaaggaatacttcaaagtgttttagctgtagttctttgtcgattaaataaaaaaaaattccaaataatggtggtcagtaagagtgtgtgtgtgtgtgtgtggggggggggggcggtgtatgaattcctgtgctaagattcagatctttgaaactgttttctagaatgttatcctacatgtctaaaactttttttctaagtgtatcagagatttgggatggagtggtaaacacataggttactaggaggtggcttgcctctgtacccattctagatgagtaatgttaatgactgatgataatgtaatgatgaaaaaattggttctttttaagtaaatagatagtctacagacaccctgtcaacagatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaaggttaattttaaattagaggtgagaattattcttcatgtatcaaaaagcctagaaatttaccagggattaaaggtagaacccattttagcctatcgaagtgtgagaggtaaggtgacctgtttagatgaatatcttgaaatgattctctggagcatgcctgatctgttctcaatacccacacattagaagaaatgaagaataatatagagactacacaaagagaccatgtaaaagaagaaccctgataaaagaaaaaaaactcttaattttatcactgcaaagacttcttgtacaagatgcctctgcaagtgtcctagtagcatgactccttaaacaagtaggatgcgtgtatgtggaagatatatatatgtatatataacatttaaaatctccctcgaaccccagcttctgagtataaactatgttacagaagcatgtggataatatgtgaagctttctaggagcatcattaagaaaatgagacatttgacactctgagccctaggtacactgagtcagtggcatggtctccaagggcactgctggcagcactaaagcctggctcataaccatatgtgcacacctcaagaggtgtttgactgttcaggtagaggataagccatttcctaggcctggttccttccattctccttagcttgtagttggcctgaagggacttcctagactctaacatgtttgcctctcttttgcttcctttctggacactgtctaaggatttaaaacacacatgactttcatgtccacaattttctgccaaagagggggaaaaatgccccagagcatgtcatcccttaccatctgcaaatgaacttctgtggtcaaggaatgctccaattaccacccagaacagctttgtacaactcctgaccctcgggaagactcgaggaactcactcccagaacccagatgctccctgtcccagaacacagggaagacgccctgtcatcacagtttgcacggcagaggcggaggtgatgctgttagtgtggtatttccaattctctagcgtctttcactttccctgaagttgctgaagaatattccatttcattaagtatgtagtaatacacatgggaatcagagagcggggaaagatggaggacgttgatgacatggcctctagcactttatttatgagaacatccagaaatctctatctacatctgggagaagaataatgtcaatcctgccctggagacatggatcaggcaatgttgccagtgtgtatttttcccttcccaataatttactgattctggagtctaaggcagagcgctgatgataatttttacattcatgtgagtgagcctggccctttgagggctggtgatgccaaataaacataaatgtatgtaaccaggtgaatacttaccacctcccaacccagaaatgtcataggtctctggtggtgctttgcttcccacaacactcccctgaagggcggtgagggtaggtgttgccatcagagcataagaagcagagcttgaggtggccttggaggacttcagggagcactgcctttgcagtaaagaatgagactaagcaaacaaacctgttagacggctcatttgtcttttccaatttttttattgtgttattcatcctttcatcattgatttatagctattcttaaaatattagggatatatcacaaatatttttcctagtttaaaaaatgattttctaccatagtaatttttattttcatgtaataaaatttaaaatacatgtattttttaaaaagttttcaggctttggttttatgcctggaaaatgcatctcatacctccagtatgaaaatattcatgtatatggcaaaaattatcactgaaaattacagaattagtgaggatgcagagaaatgggcagtctctttttttgttggtgaagatattaaccaatgctagaggacagtttagtaatgcattttacttttgcagttccactataattaattgatcctaaggaaataatcatgtaagtgtacaaacatgtgtacatatgcatgtgcatataaagacagttattgtggcattgtttagtaagaagaaagttccaaattcccaactgtccatcaataagtgattgagtcaataaattatgcatatactgaagtgcaacgttgttgtcaaaagataatgtagatctatatttattaacatggtaaatgactattacaatgttaagtgaaaagaatagaatacaaaacagcaagtaacttctcctttcagtctggaaagagaaagacaaagagaaagaaaaagagaaagataaacaggactgtatggaaatataatatttcctaagttattaatagtgattatctctgggctgtgagatttcaaaggaatttaaccttgctctttataaatactatcaatgaaacaaattcaagcaaaactaaatgtatacttttttagaattaaaaattagaacttttattttgggggaaaaagaacttacctaaaacctgcaataaatacttaaaaattccaatatgatcttcagtcattagcaattactaactagctctcttagtagggtgacatcaatgtctgcctcaagtttcccccaagtttgacactttgagatgtacatcatagttcttcccttaaagaattttaaaatataaaatttcaagtagtgaatataacccaaatatttttatctagggcatggttaggtaaattctgggggctttatgtgatattattcagatgttatagtgctatttataaagagtttttaattataccaggaagtatttattatataatattgaattaaaatgggatacaactgtatacatgcaatgtatgctcaggcatgttaaaatctagagaagacactagaaggtgatctaaaaaattattaataatagttggttctgtgtagtggaattatggatgtttcccctttactctatactttctaaatatttcacaataagtgtgaattatagaatcataaaaaaagtaaatattaaaaaaaagctgttttgctcgacagctgccaaattttaccccagatgtatcagcaatttagcttttagtcaaatgaccctaacatcatttcctaaagggaatatcacagaatggaatgtgcccaaataaagataagccatcacggccaccacctctttctaagctatcattttataatgcttaaaataaatctgagtaagggatctttcttctgttggaagttataaacttccacctccttcagaccctctccatatcttctcttgcattaccagcacctggaatttataattaacctatagtaccctggtacgtttctaggtctggaagctgtttttggaggctgatggtgtagatcaccattagggatggaggattatttattcattttaaatgggagttcccttgaataacaaacagggatgagctgctatataagatcttgtgtagttaatatgctttcttacccttcttatatatatatttattgattgattgattttttgagatggagtctcacactgtcgcctgagctggtgtgcagtggtgcgatctcggcttgctgcaatccctgcctcctgggttcaagagattctcctgcctcatcctcccgagtagctaggattacaagcacccgccactatgcccggctaattttttgtatttttagtagagatggagtttcactgtgttggccaggctggtctcgaactcttgacctcgtgatctgcctgcctcggcctcccaaagtgttgggattacaggcgtgagatcccgtgcccggcccgcttccttcctcttctttccatccctcccttctttcttcccttgttccctctctcacctgtctacactcctgtctccagccctcttaaataaatagcttttctgtagtgttagatgccagctcttaacatttagagacaattcacactataccaataccatacttcaagtagatgatctaattgtttctaaatcatcatattttagcaaaaagataatgggagaaatcaaagttgtctctcacatatgtatgatgcatactagaggcttggcaataaggcagagagtagatattttttgagaaagtaaataacaaaacaaaacaaaaagccaaaacacaaaaacaaactgggtattgtgaggacagggcagagggaaggagcaggcataagaaagaaaaggaatgacatcggtctcctggtccttgcaaaggttattcaagtccctgttcctggtgttttggaccagatatcagcctacaaaccaccctggactgtgagctatttgaaggcatagatggtgtcttactcacctctgtattttctgtaccaaacacagtgcctgatacaatatactcaacagatgcctggagaatttaactaagccctttcactgccctttcttactggcctcagctagaaccaaaacaagaagctaaaactcctaatgccacaaatgctaggtgaaaccctatcctaattcaaactcatttcttctgattttgcaccttggtccccaaactgctggagaaaatcccatgacagagcagataggtatcaacatcaacccaccagactcacctgcaccttccacactgccaaggagagtcctactgtatttctctggtcaacttgctgtcccatttgtctcaagaacgatttcaaatctctactttccttaaatctcttccccgcttattcttagcaggaccttgcccctcagtgcccatcacttgggaaacctcttaacctttcagtaccaaatctacacgtgggcttgcatctgctcctttcctttactcctcctttcttacaaaaatagaagatgtgtccctccttccatctctccacttgtactcaggattccatctctctggccttatcagtaatcttatactgccagtcatcctatgctcttctctcttctgcacattggatctctcctctctacggtattcttcccatgaaaatacaaaaaatactagtgtttccatgcttttccaaccttcttttgacctcacttcccccctcaagatattgcagtagctcattttcctttccttcatagcaaaacttctgagtggcccacatttgctgtttcttcacttctcattctctcctcatcccattacaaacacgttattgttttgaccacttcaacaaaacagcttttgctgaggtcaacaataagctcaaaattaatataagcaatatatatttgttagtctttaacctacttgattgctcagtaacatgtcacatcactgaccactacctttgaggcactctcttggcttctgtgcctatgttttctgattttcctgccaccttcttggtggctccttctgagggtattttatggcctcatttttttctaccagcggattaaatattaagagctcttcaagtctcagtttaggtcttcttctcaatctaaccctgtccctaggcaatgttattcatgccaacagattcatttaccactatatgtcgattaccctgaattcatgtctccagccttcatgttacttctgaattccagttttatgtatataaatacctgtgcaatatgctcactatgtatctatccaaagtacctcacactcaacatctcaaaaacagaacttacaaacttctctccactccagtcctcctttggtgtttcatgtaactgtgaatggtattatccttcatatagtttgataagccccaaaccaggagtcattgttgccacttctctcttttatttcacataaccaaccatgaaaaagtccaggaatattttacttctgaattatctctcagttccatcaatttcctcccatttccactgtcaatactctagtctgcctcttatgtggtctactggaatagctccctcactggtttcctcatatccatttttgatccttccaaattatttaccaaagttaagctaccttgatatatatttttaaatttttaatttcaagataattttagattaacgtgcagttgtaagagataatacagagagatttgttattctttttacccagttttgcccaaatggtaacattttatataactgtagtacaatatcacaatcaggaaattaacattggtgcaatccatctgccttactcaggtttcatcagttttatatgcacatgagtatgtgagtgtatatttagttctgagcaattttattacatccatacactcatgaatactaccacagtcaagctacaggacagttccatcacaaaagatcccttgcgttatcctttatagcaacactcacctccatttctatcccaactccctaactttgtcatccacaagtatgttctcaatccttacatatttttttcatttcaagagtgctatatagataagaatcgtaacagtacatcatcttgagattagctttttcacccaatgtaatacccttgtgattaaaaccagttattgtatgcatcaataatttattctgcttagtgctgagaggtattccatggtatagatataacagtttgcttaaccactgacccactgaagaaaatgtgggttgtttccagttttgggctattacaaataaagctgctatgtacattggtgtaacataatgtacaggtgttgtacagttatgtttccatctctctgggataaatgccccaaagtttacccttttaaaaaacaacaatgatcatgccacagtccttcttaagtttgctcctctactgtccttaggataaacacaaaaatccttaacatggcctaccaaggacctgttatcatcaggccttacgtatctcttcaacctcaacctgggctgctagtcacctttttctctctgtgcagctctcttcagggacttcatgctgttccctctgcctggaatcctcttccaccatccatccttactttttgtttttaaccttcaggtgtcatctcaaatgttactatttcagagaagcttctcctgaatttccagactcagttaaatcttcttcttttatttgcccttagagcacatggtacttttattatatagtggtaagcacaatttgtaattacaagttatattgtgagaccatttgcttagtatctgtcttacattccccagattataagctccagaaggagagagactatgttaatattcctttattatatatacctttagtatttagtagacactcaactttgtgtccagtaaaatttggctgaggcttttaagacatagtcctggaatcaagttctatctctaccatttattagatgttcttataaaataaatcaaacatgttaaatctcagttttctgatctgcacaattaggattatagtagcatctacttaatagggtagttttgaaggttaaatcagatagccatgaaaagtatttagtccagtatctaaagcaaggcaagcactcaataggtatttcttattgttattattagttgaacaagaaactagagtttttgtattttttttcctaactaggcttttgtccattatcttcatttcttgcctgttcccccaggttctgattcttgtaacttttgagactctgaaaaggggcccttagtttagatcttggataaccagtaggactactggttcttaccccaggtatatgctctcagaccagatgtggctctggttcccattttcatctcactcagtacttcctcctcttgttttccagtctatggatgtcagtgtgggtaagaatgcctcttccctactcctagtttccagatgttttctaaacactgctttcctcttgtctcattccttataattccccatggaggcaaagtatcccattggtgggaaagcccttggtctatatttctcaggtaggtagaactgatctatccaaatttgtaagcacaggagtttaacctctttgtccttccttttctactgagactatcgggaggtgatgacctggaaagtgttgctcatatgcagatccacattttcctgtaagagagcttttgaaaggtttgactgaagggaagagagtcagcaaacccatttcctctttacactaagctatgctcttcaaccaacctttataaaaattttggttccctagctatcagttcttttgtcttatttttcaataggtttagaattcaagtggggaaaagtgatgctatttatgggccccctcgaagattccaacactttggtatatgattttgcttggaatatgattctgtttctcttcatcttttttacattttagccagttttcaagactcagctgaatcagttttacatgaaactttctagcctgcaaggctctttcatgaatgaaaccctatggtacttcctggactgtatcattccttttggaacttagtcatttattatcttatgtgcatacacaacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagaggttgtcgcagtgcagtggtgaaagaaagaaaaggttactatgggcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagagggaggtaatattcctggctatagtcgattggtgttcagagtgttttgattctctgaatgagtcaaaagattgaaaaaaaaatagccactcttatcactaggaaaagaaatgaggaggaagggtcctgaaaatggtgtctgagcaatgaaagacagtgaatattttaaagatcacaaaatttaatttattcaacctaaatgcataaaagtacaggtggggacattatttatgcaggtatatgcaaatcactttataaaataggcaaagcccttctgctttttataagttgccaaggtggttcctgatattttaaaagctatgcacctttaatgtaatttcctaagagttggaatccctctgtcgaaatcatagtcattgtcagagcaagttgatttttttttttcctatcctctgggacatttacaaggatcttataaccatcacaaaaagagtggtttccacagagatgtgactggaaaaatcccttggaaattgctgaggagcaagtcacagtgttcaaagcaaagaacataggctttgaaaacatgaacccatctgacctcttgaatttagtacagtgaattcctgagctctgaaacatggggcccggctgtgcatgccatattggtgctataagactggcagtaggttggctgtggcatggtctatttcaaactccttcacagtgcccagtgttgcatgttcccagatgacatttggttggcagaagctgggcttccaaagctggcagcctggaatgcagcccactgtgttttgacaaacacataattgaccatctgatcaccagcctacgttctgcactcaggtcactgggggacctgggctttcaataggtccctactcctcgtcttgttcatcttcccaaacctttctccagaaagcaatatagagaaggcttaaacacacccacgcatatcctcccatttgcaaaagagaacatagtacatgaaacataagctgttgaaaatttcctttaaattgtcctggcagcccaaagtgaacaagagaaaagcacacttatggtgaactctaattcagagagaaggaatgaatacactgaattgtttcaacacccggctgtgcataagttgcaattcagttcaatggtttggaaattttgcttagaaaaagggagcaatgagaaaatgataggaaattggggcattgattgactttaggggggcattatttagaaactgtttcattttcaggtgaaagaagagacaagcaggacactgggaatgtcttctccttatctgcctgctcctccctcacacccactatgggcagtaggaggcacgcgagcctggtgaccagggggcagtagctcaaagtgaggtcatattcaaattgaggtctttgctgaagatcccataaggatgtattttggtctgaaatttgactccacacaatgtttcagcctttctcctagaaggcaaagattatgcaataggccaagatatgctggaattacacaaaggttaatgtctatttcaacactaccaaatagcctctccctccatcctacccctactgcacagttcaggcctttggcttttacctttgacctggtctccctattctgagtcagcctctccactttcaccaagtgctctttctaaaacatacatctgcttacaattcttcaaagcctccttgagcctgcaggatcaagtccaaactcctctgcacggcatacaaggtcctccgtatggcaggcaaggtcccctgcctgctttccagcccaatctcatactactctttcaaccaccatgtttcaatcacactgaactattcactcctctgaatctcgctgctacttaacgcctcctgattttgtaaatgctcttacatttttcttgattatgatccccttttctttctgctctttcatatctacctggtaaactgcaatttactcttctgactttaagacccagcctggtcaccttaccacatccaagtgggcactcctccttcattcctcttactacgtcttgtatatacctgcatttcagtgcctatcatatgctatagtctttattcacttatgtatctcccctatcagactgagatttctaacaaaagaaagcatttcttatttatcccggagtttccagaaccaagcacagtgactagctttccataaatgtttgttgaatgaaaactaaataaagagctgtacatgataattaatcaaaacgaagccaagtagtagtgttagcttttataagcatagtaggagcccattagcaatctaatgaaggcagaagatcccagcagtaaggcactttctgatgggtatggcaggggctggtgactggctggggtgacagtaagagtgagggataaattctgtgatggaggaaggtctttttaacagagactgccactaaggctgtaaattaacacccttttcaagacttaatattcaatactgaaagatattgtcctgagaataaatctgaatctgaattgtatagagacctaacttataagaaccaagtttcccaaataaggtaagtctgtgctacctgcttcaaggtagcatggcagattatggagggttcctctttgtttctgctaaacagtaatggaatgggaaattcttgggggaacatctgagagctcttcagttcctattgaaatccaggtcaaatacagattgtgatactggactaaatgcactgctaagagaagatcgaacaagcagaattctgtacctgtttagaggaggccattgaagaggcacttggagtcaaagcactggggagataatgttctgatctgttctcaagggacattggacatttcttttccttttgtcgagcctctggggcaccactctggagccatcaaccatcaactgtgtctatgggatacttgaggacagtaggactgtcataagcccggtcaccctgctgatatgagggcagcttcaagatttggaacaagccaagcaaacatgaagcctggcccagggatggcacaaggtcatgggtatatgaacggattatctgctcattataggtcactcccccagccttatgtgtggttaaaaaataggatatctctagaagctatgcaactgatggctgatgtagcatagaatcagatttgcattttcctatgagccagagacagcctttcaactacactttttatctcaaaagtctcccccttgattcctaattggtgacacaggtcccctgtactgcttgtgtctgaggctcgccctatagcactgacgtcacaatagctgagccgtgcgggcaggagtgcactgtgctgactcatcccggtgatgtgaggattaatgccttgtctaacacagagctattatgtgaactgtttttacacaaaagaactgtaacaaaaatgatttgccagtcagaggactagaaatatgcagtgctaggtaactgaggggagggctgtgcagatataaagtggtaaccataagcatgcatattgacatcctccaaagcatttacagacccactctatcaacactgaaatagagaataacaagacttgtcagggacaggtaggacccacccctgttgtataaatgcattacacacagctccagtctttggggagtttaatcaatctcctttctctgtcaaataaactgtcacgttacactttagccttagcatcctttggaggattctgcctccctaaatatatttgccactatcttctaggaatgttagtggaaggcacgcataaacaaaatagccatgggaacctccattctgtgcaaatgattataatacaagaaataccttggagtgaagagtcagtgaagcaagatataatgttgtgaataaggaacagagctcaccagagagtgagaagcagccagaggataccgataattatttatcacattaggtgactatcactacctgtaggatcttttgggtggtgtctcttataagtgactttgattatttgggttcattggcctagaatctttttcaagcagttcaaaataaaatttatttaaacccattcagtgcagcctggtttgaattttaaataatgaacgttctcttttttttcatataaaatcgtgtttttttttccccccgaatacctttccatcttttctaaaaaagagtggtacctttataaaccttctggcacacgtgaatctgggatttctttttttcccctgtagacttcataattttgcacaaaagtttagtctatttattttacagtcttgtacttcttagtaaagggatattagaaattttgtcaataaatgaaagctctgatctagaagttaaaattaaaaactattggacctagggatgggtacataactgaagaatacataattgcccaatgattgacaggggagcaaaagcccaactgttgctggtatttggctgaataatgtaagctatactttaaaagagcagtgacttttgcaaacagcagctgcagccaagtaaagggcagcctttatagaagtacagtatctgggccactggtattttctgcaccctcatggatagcaacttagtattaccaccaacagcatacactccaaacgcaaaagaaactaatacacactacagaagcactagaaaccacaacaaagtcaactaggaaatatgccagtgaaaaccacaatttcctaaatctgacacttttttttttaaaggtaaagaaatcacttttacttacgtaaagagaaggggcaggtcacagactgatggtcaaagatctgaaaatcaaagaaaaaataaggaattaaaagcaaaccgatatatgatgcaaaaccaatatataaaagcaaaatgatacagtgggaagaaagaaagcaaatctaggcatagatgggactggttgttcctaaaggagcctattttgtcacttctagcctcaaaataaaggagacccagcttcataaaaactttctaaaggtatgaccccctgctatgatgaccaagacagtacttcccagcacaaggagtgcaaagacctttctttgttcatttcattctaatctgtatcatataggatttggtagagctatgttaccatttaacaaaatagccactagccacatttgtctatttaaatttaaattatttaacatttaataaaaagctaaacatttagttcctcagtcttgccagcttcatttcaagtgctcaatacccacatgtggctggtgactgccttactggatagcacagatagaaaatgtttctattattgtagaaacttctattgggcagcactgactagaataggtaaaagctttactatacagtacatgaccaattttagctaattttgacaaagatgagtcaaaccctgataaactttgtctcttttaaggtatatttagtatgtttaatgtccagaagttcctctgaacaaattcaatacattcgtgtgtagctaagaactcagtcctaagtttgccccggacttgccttctaaaactgcctctaccccttctcaccagcctagaatgtcccctctatggtggaaaataatctgataaagtgattttaaacaaagcttctctcccaccaaacacaactctgtttggtgatgaaaatttcagatgaaatgatgaaaattttagattttggagaagctgaccctaacagtgttcttgttctatgtttaaaatctgatatttcactctttaaattacaagccaggctaggcgcggtggctcacgcctgtaaatcccagcactttgggaggccaaggtgggtggatcacttgaggtcaggagttcgagaccagcctggccaaaatggtggaaccctgtttctactaaaactacaaaaattagccaggcatggtggcgggcgcctgtaatcccagctacttgggaggccgaggcaggagaattgcttgaacctgggaggcggaggttgcagtgagcccacatcacgccactgcactccagcctgggtgacaagagcaaaactccgtcaaaaaaaaaaaaatcacaggccaaaaaaaaaaaaaactattataggactggtctgcccatcattgtgctttgtttttttttctttcttttttttttttttttgagatgaactctccctctgtcacccaggctggagtgcagtggcacgatcttggctcactgcaacctctgcctcctgagtttaagcgattctcctgcttcagcctcctgagtagctgggactacaggcacgcaccaccacacccagctaatttttgtagttttagtagaaatggggtttgccatattggccaggctggtctcaaactcctgaactcaggtgatccacccaccttggcctcccaaagtgctggaattacaagtgtgagccaccgtgcccagacccatcagtgttttgatagcttctcttagaaggataaaactgaagtaggaggagagccatgacaaattaataaaccaaaaaaagatactgagaaaacaaagcaggtccccctacctctagcccacttaaatatatcaagaatttaatacagggtgattcaatcttgcctctctgacaccatgattttaacaacttcacataaggcctccagaaatatgcaaaacaaacttcactaaaggagatcaagtagaaggacctgattaagtatctttgcattgaaaaggctaaagcagaaaaccagcaattaaagacatcacccttcctggaaagtttctgggacaactgcactattgtagagatttcttcaaagaaatgatttccctttgtggtcaatgtgaaaccttgctcaagtacatgcaggtgtacttgatgcaggatggtgacaagacgagttaagatgaaaatctccagcctggattattataatgctaatacaagagaggctggagatctccaatgctttcaaattgtttcacaaaattcatgagtttaatgaaaattttaggcaagagaattagattatgtatgattcattgaaagcacatacaaatttgaaatatatatataacactgactagtcttcaaagattttaaagctctaagttttgctatattctagtcttctctgcaagccaggatattagactatggcacaggggcatattttcttaccattttcctccctccctctctcctttcttccttccctccctccctccctcctttcttacattcctctctctctatttctctttctttctttccctctccttttttgaacttgctgtcttctctaaccttggggagaagaagaaaatattattagcaattttctatgaaatatgttcaatgatcatttttctgttgcatgttataaacccaataactctcaacaatattatgctcttctaaaattatacctagtgtttatgttcttatatctaaacacataactttcttttctaaatttcaaggtgcatttattcataaaattagttaaaattaaatttttgatgtgatcaaaagagatcaatgtaagttgtacccaaattgactaacacatccaatgtctggaatgaaaaactatctttcctggatgtcaaatgacacacaggatggctgtcaatgataggaatccaaaatggagagaaaaattacagtgtgtatgtcacagtctaaaacaaattaaagccaagttagatggaagttttattggatataattgttgtacttatatgttaatataaaatgataatatgatcccaaacttaatagtatggctaaaaatttaatctcagagttcttacacaattcataaatgttcataggcatcaaaagacacctacttcttgactgaattataatctgctatgtaattctgagaatatgtattaatctacatagatttatatttgctcaattcaaattgttatttcattgatacatgctctttccacctaagtgatattcaccttatatgtctataagttgtttttatctgaaatgcaaagaattatctataaaagtttcacagaggattaaaaacatttgcattaagcacactttgttcaaagcataaatatatctagcaaagagtataaaactgtaaagcccaagtaattcaggacgttaaaatatcagggtggaaggtgggggatgagcagagagagggggatgacgaggggtgaagtttaatcttcgtattataatgtctgagtggaaattattatatagtgtcaatctccaagaatcaaaaatattattaattataactttaaagtcaattctagtgtagtttatgtaaagttctacagcagtggttttcaacattttgaagtgataccgatccctatgagaatctctttctccagaaaactcctcaaaaacaccaagtttcaaggaactcctagactccatgaaggccattcatgaatcccaggttaggaacccctggcctaggcagacaggggagaaaaaccctctttcaatcccatagctactcacctctacagagttttcatgaaatgctataaactaaagccagcagcaaagaaaatgtataaaaaagagttctaagtgggtaagggtatgtggttagagccacacaggcttctttgaaggcctgccagactcctaccttcctagtcctttataatttcttttttaaaaaaatctacaaagccttagcaacaatggagtagaggagtaccgagcagagagatgataatgatataagaatcactatctactgagtccttcaggtaccttgagaaataaatccttcccaaatttggatatgagtatacccaggaatgtgagcagtgtaacgggagtagaaaaagccacaaaataaatagtaaatacatggctgtcttcctggagggtcagtattccttgtgggcaagtaatttaaagtcttatttgcacacgtgttcatttatccaataactacttcttcaatgttataccaaaaagaaaacagatactgttcttgtcctcatggaacttccggttgagtgaaacaaacaagaatatattgaggagctgaaaggaaaatctgtgtatatattttttgggtgaaacctgagacttcactgaaaagtcttgtttgtggcagactacttcaagcaatgtcctggcaggcacccttagtattggatcactcactctaacttgaggatcacccaagtggaagagtttgagaagcatggttagcagtgtatcatttaatccccactacaagagaaaatactgttacttccaatttactagagaaaaaagagaaatttgagaaattaggaaacagctcagatcataccgctgctggcgtctgaataagtgtgtgccattccaaaatctacatatttttaaccactaaattacactacctttaggagtttcccactttatgtttccccttgaatctgggctcattcaggattacgcaggctagtttaagcttctctttggaagcagacaggtttggcttgatttgcattctaaatatttcacagtggtaagcgaaagctattattatacccattttatggtgaggaagctgaaccacttgccagctgaggtatctggctgggttaaaaacagaatctgggtcgtcagactctcattcctcttgactaactccaagcctaggcactattactgtccatgggcttttctgaacatgagattcacactgggtgataaagagtgagacaaattctgctaagagaaaacaataatagtgcaattgaaaaaaagggaaaataagtaatcataactcacaccaaaattggttactttcagcattgtgaatagaaaagggagagattattcatcacaaatgagtcagaaaattagaatgtgtcactgcactgatgacagagctgaggaatttggatgaactgaagtttgacacttatccttctagctgaagagggtaaatggtgtgacaacaggacagaaatgacctcttatttccaatcttaattaatatttccaatcttttttccttaactactctgtctaaaagttagatgggtttatatgtttgttttctatcggtagagataatgttttaacatccctttaacgttctagaagtattgcgttaattaattcttatgtgggagtcattccaaatagtaggatgatgatttttaccttattgattttcctaatacctttctggtttccagtgttttcaaaggatgaggcactattagatttttagatttatatgtctctcaaaattaagtgcctgtcaactgatattccatctttactctggatacatgatttcctttatctgacagattcaaaaaaatttgtactagatttaatgacatttcatgcatcttgaatttgggagtttttaattctctattttctatttggcaaaaggtttacaggagaaagccagatgcaagggtatttatatgtgcatacagaacctgtgccatcactctctaggtactttggggtttcctgcaggacagattcttgatgtattttcattccttttggtcaggaagaagaagactataaatgccacaaatggtcatacatatcttggggtctgctttccaaaacgcatattattttggatccgtctcaagaagaacaataagagaatgatactgagatctttttttcttaagatgctatgataacaatcctaaaaaatggcctgccttcaaaattttgatgatgaaataaggttataatcaataaagagagaagattttaaagttcagcaattaggtctgggactgcttctgcgcctgagacattgccaagatacaatgtaacactccatcccaccccatatgaatctccctgttccttcttgattcttacggggatagggtctgacagactagaatgaaatgaaagcagtagtgctgggaggggtggcaaggaccgaatttgtttaatacatttaggatggttttttattgctgctaaactagacacaattccttagcatgatgacattcaggaatcctttacaatctgattccaaagaactttctcttctatatcttaaactactgaaattgtagctctataaattccaaagggattgatgtaccaggacctttgacttatagtaaactgatcttaagggatgctgaaaaggtttggcactgctatcatgtggtctaatcatttagacttgtcactaccaactatttgcttaagagcctccaagacctttcacaatctggccccggcccacctctctacttttaataaaaaattttcccactgctgcttctttatatacggtgacagcctatttgctcttccctgaacatggcctgggacatctatgtctctgagtcagctaacggttcacacttgaatctcccaagcctagcatagtgtgtgaaacacagcacgacactccaatgtttgttgaataaatgctgtccgtctattttaggagacagagatgacagaagaaagttgttaaatcagtaaataaatagcaccagagagaggtcaaggaaaagttaattttagtgcattttaggagtgggggcaagatgagcttgaagattaggaaaactgatgctctttattcttgggtctagccaatgctatgagtcagttactttttcgggaacaagtttaaacctcaaggttaaatgaacacaaatgccctgtccatcagcatataatgaaaaagttgtggctatttccacatcagcacagtgaaattaaaatatgcagtgcctctctaagaggcatcacatatgacagagcttttaaaaatagtcccctttgccactcaggtatagaaagagctatagaaacaaaagcaaatgtttgaaaaactgagataatttagcttagggaagaaagagctgaggtgtgtctttatggttttttgactataagaaaagttgttacaaagaggataatgatcagcatttttgtcctagggcaaaatgacattaaaccgtccagtgcagaatttaagacttaaagatgaacattctaaatatgcaagtggtaaataatcaaatagattgctaagagcagttctgaaatttctttcttcctgactctcttaaaataggaaaaatcttcatctattttggataaaataaatgcagctctgcctccagtcaggagaatgaattcaataacttttctagtcttgtttaactctgtatgattctataaaattctataaaatgttcaccctaaaaattatacagaatcacaatacagttgagtaaaatacattctacagtttaaaaagaaataagcaatacagatagttgataagttattacattcaaaatagtaatatatggtgctcacgttttttattcaatttgccaagtgcatataacacaaataaaattgggaaaaatgtacttgaatctactaaggctttaacatagcgattatctagagtaaaacagtctaacaattaattctttcatgtctaagaaatttgctgaatatttcataaacctcatattgaatatgtatataaactcaatttccaattaaagaaaaagttttttgaaggtccagaaagtaatatatgaactcactattattatttcctggaccatcttcaaagacaacaggagaaccactaaacaattcctttaaatgaccaaaatgtgccccatatgattaagaatgtaaatctaataacagactcacagataaggtctaacaggggtggcaagttactggctttctttgtctatttaccttttagctttggagctcagcagaagtgtccattacatacagcacagggttagatgaacagctccaatgaccttgtctgaaccaaattcatttaaagcagtttgccacttttcttaaatagaagatgagtccattctatctatggcccagatttggactggatcactgaactattgcccaactcttataagcaaagcactaacatgtaccaatcaacaggcgaaggcatcaggaaggtaaaaatacacatacataagaaactggcagtagattaaagaagaaagctatatctaaagatggactttggcttttaaagcctttgagtgttattcgaatcttgttaacaaaaacaaaaacaaaatctgcattccaatgtaacttgtagagaagatccagtaaaaaaatgaattcaagagagagagagaaagaaatgtagttttattttgcaacccattatttccataagaacatgaatcaaagagtcagctatgccaatttcttcatagctgactagttataggatattgttctagtcttcactaatgacttcttgaggttggttattactgtgatcaggagttgggaggatagaggtctaagacctttcaaaagaaacgttttgtttagtatcactacagaaaataaagtcagcattaagctaactttgacaacctaactaggataatggttggtgcatgtagccattgcttatgctgcttcataatgaatggaacagtaaaggtgtcaagttaaccagcaacttgaattttgaaaagctgtggcacaataagctgataacataggttgttagaattagcaaaacttactttctgcttcccccaccttctagtcctacttatttccacatccacattcctatcaccaggcagttaaagaaacagaaacaaatgcggctgagactgcttctttggggatactcttagtgagctctccatctccccaaccacaacttgctctcagtttgctaaaaatatattcatttaattgttttaatgcctctacttaggggaatttgcattttcttaactgttgatacaagatctacattcagtttttttcacaggtaataagcaaagtatttggggagtgtgtgtgtgtgtggtggtggtggtggtggtggtggtggtggcaaattccgtcctagatgcttcgagttttccaagtatactgctaaaaggggtcatttgcttccccacctcaagaagccaattgtgcttatagttttacttcaaataaagatatatacctataaatgcacacatcatacgtgcacacacacatattcttcttctcaaaagtcataaacatttggtgactctctgtatactccatgaagtgctgttactactaaagtcagagtaatttaggcagaaacataagaaaccccaaatggtttgcactgaaattttattaacatatttgtcagtgttttcctcatggataatctccattggttcctggctccttgtcagcatatgctccaggagcctctcacaatatctttctgccctagaaatcctggcctgtgagatttccttgtaaatatctgaattcttgtattcacctattaatgatccagggatcgaggatgttttctatctgctccttaacctcccacttcaaggattagattgtaaacaacctagtgggaacccttcaggccaaaccacagctgaacgaatctcagcaggcagggaacccgcagcagtctgtgaaataccgtgaaacacaattacgaaaatataaagtattcacccatactttggggaagaaattatgttgtttccaagatgagacctcaaaaataaggctagtatcctaattgagaaagacatgattttaaaaagtgtcagcagaggtaaatttttaaaagtaccagatttgccaggtccttctcaaaccatagattcattttcagtatatgacagtggcctgagccgacacttcaagggaagtccattcatctctgaccaatgaagcccaaagtactcactgcatgaaagggttcctttcttgtttccaaaggcaatcaatttttgtcctagagtctgaaggttcatgggctttcttttaattttgtcagtctgcacatgcatggttcctcctgcatgatttggtctggaggaagtgacccacccacaacgccacagagctaattaaccccacactgagcttttttttttttctcatttcacacatccactcaatgctttaaatgacccagcagcagcatgatcatatgatttcttccccctcagtgaggaaagcatggtgatgggaggagcagggatatatctgccctaatcaaaacagcagtgtgatcctaaaatattatctaattgcattgcatccgagggtgcaaaatactaagaaatccctgaacgaatctctttcatgtcattcatttaacttcttgcagtgtccatttgaagtagcaaataatacataagaaacactgaggtagagaagtttgatctatactcagaatgtttaaaaaacatccgatcttacagggggtaaaagaccgagagctccttccctatcccgaatagcttcaagagaagggccttttttccatttgaaggaacagactcatgtttttccagatttattttttccaaagggaatgccttgaaaactctaagatgatcactgttttctaacttttcaaaaaagaaaaaaaaaagtgaacatgatggtggtgggtgatttaatggaatcagcttgtcaacatgatgaaactgaaaaaagcttttatagactctgtccacatgctaaaaaaaaaaaaaaaaggcaacctttaaagttatgtgtatagtatagagtggtttttgtcatggcaaagaaaagaaatataattatcttatgcagtaaatgtaaggctctgctaagaatctcattggataaatcatagaaatacatcctggccagataaatggagccagacaagttctaggtcttgtaagaagctttcaaaagaatcatcatattgtaagtctgtcatctctgtaagtgacaagaaaaattctaggctatttccctcggttctactagtaacatggcttcagagttttaaagatttagacttaaatggacaagaaaatgacttctgaatatcccatcttaggcaaactatcggatttctctcattcttacaagtaagtgtagcaaattggttcaccttggaaggacttggttagagatcatatatgtcttatgtgaacttttaacctctctttcctttgcaaagtgatttatgcatacactattaaatacacaggaattctataattcttagttcagtgaacagttagtacaagggaaaatctatctaatattttaaatttttgtttagtgtcttaaatcctacactttagaactggagaccttatagataagttctataaggtcttcagtgtgctgaaaaacacatttgctactgctccctaagcttctcttaggtaaggctgccaactggggtaaattgatggataaaactagctcaataggcaaaaaacaaaggtccagtgaagcacagtttatttttatttatactggtcagaaatatcacagttaacaaatagcctaaatcaagctcttatatctagggctccagcctttggctgaagtgtctcatctggtaattctgaaaaaaatagggttgttgtgatttcaaagactctcctgcccagtagactttttcaggctcactgatgcttaggattctaaagcctttactatggtctgttagaccaatacagtatgtcccttactatttctctgacttcatctcctaacattttcatgcaaaattggtccaacagacaataaaatagacagggataggaatatgaatggggactaaaaggaactaattaataaaaattagttgctttatgtccttgttaaatatcaactctttcatgacagcctaataaagtttctgaacttatcttgagagttggttaagataggggagaatatacaaagtatttccaacaccatgcattcattcattaattcaacaaatagttttcccgagtctattattgattactctgccaactggattctacttctgccctcaaggaccttccactctaatgtatgttttggagagtttctgtctctattatcactgacaggttattagcccactttagacaagttataaatataaccacctgccatgatgattcctcttcttgttctttatttgtttttattcatttgccctgtaacatccattaacctttcatgaatgacctgatcctttgtgagctatactatcaacacagctaatttttatataaatgagaaaccccttctccactcccaactaacttttctttctcaaacagccatgaaaatataaaagtctacccagaattatttaagtttttgaaatgagtccttacaatctgatctgaagcaccatttttttcctttcttttttgaaagagggaatggagcctcagcccctaagatacatatctcaagttacaggcaaattacacacaagttactggtctcccagacgtagtactcactactctctggggtagaacaatttctgcattgaacagaggaccataatctagctcaagtaatctcaatctcagagaacagttaaccaagtgcatatttctggtccctatattctcttataaggagttaccctctccactatattttggtattttctgaacctggctaccttaggtaaatgacagtggacatggtaaaaagaacactaactcttcctcaatttgttaaacttgtttttcctcctcatatgctttataaacaaaaatgggagaatttaatgtatgtatagagcagcaaatgttctctctgttgctttcagacatttttatcttatataaacagtggtgatgaaattataaataccattattccacctctatgttaatactcttattatcttgcatcaacagacgtgaacaaatacgtacatgacaccaatcaatcccttttctaaaaatgcagtttttgtatttctaaacagtggaggaagaattttatgaattcaacatgtagtttacctatttatattttgaattttaataaagtaaaaccaaattatcgcttatgttctttcacacttacatcagccattaacactctccatgctggcatggggtagggggtgtgtagaactaatggcaatgggtccaagtcccctgggtcaggtggttaggggcttggcaggctggagaggatgtttagatgctggggcaggatatttcaacctgcttgacaggtaagagatattttctggcagtaagaggaatattttttatggaacaaattgctagggagaggtcattttggggcactaggtgagagaaatatcaaaaccaaacctaaaagcagtctaagggaactcgggaaaagaaaatcactactttttcaatctcctcactggtttcccttattccatagtgtgccttctccttccatcttctagcacttcatactcttttctcctccatttcttcaggttttctttctcctacctctttattataacaaaaaaaagcatttaggaagaattctaggagacagggagacaaaaaaaaaaaagaatttagagaagacataataacatactgcataaatatgtatgtatgtatgtatgtgtttatgtatgtgtatatgtatgtatatataacagatattcgatttaccaagaaggataaactgggacttttgagatttaaaaaattcatggtatgtctggtcatattaatctccaaaccagcttgtttttagcattgctagagctataacagaatcaggagtagaaaacaaaaggaaaaaaataaaatttaacaaaggatttatatttgcaaaggaaagaggacttatttagagttgtttattgaaattcccccaaagctattttttgaacttatatattgacaacatcaagagaaggagcttaggaattctcatagggtttaggaactactaaaccttgtatattatgttcatctcagtccactcaagcaagtaaaggataactagaggatggtatctcacagtgcataacatggttggttactttgctaggctgacatatggagacagggcccataggagcagagcttttcttacgaataccagagagagacacccaggttcatctaaatgtatagggcatgagggattagtggtacagtgttatctgcaaagtacctaaaagtgttttctaaacaagcactaacttcttagcccagtcttcttggggattaaacaaaatccaatagtaagtaatggggaatactttatttggtcactgggttggggagggttgctgagacatatgacaacattcaatccattaagataggaggaaatgaggagaaagagaaaacaaagaaagggagagcgagggccagaaaagaagagtgtcacctctgtagactctctaacagaataaatcgataatcttaagaaaagtaaaagagcatgcctagagggaaacctcagcacacttttggaatccaaggcaaaaaataaaacaatttgcttcttgtcaagtttattgccattgacccatgggaggttcctatttattctgctcttacatgcacaggtatttcttctactcttacattcttttcctaaggattagcattctgtgataatggtggtaatgacagctgccttaaattagtggcaagttaggaatgaaacactgaccaccaggctatgttcttgaatccagtctatgccctgtaatgtgttcattctactttctgcattttctctgagacctgtcgcataagacttgttttgtaaggccgggctccttacggggacacatatggctccagaaaacaagtactctactttctcaccctgactttttggttttcttgttttttcctcttttctcccagactattattttccagtttcttctctaccagtctggacgcccatggttgttaactttagagatacccaccagctccatcaattccctcatctacagttctcaactgtatttacctagttctggagctcagatgaacccacatgtatgttctcctcagcttccaggctgctgatccttgctggagaaaaagcacaaaactgtacagcttgatgctcctgcagaattacggtttccagcataagttcgaatttcagaattagtttgcaattttaaaatttgctcctagtcagtttcctttttcactccacagtttcattcattactctatttaactggttataacccatcccctacccttcactctcagctagtaaccttgcctccttttgcatagagaaaacagaggccatcaaatggcacttcctatcactccacctttgccaccaatgaatccgcctgtaacatttcagagatctttctgcctagcactgataacctcatccaggatcttattatatcagttacttttcctttcttttgtattttcaattttcctactgcctgccaacatgctttagctgtcttcatttaaggtaacaacaataacaatgataataaactaacaaacaacaaaccatcttttgcagactttatctttccctcttttgtgccaccttcaagcttcctaagctcccgtttattcctcaaaccattacaatctggtttctctagctgtgtttctaattaaacaatttttttttttttttttgccaaagtcaccaaacacttctgaattgttagcttccaaaatccattcttcaacctcattgttttctttcttttaaaggtcaggttcactgaggtataatttacatacaataaaattcatccttgctatactcatttaccattcaataagttttgccttatatgttggaggcctgtaaaatgaagcccaacccccaagccgctttgcttcatatacaaatccctttggcacctctcagcagtcttccccacataacccattgtctggtgacaccacactactcagcattcaaggatatatgccatgtacattcatgccccttgtactttctttatgtttcctctctataaacatatatgtcttggtataacacagtaaatgctatttaatattaccacatcaatttccatatagaatcataaatctatacgttattttgagaagctgaggttttccaaatagaagtcatccatcaaaatgctactacctgaagatctctattattttagtattatgggttgattatgttcccttaaaattcatatgttgacattctggcccccaattctttagaatatgaatagatgtgtgaatagggtcattgaagatgtgattaagatgaggtcatgctgtagagtgggcctgcaatccaatatgactagtgtacttataaaaaagagaaacttaaacacagacatgcacacagggagaacatcatgtgacgatgacggcagagattggggctgatgcttctataagccaaggaacaccaaagattgccaggaaaccaccagaagctgggtgggagtcacggaactcacagccttagaaggagccgaccctgttgatactttaatcttgaacatctagcttctataactgtgagacaaaaaatttctgttgtttaagccactcagtttgtggtagttcgttacaaagccccagaaaactgatatactcagtaaaagaaaaaatcttcagtatattggaatcagttctttcactcatcaggtacttactgagtgcctactatgtgctaggaactgctctaggatattgaatgaatgactaagaacttcatcacgttactgcattttttgttcactaataagtaatcaatctatcaatcaatatattaatagatgaaatgcctatcatttattttatcagcaaacatttgttgagtatctcctatgtgtcagacatcgttctaggcacagaggataacattattggcagatcaagttctccaccttgtatagtttaaattccagtagagggaacatatattaaacaagaaaataagtaaataagatatgtaattttactctgtttctgacactgagagtcataggcatttatcctctaaatcactgaacaaagcttggaactagatagcgaacatgttacttcacagtttacaaagtaataaggaagacaatgaggtctcatactagaggcacgttaaaccacaggcagtgtgcaggcttaaagtgtttgggaaggacatcccaaaagctaggtttcttagtcagttcgtcagtcaatcaacacatatttcttttttttttttttgaccaaatttctctctgttgcccaggctgaagtgctgtgacacgatctcggctcactgcaccctctgcctcccgggttcaagcaattctctgcctcagcctccctagtagctgggattacaggcacctgctaccatgcccggctaatttttgtatttttagtagagatgggatttcaccatcttggccaggttggtcttgaattcctgacctcatgatccacccgcctcggcctcccaaagtgctaggattacaggtgtgagccactgcacccagccatttgacatgtattttttaagcgcttactgtataccaggccctatgctgaagatagtagaactgtggacagagccaacatggtactattacccactgagctcacattctaaggggaaaaatttgaacaacaaatctcacagtccgttctttatcatatatcctcataagaatacataaagggggttaggagatcacctgggtcagaggactggcccatgaggggtttccaaggggccttccttgaagatgtggtgcccggacactgctttagggctggggtatgggtattggtttgagcagggtcatgaagttttcggtttcttcttcctcatcccctttcaaccatgtacacacatttcaaatacttaaaagcattcttcaaatatactaagaacaccaagaactaaacacaagagaaggactctccagaggaaaggggccaaaaatagaagagaaaaaaaacccctaatctcaccatttgttttgaaaacacccaaaatgattaaaacatattataaactaaaacatatgaactaatcacttgccaagtttcatttttaaatcaaagccgttttgaggttcataaactgaaaaaagaatcttcaaatatgaacttgtgtttttcttttcttggccctcagttggcttgaagcatttgctgttatgctgtgtggagggaaggggaacctgctagttaggaacatgtggcatgcatgtactagaaggtaagctccacaagatcatgactcttcacagtggtatccctggtaagtagaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaagcctcattgcttcatcctcattcccttcaagacctaatagaactgcccccactctaaggcaggctcagagagagccaattttgccttttgtcctccctgggtcaacaatgcaattgctagggaaatcatctgaaaaagtctgtctctacaatgcaagtaaataatttttacagtacattggtaatttccctgagcttacctaagcatatatactaatttagtaaaattctcttgtttacaaactagtcatgtatctgcaggaaaaaaaaatctcctcaagttcaaccagtttatccatgtctgctcaggatcagtacatgactctagctttattcatgataaataagatcaacttcaagaattccatcaaaccccagtaatgtgcctttagagagactgggcttatagcatttcctctgccaccctccttgccctgcatattaaaatacaggtatctgattccagtttcaatggggaaacttctgtcgtgccagaggagggcatgcgctgatttccccactctgatggttgctctagtaatcttggtgttgtggcatgtttcccagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatgaaaaagaaaaagaaaaaaagaataaagatggaaatagaaagaataaagatgacttctctctcactgtttaacaggagtctctttaaatatctcaataatttgacattatatcagttgaatatgatgtaccccccacacaaaaatcagacaaaaacacttaaagggggtgataaatagggggacgtcattaacaatgcaaattgactcattccatagtttcttagagtaatgagtcaactgactacgtgatctcatgtacataattttgttcggcatgagattttgaggtatacaattactacagaaatcaaggtatacctgcaatgtaaagggtaaatcgtaggcattttaaatgaaagctggggataggatgtgtgttggtttgagggatgagtgggagtggatttaagagaaaatcagtctaggaaaatatcacataagtgtttgtaagttccttgatattcaggtctgtatcttgtaatgctttattaaacatatttcagactaatatgtccattgcctactggacattcatatctccctgtttttaaatacctttcaaatctgtatcttgagccattacttatctcttgacctctaaccctttatatcaaatgaattactagacaattacaattagatattccaaaagcatcctaaattcaacatgtcaaagctgaactcatcttttccttcaaactttctcttcctcctatgttccctatgtgagtaaatattaatagtattaccattcacccatctgccaaagttccatacctaggaagaatcatggttgcttttatctcaccttcaaataatcacccgtgcatatagatgtgcaatcctaataaccaaaggaggccttttttgaatagaaagcaatatttacagttaattgggttttgaactaatattaatttattaaacttacaaattttaaaagcctagttttctttacacctttacctgttaaaaacacacatatatttttctatgtcttaatatagcaatttttgcataaaataagaaaaattactttcaggaagggtgagattactagacaaaaaaatttgggacctcaaactatttcaactgtcagtcagaatgttaaaagaatgagagttagggtctgatctgggaacacctttcaaatgattttgccaaggtcaccagtagacacactgaatgtttttatagtcactctgaaaatgagaaattttacgtctataccctacaaaggaaaatttacaatccaggtcctctatgtttaagtttcattcttatctaactcttttataatcactttccactttatagcctgataaaggtagacaatattttgtgtctccactaaccaggtttcttgaatctagtgccctttcacttcataacgtttttcacatttctacctctctcatccccattgcaccacattagctcagagcatcattatctgtcacttgtaatattgcgacagtacattgtactatattttcttaagtttctgagtctttgcacatgtcaccacctgtgtctagaacacccatattccctgataaacatttactgaatgaaaaaaaagttaataaatgctttggatgttgctgctttgggtgctgaacagaaatagtggcctatctaagattctggataagcctgcataaagcactcttactttcaaaattaattttgaagaataagaaaattttgccatggagaatcatggagcctatgccacaatattatgttttgcatttaataaaacacctccaaacccagggaaagaatcagttattacttccttcaattcatacaacgaatatttactgaacactctctatgtgccaggctctgtactaggcactgaggatttcttagagcatagaacaggcaaaaaacaaacaaacaaaaccgaaaaaaacctcacaatcatggggcttatattccatggcaagaggaaataaatgtgtaaataaaatatatattttgtctgaaggcagtaggtgctatgaaccaaaaggggtggaaagctaaatgttaaatacagtggttatgaaaggccttacttagaagtgaaaattgagcaaagacctgaagatgataagcaaacaagccttatctggggaaaacatttaaggcggtcagaaaagcaagtgcaaatgtgaaatcatgcatggtaggctggaggttaggaagggggtcaatgaaggttgaggggagtgagctagggtggagcgctaaatgaagacagagaggtaatggggaaattgaatatggagggtcttgtgaactactgcaaaggcttttcttccaagtgagatgttgagccattagagagttctgagcagagaagtgatgtggtctgactgaaattacattacatatattgcaaagcatcactctggctatcattttgagaatagactgtaagtggtaaggccagaagcagggaagacaattaggaggctactgcaataatccgggtaagaaatgatagttgcttggattagggtagtagtggtgatgaggatgaggagtggtaagattctggacttattctgaaggtagagctgcaggatttgttcaatggttgggtttgtgagagaaatacaggtctgggagagaaataaatttttgatttgagtaaccctaaaggtggagcgttatttaccaatattggggaggctatgtatttgcttggtaaaataaggaattccatttctggtatgtcaagtttgagatgctcattagacagacgtggagatgttgaataggcagctgaatatgtgagcctagaattctgtgtaaaggcctggactagagatacaagcttgcaccataagcttgggtgcaaatattaagagagtgaatggagctgaagagaagagcttcaaagattgagctctagggccctctaatgtttacctgcttgggaaatgagaatatgctagcaaaagagactgaggaggagtagactgtgaggcaggaaaaaaatcaggagagtgtggtggactgaacgccaagcgaagaaagtgttttaatggagaatgaataatgggccatgtaaaacaattctgagacatcaggaaagacaaagactgccgaatggttaatggatttagcaacatggaagtcattggtgaccttagcatcaacagttttactagactggtaggtgcaaaagctaactagaggggcaaaagagaaccagagcataggattggagagtgtttatagtgactatacgcatttcttgagaagttttgctgtaatggaaatcaaagaaatgggacaggagctgctagggagtatggtttataagggtatttttaggatgagataaattatgtgtttgtatactgataggaaagttttgatagaaagagaaaatttgataaaacagaagaaagatgtgagctttttcaggagcactgtttatgcatgtgcaagaggagagagattctaaggcacaatgagggatgggctgagccaagggtacacagagtttatccatagttgcaggagagaaggcaaaatacatgggtacagataaatatgggagggtaggtgtgctggacagcaagtatttgtgaagttgtcttttgatggtttctattttttcagtgaagtaaaaagaaaggttctaagttgagcgtaaggatgggggaggaggtgttagaaatttgagagagggaaaaatatgaaatattcttgtacagatatggaagagtaaatgacaaggaaacatattatatttgctgggcagcattaacggcctccttgagggatcatgaatttaaactgagagtcatacatttgcttgtgtgtttttctccagccacattcagctggcacacaggcatgaaatagatggcgagttgcatatgatcagtatagttgagatttgtcaagagagcacagttaagtcagagaaggtcaatggtgttaaaggcgcatacaaggaaatgattaaaatcattgtccatggaatctacgctatataatgaagtgagcatatgagaagctatgggtaaaatcaatgaattaggggtcctagtgggtttaaggaattggtgtattaggggtaacaaagggattgaactaccaagacattaggctgtggttggaaaatggaatgcttgaaattgagattgtggaatattgtaattattagtaattaaaacatcagaaatgtagccatgggaatgagtagctatggcagagtggagaatcaatcatgagaagttcaagaaattgagaggaggtattagagggagcgtgtatttacacagtgaataaccaataattgtaatggggtagaaatggaaagagtgttagtgagctaggggctaacgttttcaaggaattgggaaacttgcctggtagacaactgcatcaagggggagttatgggaacacttagcttttctactacctcctcaatgtttcctctctctcactttccatctttccagcttatatactggcattacaaactttaatttcctagactagatagctacatatcacctgtgtctaccctttctcctccctatccaaattatctccaagtcttgagaatttccaatttttttttctgagatggagtctcactctgttgcccaggctggagtgcacagtcatgccatctcagctcactacaacttccgcctctcaggttcaagcgattcccctgccgcggtctcttgagtagctgagattacaggcacgcaccaccacacccggctaatttttgtattttagtagagacgaggtttcactatgttggccaggctggtctcgaactcctgacctcaaacaatccacctgccttggcctcccaaaatgttgggattacaggcatgagccactgtgcctggcctccaattttgaatactctctactctccccctttgggaccatcactactctagcctgtcactctctattttatcactcagattaatgttcttcatggcactaatcgctctctaaacttaacttgttcatttatttgtttgctttttttgttggggggggtgtctattttccttcattaaatataaatttcataaggggaaaagttttgtttaatttgtgcctggaacataatatgccctcaataaatactttcaggatgaattaataaatgccccctataacatgctgatgaatccttatattcttgggttcacacaacagctttgctttactatcctaccagcttctccctcctttcctgctcaaaccatccatttcaccgagtaaagtcatttcactactcccccaaaacaccatgttcatttctattcagatgatttcatcatatttctcccttgtttatgtctattccccacataccaattctttgagtcccagcttaggtcttacttctcggatggtttttctatgattaccatgaggcctgctgatttctccctcctctaaaatcctgctatccctaacaacaccagctgctttatattttctaattgtttcatatgggttattcttaccttttcactttaaaataggtttatttttggcctaaggatcctgacttacaactacagtatactcagtaaaaactaacacagtgtagggcagataacgggtattcaaaaaatactatggcctccttagatagcttcatagacttccatcttcctcaacaaacattttctaccttttaccctgctgttagctaaatctaactattcttcctgctctatgatactgtctttgagaccagaaccaacccctatgtccactacacagaattctacactcttgcactgcaattcccacagctaaatcattgtcattgccattattgttcctggattctcttggcaattttagtatattcaaggcatagctgccaagatcatcatcctccttgattgtttggaatctttatttttttaaatccctgcattttttccatcaaactttaagtgttcctgtgggatttgtttttccttggctccatccttggcctggttcttctccactttcttatgttcagtcactcgatttgccctttgtctcatttgaaggaatcagctttcacaccttcttttaaactaccttgcatatttagaatattttctcaaataatataaaatttataatatttatgaataaatgacacaatgccaagatattctgtctcttctttcaaataacatctgaagatgcacctgcactagtgagttctatatttaagatattgaataagtatcattcacccatctgctttcattctgtcctgcattttttaggacctgcttcagagttgtattttgaggtcttttggacggggaactgtctggcatagttcacaaactggcctttgctctgtatattcatgttcctttgataaataataaataataataatagcccactgtgcatttttacattccactcataaatccctggaaaaagaaaaactaacaaccagggattataatagaaacacagaaacaaaactaaccttttaccaggttttgctacagtaatatatacttccatagacctatattctaacaaataattacctgcttaagtcatttgtaaattgttcctttgccaacattatgtataatagcaaatgtctacgtggtttataggacagggaaaacaactagaacattacagctatgtgggggatcagtgcaaaagcagcaaaataagaggtttactctgttgggtgcacagtttggaagaattagtctcacaagtagaactacttgacagaatatatgcctgctctccagctcccccttctcccctcctccagatcttttttcaataatggaagaagacttactttcttttttcaaatccaggtgggaagtgtatcattttgcgtgaaaaatctgtttttctttgaacataacaaatggtctgattgaagctgctctatgaaaacggcagcatatctaaccagggaggtgggaactatagtttaatgggtggagcacctccatatttagctgcagatgagccacatttaactttaaaaaaaataaaaatttaaaaaataaaagaaggccaaaatgtaatgattgtcttgttactgcagtggccactagatggcaggtccaaaaatctgatgggagtctcacaggagggcaaatcttagggagcagaatgtttctggcactcaatccagtgttggttcatcaataagccttggcagtttgctaaaatatcaggtgggtaagacaatatccatgttatttcacagggctgaagggggcaggaagccctttggtatctaggtttgtagagtattgtcatcacatactcacacatccagatactgctacccctttggacttctgtccacagacattcttggagctggtttttatatatgttcagctgtattccattatctaatggtctgtgcaatactgagccataatctcaggagtgtaaaaggtagttgtctaatctgcctccatggaaacaaatgaaggaggctgtcaggctagggtaagggaacatacagctgtactgtatttaacaacatatatttaccagtaattgcaacttcatgttaaatatgtgtatttcctatactggaggctgaccatatattcatgttaattgttttgaaaaagagaatgttgatatataagagacttattatttaataggataaaataactaaggcctatgattaaaaatgaaatgagtaaatttagaacaaattatttgttgtacacagtagagttttcattttcttttactaggatgggagacttctagatgtgggtcttatgagactataaaaaagtcattcttggaccaattattctgaagatagattgtgtctttcccttcataatttttttttttttttggttactagattatcctgataaaagtgatttcactacatggacaatgcctacttttctttatcttttaattaaagaactgaccttatgatttttaaaagtagagaatcacaagctctgagataatttatcattctcactaaagaaaatgtgctctagagtcaaatttatctttgtacaagagctgtgacatgcattttgatatacatttaagcatctatgtcaattaaaatattataaaaataaaagcaacaaaaactcaattatagccatgcaactcagtcatcactcaccttttgttccctttttctttgaaaatttagatagaataatggtaaacatgttgatttcatctattcttgctctgtatatttggactgtgaaatgtctacatgagacacaggaagagggcacgggtcttcaggataaaaaacaaaaaaaaatttttcctaaagaagaaatatgggctatattgaattatgatagatgttttaaatcagtaccgttttcctttagtttggagtaaaatttaaaatgagatgactgaaataatttacgataaaatatcatggttatttctacatatttaaggtttaaaaatgctcaaacttatactttcctcatagaaagagcactggaatgggaaactgagaggtctgggttctattctggctttgacagtgactcactgtgtgacatccagagagcatgacctccccaggctcctcacttctgaaatgggagggttttgaggacaaagtctctctctgctttaacattcaatatccaagtaagtaaattgctacgtattgcagatttttttttcctcagaaatagactaatttcctccgatgaaagaataatactgttaagaagctgatgttgaaagctaacatgtccctaccaacactgtgggctctacccatgcaggtgaagctagagcttgttcttccttcaatcccccctttccctattctgcaccactcttccacacactcccccatcatctttaagtctaaattctacctgagaggtcctctgtgacccctaggtagttacttgctaattattactaattattcaataactgttttacttttcctcttgagcacatagctaagttccatttcccagccttctctgcagatagctatggccctgtgaccaaattctggtgagtgggatgttggtggaagtgacatacgctgtcccaggcctggtccattaaaagttcctgtgtaatcattgctctctcttcaccagatttctggctggatgtcacacccacagcaatcttggaagctatgtactgaagagcctctgtcaacctgggtccctgaccagtctttacatgagcaagagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaataaagtgtaaagtctttttctaaatgctgtatggcttgccttttttatatatttgtgtaaagaaattcgtagtagtaattctctgacactgagttaaaggaagtcctattttttttcacaattatgtgaaaacacaattatgtgctgtataatgacattttagtctacaatggaccacatatctgactgtggtcctgcaagattataagataactgaaaaattcctaatgcctagtgatgtcatagtgatcataacatcacagcacaattactttttaaaacataaatttagtgtagcctaaatgtacagtgcttataaagtctacaggagtatacagtaatgtcctaggtgttcacattcactcatcactcactcattcactcacccagagtaacttctagttctgcaagatccattcattgtaagtgccctataaaggcatacacttttgatcttttatgctgtgtttgtactgtaccttttcaatgtttagatatgtttagatacatgaaaacttaccattctgttataattacttacagtatccagtacagtaacatgctgtgcaggtttgaagcctaaaagcaataggctatatcatatagcctaggtgtgtagtaagctctatcatctaggtttgtgtaagtacactctatattgttcacacaacgatgaaattgcctaatgatgcatttctcagaatgtattccctttgttgagcaatgtgtgactacattttgaaaagttaaaataatactaaagggagggacaagtgaagagctaacttgagaaatctaagaactaggtaatttaaaagaagtgcttttagttacatagggtttttaacatcattaccacctatgaaattacaggtattaactactgtctcaaaatgatcatcgcccttttgatactttactctcagtgtcatggctgacctcttttgagtcaagtttattggacattttcagttttattttttaattctcatcactgcccctccctgaaatacttcatccctggtttccttaataatactggcctaatttccctattctctatctctagttttctctcctcttttgtttggctcctctttctcatctattctttaagtattagaatttcctagtgttctgctctgagtttttctttctctcataatttttccttgagtcatcttatctagtcttatggctttacctactacttcctcacaaataactcccgactcttgatctttagcccagacctttcttcggagcttcaaaacctgtattgcctatagtatcctgggcattttaagaaaatctaaatattttgtgccaccttaaattcaagtcccaaaccaaaagcactccttgccctttcaagtcaaaccttcttcctcctgtgttccagctcttggtagatgacatcaatttagaaacattaaactctccttttctttctttcttgtcccttatctaaattatctaattaagttctaaatcctgtagtgcttttatagtccatttgagattttagcctaagtttgaggactagataagtgaagacagattaaaaataagacttcttttaactcagtgtcagagaattactactatgaatttctttacacaaatatacaaaaaaggcaagacatacagcatttagaaaaagactttcatacccttccatcataccagagttccattatcagcctgaagagaaccaggagagctgtcctgagagggagctttctcacaatcaggactggattgaaacaaaatagaatcaatggaaagaaagatttttggggaggggagagaagttttgcttgctgctggtcctttggtaacctctgcaaaagaaaagtttaaaaaatgaccctggctggcaagatggccgaataggaacagctcccgtctgcagctcccagcaagatcaatccagaaggcaggtgatttctgcatttccaacagaggtacctggctcatctcattgggactggttagacagtgggtgcagcccacagagggcaagccaaagcagggtggggcatcgcttcacccaggaagcacacagggttggggaattccctccgttagccgagaaagccgcgagggactgtgccatgaggttcggtgtattccagcccagatactatgcttttctcaccgtcttcacaacctgcagaccaggagattcccttgggtgcctacaccacgagggccctgggtttcaagacaaaactgggcggccgtttgggcagacactgagctagctgcaggaattatttttcataccccagtggcacctgcaatgccagtgagacagaaccactcactaccctggaatgggggctgaagccagggagccaagtggtctagctcagtggatcccacccccatggagccaagcaagctaagatccactggcttgaaatccttgctgccagcacggcagtctgaagttgacctgggaccctcaagcttggtggggggaggggtgtccaccattactgaggcttaagtaggtggttttcccctcacagtgaaaacaaagccaccaggaagttcaaactgggtggagcccaccacagttcggcaaagccactgtagaaagactgcctctctagatttctcctctctgagcagggcatctctgaaagaaagttagcagccccagtcaggtgcttatagataaaactcccatctccctgggacagagcacctgggggaaggggcagctgtgggcgcagtttcagcagacttaaacgttcccacctgccagctctgaagagagcagcagatctcccatcacagagctcgagctctcctaagggacagattgcctcctcaagtgggtccctgacccccatgcctcctcactgggagacacctcccagcaggggtcaatagacagctcatacaggagagctctgggtggcatctggtgggtgcccctctgggatgaagcttccagaggaaggaaccggtagcattgtttgctgttctgtagcctctgctggtggtacccaggcaaacagggtctggagtggatgtccagcaaactccagcagacctgcagcagagatgccagactgttagaaggaaaactaacaaacagaaaggaatagcatcaacattaacaaaaaagatgtccacacaaaaaccccatccgaagatcaccagcgtcaaagaccaaaggtagataaatccacaaagatgaggaaaaaccagcttaaaaaggctgaaattccaaaaacccgaatgtcgtttctcctccaaaaaatcacaactcctcaccagcaagggaacaaaactggatggagaatgagtttgaggaattgacagaagtaggcttcagaaggtgggtaataacgaactcctctgagctaaaggagcatgttctaacccaatgcaagggagctaagaagcttgaaaaaaggttagaagaattgctaactagaataaccagtttagagaagaacataaattacctgctggaactgaaaaacatagcacgagaagttcatgaagcatacgcaagtaccaatagctgaatcaatcaagcagaagaaaggatatcagagatgaagatcaacttaatgaaataaagcatgaagacaaggttagagaaaaaagaatgaaaaggaatgaacaaacctccaagaaatatgggactatgtgaaaagaccaaacctacgtttcattggtgtacctgaaagtgatagggagaatggaaccaagttggaaaattcttcaggatattatccaggagagcttccccagcctagcaagacaggccaacattcaaattcaggaaatacagagaacaccacaaagatgttcctcaagaagagcaaccccaagacacataatcgtcagattcaccaagattgaaatgaaggaaaaaatgttaagggcagccagagagaaaggtcaggttacccacaaagggaagtccatcagactaacaacagatctctctgcagaaaccctacaggccagaagagagtgggggccaatattcaacattcttaaagaaaagaattttcaacccagaatttcatatccagccaaactaagcttcaaaagcaaaggagaattaaaatccttgatggacaagaaaatgctgagagattttgtcaccactaggcctgccttacaacagctcctgaagaaagcactaaatatggaaaggaaaaaccggtaccagccactgcaaaaacacaccaaactgtaaagaccatcgacactatgaagaaactgcatcaactaatgggcaacattaccagctagcatcataatgacaggatcagattcacacataacagtgttaatcttaaatgtaaatgggctaaatgccccaattaaaagacacagactggaaaattggatagagtcaagacccatcagtgtgctgcatttaggagacccatctcacgtacaaagacacacataggctcaaaataaaggaatggaggaatatttaccaagcaaatggaaagcaaaaaaaaatgcaggggttgcaatcctagtctctgataaaacagattttaaaccaataaagatcaaaaaagacaatgaagggcattacgtaatggtaaagggatcaatgcaacaagaagagctaactgtcctaaatatacatgcacctaatacaggagcacccagattcataaagcgagttcttagagacctacaaagagactttgactcccacacaataatagtgggagactctaacagcccactgtcaatattagacagatcaatgagacagaaaattaacaaggatattcaggacttgaactcagccctgggaacaagtggaccaaatagacatctacagaactctccaccccaaattaacagaatatactttcttctcagcaccatatcacacttactctaaaactgaccgcataattggaagcaaatcactcctcagcaaatgtaaaagaatggaaatcataacaaacagtctctcagaccacagtgcaatcaaattagaactcaagattaagaaactcactcaaaaccacacaaccacatggaaactgaacaacctgctcctgaatgactactgggtaaacaacaaaattaaggcagaaataaataagttctttgaaaccaatgagaacaaagacataatgtaccagaatctctgggacacagctaaactaatatttagagggaaatttatagcactaaatgcccacaggagaaaacaggaaagatctaaaattgacactctaacatcacaattaaaagagctagagaagcaagagcacacaaattcaaaagctagcagaagagaagaaataactaagatcagagcagaactgaaggagatagagacatgaaaaacccttcaaaaaattgatgaatctaggagctgattttttgaaaagattaacaaagcagatagaccgctagccagactaatcaagaagaaaagagagaagaatcaaatagacacaataaaaaatgataaaggggatatcaccactgatcccacagaaatacaaactaccatcagagaatactataaacacctctatgcaaataaactagaaaatctagaagaaatggataaattcctggtcacataaaccctcccaagactaaaccaggaagaagtcaaatccctgaatagaccaataacaagttctgaaattgaggcagtagttaatagcctaccaaccaaaaaaagcccaggaccagacgaattcacagctgaattctatcagagatacaaagaggagctggtaccattccttctgaaactattccagatcatagaaaaagagggactcctccctaactctttttatgaggccagaatcatcctgataccaaaacctggcagagtcacaacaaaaaaaggagaatttaaggccaatatccctgatgaacattgatgtgaaaatcctcgataaaatactggcaaaccgaatccagcagcacagcaaaaagcttatccaccacgatcaagttggcttcatccctgggactcaatgatggttcaacatacacaaatcaataaatgtaatccattatataagcagtttagagccaatgacaaaagccacatgattatctcaatagatgcagaaaaggcctttgataaaattcaacaccgctttatgctaaaatctctcaataaactaggtattgatggaacgtatctcaaaataataagggctatttatgacaaatccacagccaataccatactgaatgggcaaatgctggacgcattccctctgaaaactagcacaagacaaggatgccttctctcaccactcctatttaacacagtattggaagttttggccagggcaatcagacaagagaaataaataaagggtattcaaataggaagagaggaagtcaaattgtctgtttgcagatgacatgattgtgtattcagaaaactccatcatctcagctcaaaatctccttaagctgataagcaacttcagcaaagtctcaggatacaaaatccatgtgcaaaaatcacaagtattcctatacaccaataacagagagccaaatcatgagtgaacttccattcataattgccataaagagaataaaatacctaggaatacaacttacaggggatgtgaaggacctcttcaaagagaactacaaaccactgctcaaggaaataagagaggacacaaacaaatggaaaaacattccatgctcatggataggaagaatcaatatcgtgaaaatggccatactgcccaaagtaatttatagattcaatgctatccccatcaagctaccattgattttcttcacagaattagaaaaaaacaattttaaatttcatatggaatcaaaaaagaacccatatagccaagacaatcctaagcctaaagaacaaagctggaggcatcacgctacctgacttcaaactatgctagaaggctactgttaccaaaacggcatggtactggtaccaaaacagatatatagaccaatggaacagaaagaggcctccaaaataacaccacacatctacaaccatctgatctttgacaaacctgacaaaaacaagaaaaggggaaaagattccctatttaataaatggtgttgggaaaactggctagccctatgcagaaaaccgaaactggaccccttccttacaccttatacaaaaattaactcaagatggattaaagacctaaatgtaagacctcaaaccataaaaaccctagaagaaaacgtaggcgataccattcaggacatagtcatgggcaaagacttcatgactaaaacaccaaaagcaatggcaaaaaacccaaaactgacaaatgggatctaattaaactaaagagcttctgcacagcaaaagaaactatcatcagagtgaacaggcaacctacagaatgggagaacatttttgcaatctattcatctaacaaagggctaatatccagaatcaacaaggaatttaaacaaatttacaagaaaaaaacaaaccccatcaaaaagtgggtgaaggataagagcagacacttctcaaaagaagacatttatgtggtcaacgaacatatgaaaaaaagctcatgatcactggtcattagagaaatgcaaatcaaaatcacaatgagataccatctcacgccagttagaatggcgatcattaaaaagttaggaaacaacagatgctggagaggatgtggagaaataggaacgcttttacactgttggtgggagtgtaaattagttcaaccattctggaagacagcgtggcaattcatcaaggatctagaaccaaaaataccatttgacccagcgatcccattactgagtacatacccaaagtattagaaatcattctactataaagacacatgcacatgtatgtttattgcagcactattcacagtggtaaagacttggaaccaagccaaatgcccatcaatgatagactggataaagaaaatgtggcatatacacaacatggaatactatgcagccattaaaaaaggatgagttcatttcctttgcaggacatgaaactggaaaccatcgttctcagtaaactaacacagaaacaggaaaccaaacactgcatgttctcactcataagtgagagttgaacaataagaacacatggacatagggaggggaatgtcacacactggggcctgttggtggctggggggctaggggagggatagcattaggagaaatacctaatgtagatgacaggttgatacgtgcagcaaaccaccatggcatgtgtatacctatgtaacaaacctgcatgttctgcacatatatcccagaacttaaaagtataataataataaaaaaaagatctaatggctaaacctatagaaactctagctagacctgtggtttctattccttcctgggtataataataaaggctcacatttattttaagtgttacatttttcattgacattgaaatgagactcccttttcgactaatcggctgctttgatttcttcaccctaaaaatcactcttcaatgttttccacaattcttcaacattagtaataacttcctatatagtatctgtggtcctttttctttccccagtgtgatatatttatcatctattacacaaacttcctcttttgcttcctcccttttcaccaccagctctaacatcttaaattttcatttgacatactgcttacctaaattatttcatgtgtgttcccatccatggaaattcatttttgtgtgacataaatccctaccctactctatttcacagtaataaaactttatactgaattgccaaagagataggtaaccaaccacgcagtttaaattaagtgcaagatacacatgtttgaatattctgctctctgtctaagatgtgtagagacaggtcctgtttgtgtctgagcattctgtcatcttattcaaactgttggagttaaatcacctaagaactgttttctcactttgattcaaaagtaacttctgctatgcaaaaaaagcacagttatgaaataatatgtgtattaaaaaatctcaaaaataatgattagagtcacattcagtctgtgaaaggagtagctccatgacttgagcacatgccaatgagattagaactcatcgggggttggcattctcattgattgttgtccctctgtaccttcaatggtttccagtccttgtccaagttaacctttgctagttgttgtagccatggtaaatatcctgtttattggattttattagcgttttaaattttgacatttggaaaagcacaatcctccttctttttcatcctgtcatctttagtgtataagtgtccaggctccttccaattttaagtttctctttcctagctttagaagattataattttggaaagtcacaattattctgctagttggtggccagaacatatcaattgcatgtaacaaaattttattcagatgcatcattcatacattttaagtctcacggtttacttctttcataattatttgacatttttggtgaaataagtttagttctgaatcacccattttgttatgttgattctccactatttttggcgatacaatagtaataatgttagacatttgtatagcagtgtaaagttttcaaagtgcttccacatacacagctcttatttgcttctctaccttaggacataagcaatgtggtgttatacccattttacagataaagaaacacaggaacagagtattactttggatcacacatggtaagcctcgaggacagaatgagctcctgtgctagtgttctttccattgcatcgtatcattagtaatgtttacttacacctacatacttactgcttttcaaatatccagacgtcatctcctctactgtaccactctattatcactcgtgtcatattctgtttttatctctttgctaaggctatacccacccttccagttccccactgccctcattagactctgagctgctcgagaaaaatgattcatccatctttgtatctctagacccaagtaagatcacaccacatttttgccaagtctctcttgtgctataaatgttcatcttctcttagttgtaaattgctttcaacccaccttttttttttttttctaacttttattttaagttcaggggtgtaagtgcaggtttgttatataggtaaacttgtgtcatgggggttgtacagattattttatcaatgaagtactaagcttagtacctattagtaatttttcctgattctctccctcctcccatactccatgctccgaaaggccccagtttgtattgttcccctctatgtgtccacgtattctcatcatttagctcccacttataagtgagaacatgcggtatttggttttctgtggttttctttggttgctgtgttagtttgcaaaggataatattaccactgaccccagagaaatacaaacaaccatcagagaatattatcaacacctctgtgcacataaactagaaaatcaacccataatttttaagtttatgttataaatattagtattatctgagaggaaggcattacatccataagcagaaaggtggaaaaatcaggagagtgagtgatttatttgagagtatctggtttgttagtgaaagagatatgaaacaaacccagggctcctcatacctaggctacatctgtaacaccaaagtccaatgtactggtaccaaacagactggcacttgtgggatgctgtgtaagcagcatggacagtattcccttatccccagtgcaggctacagttgcttaaaagaactatggaaaaccggacattttgttcccttctaatttatctgtgttcctgtagccatgtctccacttctaaacgctaatcacttctctaggtgagcttaagtacctaattattaagagccctccaaatttctagtgtcatcttcaatatagttagtgccctttctgtcccatttgccccctgtgcttggcactgaatcagtatagcaaatatccctaatgaagaatcatggtacagggttaaatttacaaattaagcaattcctttagtttttatgtcaattccttttatccttgtatccccaccctgcatttgcttaaaattcatcccactgagaagctaaaaaaacaatgctactatgacgatttaaagagaaatactgaaccctaggactttttcctgagattcttgttacctgtaaactcttgaatataggatcagattacctaggcttccagggaatagtaagaccatacattagcagatttaatattaatctctagaatcccagatttacttcttgtccaggttaaatgcccttttgattattttagcaaaaaataatacaaaaaattgattacaaccattaatggaggcttaaaatgttaactcccatagctttaacccagtatctatgattaaatgcaaaaaatctaagttaatgcaatgttaaggttgagcttctaattgcacaaaagtcatgaaatttaaaattaaggtttctagtgctactctctgtcatttctacaacattcctccaatggttttctacaatatatgtttcatttaaatgtgtgtgttgtagagttcccaggaaagaacataaagcacaacagatcaggattcaacttgtggatacctagttttacataatcaatatggctggaaaagtgtgattcttttttaaactacaatgccctatttgagtgataaccatattcctgtttacaaatttgcccatttcctctaaaaatccttgaatcttcacttctgattacacactagccatcccctagagaaggaaagagcatttatgtaataaacaaaccaaacaacctgtggactgtgatagtacctacagaccttttcttcaacatatgacaaagcatattcatgtgggattaatgttgaaagagtaactcagaatatttaggtttatgggtgcatctagcagaacaagcaaaggtgaatagggactggaatcctgttaatactattaataggactagctgaggaaactgtcatcaaattattaaacctctctgaatgttattatcagagtaagaatacctgcttgtaggattattaggaagaacgagtgaagtaatatatgtaacacatgctctttaaaactctcttggagtttatagtaatagatcaactattactattaaagaatgagtaatcataatttaatgatcatctggatgtctacaggtattttggaaatatgaaacaatgataatttaaaattcattttattgaaagatacctagaattatttttttcacaatagtttcattaagttaggtatttgtttatagcctactatggaatgcccagataacatttaatacatgatgcactgagctgcatcagctaactctgaaggcaggtgagttaaatgaattcttggatattgggctgccatgcccaatattttcttcaaattttatgaaacatttgtgtctaaatagaaaatgtgcttgagaaattctagcccaacatgcaatttagagagaaagttataaatcataaatataagagcttagagctaaagtgccacctcaaccataactataataaaaactcctaagtgcattctggcaggaataaataaaaaatggcaaagcctgttgtggacggtgcagagcccaggaaggtaaccaagtgagtaaacagctaaggcaggattatcctcatttgggaggactccattccagacaggaattaaagaggaggggctggggaagggagaatggaggttgtgggagaaagtgtttttgcatttgaaagcagctaagttaccttgtgtaatgaaaaggaaatttgtttttttcctttcaacagtaatctcatttgaggtctagcagactgctacacaaaagatacatgtgttctacctacttggtttttctcctctggcagtgaggtacacaggaagggttcaggtgaatcagaaccattcagaataacatagtcaaattcctttccaaaggtttaaatacctattctttaatagctttcttcaaaagactggtaacttactgcactgttcctggcacattcacaaccaaaatttgttcctgggagtactataatacgatgcaacaaatgggtttaaacgaaagctggaaagatctatactgaaactatgaatcacaattactgaaagcaaaaaaatctcatacacatataatatccagaaaaacatacaactgtcccttggtatcctcgagggactgattccaggaccccactgcagatactaagacttgcagatgctcaagtccctcatatgaagtggcacagtatttacatataacttatgcacatccttcccttatacttctcaccatctttaggttacctataatatctaatacaataaacactaggtaagtggttgttatagggtatttttaatttgtcttttttttggtatattgttattttttattgttttttttccaaatatttttgatgtgtggttgattaaatctacaaatgtagaacccataaatactgagggctaactgtataaccaataatttctgagtccttttgtctctccctatgttaaagcaatggtgtagatgagatttctctgaatagaggggagcagctggaccaataagctgcattatcacttagagttatcaggactatatcaactgattcaagccttagcccccatctccgacttgctgtgatatgcaccaagttgcctttcttcttggtactttcctttcttaacaacaactagtaaattgactataaaacccttggctactataaactctattagaaaactggctgtttccagcatgagccaaggactctagctttccatactcaaagatttatatttctcaagtttcttaacaacattggcatatatttattacaatacagtttatacttttaaaatcaagcaaacagttaagattttaatggtcataaaaatgaagaacgcattggctattttctgagtagtgaaaaagttctcttttataatagcttaactcaagaacttttgaagtctttttcttcaaagatttttcatacaaaaattacctttgagagtaagcatgaaaaaatctcaggaagtaggtaagtattgttaatttaaatgcctcccttttcactccaggaaacataaaaccaaatgacaaagtacagatgatttattccacaactattcattgagcacctactattctctggcactgtggtaggcagtgaacaactctgctttaacagtgagaacaacattcttatctcctgtgacccttaaggaaagactagctgtagttagacttactggatttggtcataaagataaattaaatataaagcagtgaccatttaagtttaattatgttaaagaaattttgaaacaatagcttatttaaatcatttaagtatttgtttacaaatttttaccttctttctaaaatgccaagaattgccaaccatgaaattatgaaaacaaatcaataaaaatacaatgatttgaagaacaaatctatttaagataaaaaggcacataacctaacaccaataaaattacctgtagcactcttaaaaactagatttcttctttctttctttctttctttctttctttctttctttctttctttctttctttctttctttctttctttctttttctttcactttctttcttttctttctttctttttttttttttgacagggtctcactctgttgcccaggctggagtgcagtggcatcatcttgggtcactgcagcctctgcctcctgggcccaagtgatccttccacatcagcctgtcgagtaactggaactacaggcacatgccatcactcctgcctaatttttgtatttttttgtagagatggggttttgccatgttggccagggtggtctcaaactcctgagctcaagcaatccacatgccttggcctcccaaagtgctggaattacaggtgtgcaccacaacaaatggccccaaaactaggttttcaaatatgtgagagtatctctcagctatgtcaaaaatcctatgagtcattcattcagtgtttatttaataccaaaacatggaagatagtatgtctaggaactaattttactccaacaataaatctagaagaatgagtacctatttcatgtggttatcatgaagaaactctgtcagaaaactaaaatgaaatggctcatgaagttgacatatgtatgaaaatataagaattctgctcacacctcttctttcttcctgggggcattatccatgagcatcatctctgtatatgaaggacggaaaacccgctttggatatgtatgcttctgggtagtctagtcaaaaaggaatatgaactcttttatctctgaatgcttccaaataccagagaagaatgatttatggagttctgtatatgactaaaagagctgctagtacttttagagtattcattctttctttattccttcttcagggtgatctggaaattgcccttcccaggactttctgtctctcatataaactaccatttgtataccactttttaggttgcaaaatgctttcacatgtattgtgcaatttagttaaaaggcatcagggtgcgaggatcaagaacactggctttggtaccagagacatcagtgtttaccaaagctacttactagtggtacaccattgtgtgagccacttgatcactttaagcaacaattttctcatttgtaaattagggataacaatatccaccttgcaatataaggtagagattagcaatagggcagttaaaatgttattatgattaataacccatagtagggacaccaaggacttctcaatagtctgtttctcttcatcaggctggaggagggggtcttcacagttacttatgagtacatattacaagcttctagttaaagtaatggcctcttcaaatcttagatctgaaccatcttcataaaacagttctttaattcatggccaaaaacatcgtttccatatactctcagagacagagtccttttggagcaagatataaagtttaattctaagtctttttttaaccccgaaactattttccctgaagcaatccatgtgctgccatcagattttattaggtgggctaaaatagagtcagaaggagatttctttacataatagctgtccctacagaaacttgagacagtcagcttaaaaattatttttaatgaagaatttttgagatccataagtacaggaaaaattttgatggtctttctcccttactgattcattgataattctcaaacattgggctggcacaactagagtaaatcggtacatcttacacagtggaaagcggtgggtgtagatgtttttggagccagtcagtctctggcagcggatagagtcacacttgtgctttgttgcccatttacatcttcagaaagcagcctgggtgggcatgcttatcaaatgtgctcatttaaggataaacccatttgaatattataacaacatttggcaaacttcctctaccgaatggtggacctggcccactacctctgaaaactattgcctggccaggcaacataggtcctttgactttctttacatggtagaacacatctgagaccttccaatcaaacacccaggaggagtcctgagtgctttacctgttcctcaagcattctgaaggttctagtctggactagtgggttatggatatatggatatgcagtgagtccttccttttgcaacatacaccttttttttttttttttaatccagactggagaattcaaatgccttgttaatatctagtggtcacctttggcatgaagaagtcagcaaacatttactgaaaaagttgcacgtggagaattctgtatcataattaaggagatgccctccactccctgaagatgtttataattcttgctgggaatgagggaaaaacaaaacctatacaggcaaaactgcacagcacttatagaccaacacaaaagtgtgtacacacagtgtacaaagacttaagcagagcaaatagggttaaaaaaagaatttggaagaaagtaatggatatacattttccaaggtgagagagaagaataccatagagtggagaaagcataaacaaaggcatggaaatgggaactggaaagcccaccaacttggctaacatagagaaagcagagcagtaaagagtagggggtaactacaggggcatggggatgcatgaggaaccagtttgtaaagattaccaatgctaagccaaagctcttgttcattccattccagggaaacagaagttgatggagaccttggagttgggaaagaaaaggaggccaagaaggataactggtagtagagtggccttacagctagatgaggaattcggattctagtcttcaggtagaaaagcagcagtataaaatccaaggccaagaaatgagacatagaaaattatgtgtgggagcaggtatcctagatgcttaaaaaaattgttttgtgaagatagtttgaaggaagggtggcctattcaagcggttcagaaaggagataaggggccacttggtctagtgtcagcccttgaaaataaataaaagaaagaggctgaatgaagagatattactgggtgagaactggcagaatttagtgactgactgaatggtaatgaagggcaaaagaagaaaagatttaaaaatgatcgtagtgctggggcctcaggaaagggtcctatggacagtaattgaaaaagaaaactggtggctagagcagaagatgctctggtcagtggtagagcatcccaatgattaaggggtgtatgcatgtgaatgcatgtgtgttactataggcacacagatttaggagtaatacctcctttgccctaatgttacataacagcttacaattttctttcaattgaaatctttatttcaagtatttattaagtgcatactaggtgtaaagtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactcagattagccttatggccatggtatcagaactgcaaatagttatattgtggattctttcttgtttgtgggtgacaggagaaaggaaaactcacactttttttgaacaaagcaccatgtagatatccaactgaagtgggctctgttcatcctcaattcaggtgtgatgaaaacctacagggagttgaccttcagtactgaccttttacattatctcatttctctcatgcaacttctgtctaaggatgggaagagacctaagagatctattagtctcagaattacattcatctacaggtgtgccaaaaggatatcaagttttaaaaacacaactgcactatttcttttgtttttctttttattttctttttttttttttctttttgagacagagtctcactgtgttgctcaggctggaatgcagtcgcatgatctcagctcactgcaacctctgcctcttgggttcaagtgattcttctgcctcagcctcccaagtagctgtgattacaggtgtgcatcaccatgcccaggtaatttttgtatttttagtagagacggggtttcgccatattggccaggctggtctcaaatgcctggcctcaagtgatccacctgcctcagcctcctaaagtgctgggattacatgcgtgagccaccacacttggcctatgactggactgtttcttaacattaatataaagcaaaggttgcataaacaatggatgtaggaagctcattccttcataattattaagaactgaaaaggtacattgaagaaaactagccatgaataagaaaataacttcttcacagtggttaaagagaaaaggtactgaaaaaagtaaacaaacatatgaaagcctcttaatatactaaggtattactatatatatttctgacctttggctactgagaaaatgtgaaagatgacaattctatagctattctatataacggcagatgctcctcttattccaggaaacaaaatccttttatgacatttcactaaatatctaatcaaagagtattttatgtgctcatttcagatagtctcattcacttgcccttataactttaaatgagttcttttcttaagcaggccagcttgtatattatttatgataaaatactttctttaagatggattcagtgttaattttgtactatatgacttagtacagtgggacaattacatataacacttcttctatcagccctatgtttctatgttctttattaagatattatcaaagtaatagcaaaattctgttaaatgttcaatgtatatctttactgctaattttttttcaacatggtaatattactggtaccacagtgactcctcatatcttgaatatatgcagtacaattcattctctactagcatcaatttctttttgtaaacagaaatttggctttaacacagcaatttccaccaaactatataagtgctaatgatgaccaatttaggacataaacagtttactactgtcctttgagcctctctcttttttcatttctctaatcatcacactaaggattttttttctagaaagctatgggcagagttgatttcacagagttacaagttgacctttttcttttttttttttttttgactgatgctgttaatagagttttggtgactctatcagttaagaggtataccttgtacctgacattttacttgcttgagcaactggccccaactaactgatttttaatattttgcttttctgtttcctcaattttccttccataaaatattttttctacttctatataacttcttttttatttttttgagatggagccttgctctgtggcccaggttggagtgcagtggcgcgatctcagctcactgcaagctccacctcctgggttcatgccattctcctgcctcagcctcctgagcagctgggactacaggtgcccgccaccatgcctagctaatttttttgtatttttagtagagatggggtttcaccgtgttagccaggatggtctcaatctcctgatcttgcgatccgcctgccttggcctcccaaagtgctggaattacaggcatgagccactgtgcccaccctataacttctttatttattttttcttcccttatcaaattccatctcatttttcttacgcaattaaaatatttcctcactacagtttgggtcagcggtcagtcatatttacatcactttttccatagtttggttgatgatgtgcatagagtatatgcactagccaaactgatccacattcactgtggataggctgaagtccaaattgtaagctgatttgtcaacagctttgagtaagcctgatgccagacaatattttaattcttcagtgatatttcctcttcacttatgaaggaagccttgaagatggcaagttaataagtgcattgttttaactctgtaaataatgctttttggggggttgtctttaaagattctcatttactttttataaagaaagttataatttcttattttctggttccattcttgatctctttattttccttcagtttgtggatttgctctacttttaaaaactcataacttatgagtaattttacagatcccaagatatagtttgtttgttttttgagacagggtctcactctgtcacccacgctggagtgcagtggcgtgatctctgctcactgcaacctctgcctcctgggttcaagcgattctcgtgcctcagcgtcccgagtagctgtgattacaggtatgtgccaccatgtccatctaatttttgtatttttagcagagacggggttttgccatgttggccaggcttgtgttgaactcctggccacaaaggatcggcccagctcagcctcccaaagtgctggaattatacacataagccaccacaactggccaaaataaatttttttaaagaggatactgagcatctgaaacaaggggggtttgtagactcacaaggattaaaaattatttcgattgtctttaaatcgattgttttttaatcgattaaaaatatattcgattgaatatagtgatgcatttatcagtctatcattctgtaaatagtatggaaaattctggaaaaaaattcctgttcacaataaaagagattcaatttgcgtaacgatatttactgtgtgcctactgtgtcctgtcctaagacacagtattaaagttctttcacttaaagagttcatacctagcagagggattagacaaatttatagacaattatgcaaattaagtaataagctttacaaaagaagtgcacaaaaatttattgtgggcgggtggtatatacaagtcaatgactttcgttgcatgggagagctaaagagaagtaagcaataagggcctcagaaagttagaggcatttgggatgagcctttgaggataggtaatatttgatatatggaaatgaagatagagatatacataagcaacaaagtgaagaatgatagattggaagtgggctattcaggaaaaaatgcttttctttggaaaccatggataatatttcagcttctattcttataaattagtctcagcaaagttgccacttatcatatgttcaatatgaagtattttccttgcctataagaaacactacaaggatgtgagtagaggtgaaacatagagtagacgtgtcccaattgtaccccagatgtgtttgtaaacttctaggtatggtttccaaagaaataaagctcacagaacttttattaagaacacttttatttctataaataaatggaaactcatcttcagctaaaaatatagtggcggctcacatctataatcccagcactctgggaagcccatgtggggggatcacttgaggccaggagtgtgagaccagcctggacagcatagtaagactccttctctacaaaatattattttaaaacattatttgggcatggttgctcatgtctataatctcagctactcagggggtgaggtgggaggatcatttagcccagaaggtggaggctgcagtgagtcatgatttgtcattgcactccagcctgggtgacggagcgagaccttgtctctaaacaaaacaaaacaaaacttggaaattctagatatccaggtatttattcactaccacatagcttaactgtatttccttattattttgtctctagctgaagttctctggaatggtcatgaagagagaaaacatcaaagattaggaaatctatcccaaaaagatcacaaaatcaaggacagtgacacctttttgagctttttacttgactcttcctgtttttttttttttccacttcccttagtcattcactaatcagttctgctttagaaccattaaaataatagaaaagttacagaaacttggtaaaatgtttctctggcctatttccaaaccgcccaaaattaatgggaaatggttaaagtcaaaaaagctttttctctgacatggatttctaaacaatataattatggttcactccatggttatgagctttgggagctcccacaaaaaagtctttgctgcagatgtggccactggctgctataccaggcaatttgattcatgtttgttgttgttaaaaaaatatataaaactctcttatgttggattaagaggcttttaagaggaagctagacagaaaggccaggtctctctctatttgctcattcatgacaaaggtggaagcttcaaatttgtgatacatgtgaagaaggtgtctgttacttcgtgttacatttttgccttcagaattattgttttcaatcattctattttatataaatgcacaaaaaataagtccaagctaaactagtgatgctgggtcactccaagaagtgtcctcaatatagcttcacaaatttacccttttctctccaaatccacgtttatttcttgagacagttatatgatgttttgccaagaaagcaactgggagcaatgccttatgtttaactgggcttttagatttgagaagcaatccaatccaagacttcatgataagacttccacagcaattggatattagtgacatataaggaccttaagaactccaccattttatactctatataaatgtatgatgtggtacacaaagtattaatcaatacttcatgagcatagtagctctgtttataccaatttctagcaatgtacattaggcaattttgtagaaaaaatataataattgaaagtataatttaacttccactccatgaacacttagcctcttcataccatcctcttccaagcatttctttggtccttggaaaatcagtgaaaaatctgaaaaattgggattttgtgtttgattatatgtacatttactacaagtatactgggctttccttttctgatgctatagagatgaactatagctttcctaactcagtcttattattagccaggtccagtttatattagttaaaatgaacatcataaatttacagtataacttatctggtacattccttctattgtagtttgaaaatgtgccattcaggactgaaatgacttaaacataatcagattttatttctagagaagtaaagtctatacttctataattctgtgaacccatcagcaattaactttgtcccagtagaattaatatagtgttcaagttcaggattgagtagatgagaagaggaaggaacaataaaactcattcactcccatgctaggttctgcaaaatagcttccatattcccataatgtgatatttatcttccttataatagcacatttaaagtcagtaaccctaaaaatctcctacataaaggtttgcatctttccccttaaaaatgtacagatgagcttgtgataaagagatgatgtctcctgccaaattgtaatatcatatagaccagttccaggcaaagtattgaagaagcagtcaaaacttcatatacctatctatccttgtcagcctcacgtattcatggatggggtcacagcttatccctttattctttttggttagaaagtctttccagatgaggtcatcattttcattactctgtttcttcctctctcactagagtgtctttctaaaggaaaccaaggaccacttcagtgaaatattgaaggcaggggaggccctaaatgattaaaagaaacaaagctttcccatagcacgtgtccttttctttgtaaggagatgaggtaatatataatcttcccacgttactaccacaagggcattttgtggcagggagagatggatttctgggagtgaaatccaactgcaaagcaagggctattttcagaagggcttatcttcaatatcctcatttcagaattggtctctttgctcagagcaataccttgggcaacactgagaactcccatctctaaggtaagaataaaagttatttcctcattgatggaatatctgatgaagaaaaaggaagacaaaaaacaataaattattctcataaaaggtgatgcatatgaataaatgtcaaatccttctagtatttctcatgtggcttgtacacaagacttctatttgatctttggctctgcagtttctaccactagatgacccacatgtgtaatctggataggcagctagtttgcttacatataaattaaatagcctcaagtgtcagcagatctctgtatctttttaatatcccccaaactgcttcaagtaggaacagctacaaagaaccttaccaaaggacatggaattcacacttgccaaagaaatcactgcacgtgtaaattagaaactaatcatcacttcctctctggttacagtggcagctttgcctcatagtttatgttgaaatatacatttttatgaaatatttctcactgtagtcagcatcaatttaggagtatcaaacactaattcccagctccagcataccagaaaactagagacagagaagtgcagacaaagggaattgacaaaggcctggacttttcttatacttgaagaagctaattgtatttgtaaatttctggttaaaaacctgacaattatcagatctgccactgcaaggctattcctcaatttcttcatcatatatttttccctaaagtctctcagagaagtaaagggcttctagagatgaaaatgaacttgacaatcacgttgcaactcaaactgatcttgattcttttcgtcactttttaatttattgcagatggtgtaaatgggatgtttactggttggcaggtaatgagtcttgttgtagataatagtgatggacagaatctcacgcctgtcgacatcccagcatctcagcagctatatatggttatcatccattgctttgaagcacatataatattgtgacaggatgcacaatatttcccccatagaaacgatgattggtacacctgaatctcactagttcacatgtcatttgtcctgattccatcctcactgtccacatgagtagacattctaagatgtgatctaatggaaaatgtaatctgtttaaacatccaaacactcctcttccaaggtatcaccatttatcacaactgtcagtgcccctgtggaagagtaatgaccctcaggcatgggataatgctccatagaggccttatgaatgccactgtgaaacacagaaattgaccagttttcagttgggctggtatgtgcatcatgaaagatctgcacttactcactaaattacaagtggctgtttaccctttatacaataaagtctaggttgggaagccacagaccctgctgacttcaattgtcccaaacatgtgagtactagatttggacctgcctttgaaatggacttaagcagcttgaaactggaagttggatcacagtcattcaaaaatacattgggagataacataggtgtcattgccttccacttttttgcctttttaaaaaatcctctctatcaatggaggataacaacatctcactatccactattagcaattaaaaactaaacagggtaagcatgccagtgaaaagttaactatttgtttccttcttgtaagcttcccttcatccagaagaaaatctggatctggatctgttcatatattgtttctacaaagcagaacaaaggtgaacagttatgtggtatgaactcatgattttcaggtccctcccaatgggtccatttcctcattgacgatttccttgaagtcccctgtaccttcccaatcttatctacattttctatgaagtcaccttagataataggatcacttgcactctaagactgtttacatctcagtaaatgctctatcactatgaaagtttcatctaaaacatatctattcctcagtgctcagacaccctgaagatacccttcaggatgtagcatccatatgaagtcacaaaataccagttgatcttcccgtggaaattgttttccaatctgtatgaattgaatggctcaactaaataaatgaagaaaatgaaatattttactcacagtgattcattccatattaagaaaatacactaagtaatgaatggcccctatgaaatcattacagttatgagcatcttttctacttgacagatctctgttcccctcgcagatgagttatgccaacctaactatacttttggtattcacaatattctgattattagtatctccaaagatgggacttaagacactttcctgagaagagaaatttacaattagatacatcttaacaattaataaaattaatgagataatgaaataagaagctctcagtatactgctgaggatgcagaaatctttttgagaattaggaatgttctagaagacaataaaaaagatcagattgtgaactgagcaaaacaacctttgatgtgaagtgtcagccagaaatgtcaatccaattcaagactgcatacaaaggggcactgtgtctttgagctgagaggtattatgttacctgattatcttctctggaagaatgcattatggtttagacacttttattacctgaaagatgtagacaaattagggaagattaacaaccagttttattaggaagtagcagatgagctggtgtgaatggtactggttgttatgagttctgtattctcttttcagctttgatatgctctcatgtgggaatagtcatccttgaaatttagataggataatttatattcttttccccagagaaaagacagtttgggaatgaaagggaggggaagtgtttaaaacagcacaagaacctgggataacagaagggtcagaaattctattatagaatttttcaactcccatttacaaaaatacaaccaacaataaccagttcttaagcctttatttgaataagctcagtacatttagtatttgcagtatgtttttcatatatagtacctaattgtttttggtccacagaataaggctattctatgatactatgttattatgttcatgttttcctggaaatataatttgcaaggtcattctaggaactctgattatgaaattcaacatcactttaagtcagttaccctgaactctaatgcagtttcttgtctcttcatacttaccctggagctataacctatagtcttatagaagtgcccttttcaaaaaggctcccactccttgccttctgaatgactgtctagatatattttcacctgtaattgcatactacaccaaatttgcattatatatgaatgtgattgagaaatgattaagataattgtttagtttattagtgaaaataagtggtatataagctaaaataaattattatttttacacatggcattattcctagttgtatttattatgatttaccatttactaaagtatttcagttggttgacaaggaataatagcactaaacttccttcaagcaatactggtgactcactacagccctaatgttaatacattccctcagacttaatcttttaattctattgggaaacacctataaacacaacagaattttttccttttctgatgttcattcaaattacattacctatttccaccattcagtgtagtaatttctgggaactaccttgaggggtggatggtggtaaagaatcaggacatttaaacttctattaaaaagggacagaagaagactttaggtcacctgtgatcttaggcagctttcaggaaacagaggaagcacacttgtgatgaaccttcataaaattggcccatattcccaataattcccttacctattgagattcctggttgctaaggactttatcagttacttcaacaatcctccctccccgctaataacagtacctcatttgcgaacaatactggactgtactcacaattccttttccccttcctttcagaaagaacacttttacgcccctaaatagtcctataaatggccaaagacataggacatgctacatgattcatctcatgaatcagtttctgttctcttggctgttcaacaaaagacatttcaaattctccacgaggcaatgtattacactgccatgagattaatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttctcactctacagcctatatagtctggttcctgattccttctctgaacacatcaccagtatacttttccttattcactgacctgtcataattcacatgcctagctcacttgagcctcaaggcctttgaagttgctattccaatttgcctgaaatgattttccttcacatcttcatatggctagtttctaacatcattcaggtctcaaccaaatgccatctccttacatgccatccgtgtgagattttactcttactttcttcatttcattcttcattgtgtgttagtgagtttacatgtttattaactatctcccttaactagaatgttccagaaggaaggaggactttgtgagttctgatcactattgtatttccagtgtctggaatagtaggtgctcaacaaatacttgctgagtgaatgaataaattaatgaccaaacagtaaataaatagtaaacaaggccaatatcaatgctctttattacagtagttatttaaatgtacctcaaaatgctctaaaaataaatatgtgctttccctgcacattaggattaaaagtactcattttactaattaaaagccaggacctcaatttacattaatgactggtccaagatcatatggtaaatacgtattgcacaattctggtctgaaatcttgttagcccagtcagtcctacagtgatttacttagaacacaattgtgaaccaggtataattaatctgaggtccaccaataggcttgagggggtttgtgaatcctttgaaaaggtattgcaccctcttttgggaagagggtccatagctttcatcatattatcaatggaagccataaactaaaagaggctgggaatctctttaagcaataccattctgaaacaaattattcttaacctccctaggtagattggaaggctgctggcttcaacattttctgtagagaaggaacacctatgaaaatcctatcactggctgagtagacatattttcctttccagcaccaactctggggaatggtgggcctcacaggctggctaacccttcttggagttcacgggaaaaagatgtctagttcaaagacgatgagaagggaggtatcattctaatcatgtggaaagcccactgtgcttttagtttgtgtttgtagcattcttagcttaatttcagggatgttattgtagctgtgaagattagataataataagaaaaactaattcttaggcaccagacagacaatatgaaaaaaatatataattctaaatgtaggtcaaattttatatttatcagcattgatgcagtgttgttttggtctgttcttaaatttttgttttatgaaaaacaatgaatgcaataatcttctaatacagtgattaagaaacagtgtatatttttccacatactatcaaagcagagtaaagagtgaattttgccatgggaaatagtgtattgctacagtaagtaagaatattaagtttaccaagtttttctagactgaagacttaacaataaataaggcacatcttccctgtaaggtttctcttgagtctgttacttttcagtagatgatgatgatgacagcaacagcagctaacatttgttgcttattatgtaccaggtcctgctctaagtgctttacatttattacttcacttaatcctcccagcaactatgtccatgaattaggtattattattatctattcttagagatcaggaaagtcagatgaggggttatttaacttggtaatgaggggtaaaaccaagattcatatcccacctgtctgatgccatgtccaagcctttcaccactacactttcctgtctccctctgtggtagtgcagggatactttggagatgtaacacatcttaattaaaaatactttattgctgaaaagtgctcaccaccctctgagctttcaagattaccatctgagtggtaatctttttgctggtggagggtcttgctttgatgttgatggttgctgactgatcagggtggtggtttctgaagcttggggtggctgtggtaatttcttaaaataagacaacaatgaagtttgccacatgattgactcttcttttcacaaaggatttctctgcagcaggtgatgctgtttgatagcattttacccacagtagaacttctttcaaaattggagccaatcctctcaaactctgccatcgcattatcaaatgagtttataaaacattctaaatattttggttgtcatttcaaaaaatgttcacagaatctttaccaggagtagattccatctcaagaaactcactgctttgctcacccataagaaactactctttacctgttcaagtttgataatgaaagtatgaaagtacaacaattcagttacatcttcaggcttcacttctaattctagttctcttgttattttcatcacattatgtacagttacttcttctactaaagtcttaagtgcctgaaagtcatccatgagggttggaatcaacttcttccaaatgcctgttaatatttatattttgaccttgtcccatgaatcacaaatgttctttatgacatcgagaatggtggatactttccagaaggttttcaatttactttgcctatgtcgatgatagaaatcactatctacggtagctatagccttatgaaatttattttttaaatataagacttgtaaatcaaaattaccccttgatccatgggctgctaatagatgtcgtgttagcaggcatgaaaacaacattagcctctttgtacatctccatcagagtttttcggtgaccaggtattgtcaatgagcagtagtatgttgaaagaaatctcttttttctgagtggtaggtctcaagagtgggcttaaaatattcagtaaatcatgctataaacagatatgctcttgtcctggctttattattccatttatagagctcaggcagggtagatttaacataattcctaagagccctaggattttctaaatggtaaataaacattggctcccagttaaagttacctgctgcaccagctcctaacaagacagtaagcctatcctttgatgctttgaaaccaggcattgacttctcctcaatagctataaaaaccctaaatggcatttccttccaagtagaagactatttcatctatattgagaatctgttgtttaggtcagccaccctcatcaattatcttagctagatcatccagataacttgcttctctatcagcacttgatacttcactttgcacttttatattatagagatggcttctttaattcatcttcatgaatcaatctccactggcttcaaacttttcttctaaagcttcctcacctctcttggtcttcatagaattgaggagtcagtgccttgctctggattaggctttgtcttaagggaatgttgtggctggtttgattttttttttttttttgagacggtgtcactaggctggagtgcagtggtgccatctcggctcactgcaacctccgcctcccaggttcaagcgattctcctgcctcagcctcctgagtagctggaactacagacacgtgccaccacactcagctaatttttgtatttttagtagagacggggtttcaccatgttggccaggatggtctcgatctcttgacctcatgatccacctgccttggcctccaaaagtgctgggattacaggagtgagccaccgctcctgtttgatcttttatctgcaccactaaaactttctccatatcaacaataaggttgctttgccttcttttcattagtgttttcactagagtagcacttttaatttccttaaagaacattttctttgcatttacaacttcattactgtttagtgcaaggggcttagctttcagcctttctgggccttcctcactaagcttaatcatttttagctttttatttaaagtgagagataacgtgactgttcctttcacttgaacacttagaggtcattgccgggttattaactggccttatttcaaaattatgtctcagggaacagggaagtcccaggagagggagagagatgaaggaacagctagttggtaaggcagtcagaacatataaaacatttattgattaaatttgtcatcttatatgggtgtggtttgtggcacctcaaaacaatcagaatagaaacatcaaagatcactaatcacaaatcactcaaacaaatataataatgattaaaaagtttaaaatattgccaagaaccaccaaaatgtgacacagagacatgaagtgagcacatgctgttggaaaaaatggtgccaacagactcaatacagggttgccacaaactttcaatttgcaaaaaatgtaatgtctggaaagtgcaataaagtaaagtgcaatagaaagaggtatgcttctatatcctattttcaatacaaagatgctgggtagccaatttctaccactgtctttgtctatttgacaaaactttcccatgacttttatactgttaacttttttgaatagcagatgagacacatacttgcatcctcaaatctgcaaagacaccttgggccagtttgaaccgaatcccatttttaactgaaaatgatgaaaataaggtacattattagcctgaactttgcataactctaaaatgtattaatcttcggtaaaaattttaatcttagttttagaatcctcatgaagtacttagaatgtttaaatgagataacactgggtatattaaacattatgaaattgccatttctgtagcttaaaaatggtcaattgttgccacagtcaagtgattaaacctaaggtaagtaatcaacttaccttattaagttaactgctattgttgtaagataaattattctcactctacaatcctccctccctgaaaacttttctagtctggaatgtactgctgataactagtgctagggacatagggttgaacttgcccatgattttaatttgtaatacataggcttttaaaattcatatcatagcaggtatacctccaaatgatgccacaaagacagcctagaaaatgggccttagaagattaagttaataaaggcttattatttttcctatagctggatgtactcttaactagataactttcaatagaaatcaagttcatgaagcaggttcatgggaactgtattagtttcctatcgctgctgtaacaaattagcacaaacttatagttctggaggtcagaaagtcctaaaatcatggtatcagcagagttatgtttttttctggagtctttaagagaaaatccctttccttgagttttccagttattagaggccacctgtattcattggctcatgatctattcctccctcttcaaaaccagcaacgcagcatctttcaatctctctctctctctgacctctgcttccatcaccacatctcctctgtgatcctcctgcctgcctctttcctttaaacggcccttataatcatattaggcctaaccagataatctggcataatcttcccatctcaaaaatccttaatttagtcacatctgtaaagtctctttgccatctaaggcaacatactcacaggttctgaggattaggatgtgaacatcttcggtggggtggggaggggggcattaatctgtctgtcacagagaccgaaatattctaggtacccaaatttcaaatagcaagcaagatggtatcttatttctttaaacctcatagcatggtaagctgcacagacatttttacatataccctcataatttttaaggagattgtgatgtacaactctccagtttctcttctggcacaagtgtgtggaaatcatggtcttagctttggtttgtagaaccagattttactcctttacccagttttagtcaatcccatttatatttaaatttgtcctttttgagcattcatactgctatccttagccaaagaattattagtacagtaagtgctttctgcacttccttctcctaactctaggaataaaaggcacacgtgtttagctgagaaccaaccaggacagaattctagcacttctcattacatctttcttgtgctcttccttcaggcactacattgacatctcaataagcaaataacaccagcgttgcaggtgttaacaccaatgactataccatgagaaattcccttatgtcacgccttgcatgggtaaagttaactcaaatgtcttccttctcttacctaaaatatctgcttgcctgacctacatctcccttgtccattgtttccaatgaacactaacccttaaacatttaagcctcatcagcacatgcccatcataacagcataacatccttgtcctgctggaaactattcagcatccagaggaccatctttatgctgataacactaaaatataaaataatgccaacagctggtgctacaaatggcttttaaaaacgatgttcattcactaaaattcctcttgctacttttgacatgaaacacgcagtctctaattattctgatcaagacggtgaaatacaaaaacaaactttaattgtgtttaacagatatttaatcaggactcactgaactacagattaaagctgaaattcataaaccataattacccgattgtcgcaatcttttggtccacattctccttccgtctgggcgtctggcaccttgccccgaatttcttttactgtcttctcagcttcattactgttcatgttttccagcagagatttagcacagattacaaaatatctgttcttggcaactttcttcattagctttttctccccccttgcaaaaagtttattttcttttttctaccagagtagctggaacaggcatacgtttagggtgctttgatgacacaaactaattatatagttatcaggagataatacggtagcgataactaaagttactacagttatcatgtaggtatcatgcaatttctccagtataccatgcggtgtgtcccagtcaccacgtaattacctaatgtcactactgcattgtttcatggaaaatgcttatctcaccccaacaaaaccttttctgccacatttagagaaaaaaaaagaagtgaaattcttagttctcatatccagtactgctcattcccagtaagatgttgtcatgcaaatgtaagggaaacacctgccctctcctgaaaatttgctcttacagggagcaaatggagcaattattattattattttttcctgcttcactctttccaggtaaaagaagtaattaccaacaatacatacattttttctttttttttctttttttaaaagaaaccaatccccctaccgacccccgaaagaaacaccctatttacttaggattcgtttagtctggcacttcccccctatactctttcctttcaaatttcagtcactcacatttgtttttcctagaattatggtgtaaatcattcttaacaagctaacttgaaacttctctcactcagtagaaacacaaaatgccactgtaattgaaacacggaagcttgaaactctttctaaccagttcttttgggccactcttcagaagggcatgccgagtttccctcacagtgcggtaacccctgggtcacacagcgaggataacatcacagaccaaggcaagaggataaagagaaggcactggctaaagaagaggtgggtggttcctttattccccccagttgggcagtcaaccctatgaagcaaggactgtagttgctacttatttatctcaagttgatggcttgaagtctgacctcactaagacctttagatgtgacataccacctgagagttccagtttaaaacaggatgtagcagcttcctttgcagcacaagttgaaagctatttccaattctgcttttattagtcacctcccaatctaagagctgcccattcaattgtacacttaactcatgtcggggtaaaaagcacctccagatttagaagggccagaaaaattgctatcctatcctagcacattgttcttcaatcacacagttcctctaaatacagttgacagcctttgagatgcaaaatgtatcactttaatgtagtagaggtccccttcactgcattgccaaatctatttagcagaatcttcttggaataatctgtccctagacctgaggatgcacagtgatttcaagcattttaagctaatgataatggttagtgctgagaacagatgtacctggctgtgatgtgatctattccagtaggcttttatgagctgttcattcctattgacttagcattttatgtctgtgcttttgcctggtgtgatggttgcataggggtgtcatgtgtgtattttcctgatgtgtgatggctgcacagggggctgtgtgtattttctcagtgcaatggccacacagggtgttatgtgtgtgtttgcctggagttatagctgcacatgttattgtgtgacttttctctctatttgatgcttgctcgcagggtcctatgtgtatctttttcttagtgtgatggttgcactcaatgctgtgctaatgatggacatttctagcaattatctatctacagggtcctcgggaaaaaaattgcagtgaaatcaataaacagtgctagacaggcccttgtaaatatgaaatgacaccatgcataaatgccgtttcctactatagcatgttaaaatccaaattctgttatgttattggcattgggataaaatttctatggtccctccatctccttcatatattgcaatcttttgggggaagttgagattactgctggttggagggcttttacacatgcatctatgtaatactactttttgctacattgtcctacacatcatctcttatactccattctgacttatcctggcataatagctgatattctaaaagtgaatatgcctttcatttattccttcagtctcaccaagccctcccccatataacccctacatcacacatacaaaaccccctcgcttgcctccctctctctagtttctccgtatccctcctgtgttcaccaaacggaactgacaaaggaaacaaccaatgaggttaaaatcttttgaaacccctggaatacagatgagctgggaggcatctggaaacaaaaccagacacttgaaatcaaagagacaagtaaattactatcctaatctaggaagaataactaaaggtgtcagtggggttccattgatagcacttggctctgggccagaatgccaagggttcaaactccacaccagctttgggctcaggcccaagacttgctactgcagggtgcagcagcatgtgcagcagtgttaaaggtgtcagccttctgcagagaggttaagtccaagtccttctgcctgtttgtcattacaccccagagagacggagagataaccctagctttctcttcgctgcctttctcaatagaacaggctgaggaggaactagtgctcagcagcagtacttgctagtatgagtactatacaactaattagtaaaattcccctctactgataaggctgcttgaagtatgcgcaagaaaatccactgtccctctccccccacgaaaaacctgatgtttgtcctaaagattcttccatcaatgcaaagagctaagtttggaaacctaaaaccatgtgtctaaaagaaagaaaatgttttcattggaacagcttacatgtctggtacacttgcataaaaactatcgcatagcattttagagctaaaattgctataaaatgcttaatacagtaagagtaattatgagattttgcatgcacagctggtatacaactagagtctcagccacatattcaatggagcatgggaaaaccatttataaaaattcctggtatgccagtttaactcaccatcaacagcctatcaacacttcattctttaagtggatagggaagatatttacctaccaaatgctttatttcttctctcatggatgttatcaatacttgattcaaggaatttgagttattacttagagagtataaatataagctgttaacaggacatgaatgacctgaatgcaagccttctccactgagtgaagaagttacaatgatagtagtaagtaatgaaccagaagaccaaatcattaaatctacttgtatcttccctttttaacctccgctttttgctatatcttcacatattcttatctctcttcatttctctaagattcaaatcctcgggtgagttcctgggtactctggactcccctgccatagcccacctggccttgccttcccctgagtaacaccctgaagacagagctcttcgtttacattttcccccaatcaagttataacaggtatttgttctccattccctttagttccagctacatcacttgaaaagaaactgatttgggtgagttgttaatggttaataataatttaataaagtttatttcttgatgaaaacattgattttaagagtcaaatgaagaacctctttattgtggtcttttaggctctatggaaaatgccataataggtgagatgattctaatcagaagcattgatggatgctccattgcacattttttagccataggagccagtggatagatgggaattcccaggtggacaggaagtttggggtcacaaaggcagcatgacacaatacaaaatgaatttgaacagaatcaggaaactcaagttttaggaccaacaaactttgccacgaagtgtttggcagacattcagtttcttaacctgagaaatgaggcaggccctgggatcagaaactctccatgatcctctctggctcttacattctatgactctctgaccgcagatcagtcaggtctcctggattagctaccacctccagttaagaactaatagttctgaataaagatggcggtcattccacactgagccaacctaactaaagaggtgttgatgtccataggtgagttttacctgtctgcctacaacctgcatacactacttttgagttggctcctttatgctatacagatatttcttagcattttgttttccctcatttacttaattcagcaaacatttaatgagcactttctatacatgaaacacagagtcgatcactaaggacaggactgaacagggcaccatctctgttgcacagatgattttattattcttgtccattctctctctctctccccaccttcacttttatgcataaacacatacttctagaactataaaagtagtatagaaaaaataagaggaattagacttatctgagccagtctgaaatactgtttattttaaacaaaagaatatgataataatttgtgttggcaaaatatatgcattcaattacgcacttcaatagtataaagggtatttctcaacatgtattttgaggtcagtaatttgcaataaggataacaatttgggggaaagaagattataaaggtaaaacattcccttctgtagaatcctgataaagtcctaggataaaatctgtgacttgtgtaaataacctctgggaaagtgagatcatagaattttttttttaagtttttgtttttcctctaaggattttgggttcatatccctccaaattttatttcctgacttaaaaataataactgccacttattgagtaaatattaaattccatgcacttcaaatacattatttttataaatacagtatgaaatacaatatattaatatattgtataatacaatatgatatattataatacattgtaaatattaaattcaatatattattaaagcaactctgctagatagatattattactctaacagacatgaaaactgtgggtcagagagctgaagtaacttgtcaaagataattcagacagtgtgcagagttagaatttaaactcaggtctgtatttgtctatgcaatatggctccataaccatttcttggttctgctgaatctaactttattttaaaaatgaataatcttgcttgaatgctttgttagcaaataaggaaagcaccctttttactcttccttcacattcattcattgcattacatatagtacaatgaaaacaggagatggttaagattttttcaatgcagatctggttgccttttcatattgatttggactgagataattaaatttgggctctcaatcaaagtgaaagaataagctatttgctatctgaataagtatttcttattaattgatcagacatggataaggtgtgttattacaactatatttgtaaggtatgatttatgttgttctactgcatattactctgtgctgtttttcattttcttgcactttggactttttgttttgtttttatgaatttagtcacagttggttgtgtgttgaactttgtaaaaatgtaatactaaggaaattaaaaaaagaaagaaaatattttcaaaatgatgtcaaaatcaaatctacccctcactaatttgatttgtaggaaatggagaacaaagtattagaagcagaatgcttttaaataatcctaattacttcaatgtgcaaatgcattgactaaatcgaagcatgcgtttaacactttgcacttcaattgtgcttattcatctaagttctatagatagcaattctataaaaaacaagagatatagccagccattccatagttattgggggaaaactattgttctaaaattcaagcttacctctcaagtcagcccacttttggactaacgcagatcattaggtcaaagaactcaaaataacataatttactgtaactactcaggttttcccaattgactctgccttccctattctttttttctgccttcagcggggtggggtgaggacgtggaggaaggaaagcttctgttaacaaagccacagagtggaagcagcaaggcttttggtagtcaagccacacagcattaagcagggccaatcttaaggaataatgccatggggttagagtggtttgtgatcaaggctgagatggagtcatgatggcagggtaacttagtacctggtctaggaccagctgcatcagaaccacctgctgagcatgttaaaaagacacatttcagggtctcactccagagcaaaccaacagaattagtatctcttgaggtggaactcagatctccattttaaacaggctccccaagtaattcttatgctacttaagcctgaaagcactggcatatgcacttaagctctctaattctatatccagcgacagccctgctgctacacctgtatactctgtcccagtcttcaagacatatgtgcaagtccaactacttgtcctgggaggcattaatgctaataataatggcccaagggcttagctaggcatgatgttatttgacatgcagtatctcatccaatccccacagcaaactacgagacaaagatgattactattctcatctttcagatgagaaaactgaaattcagagagacttagtaacttgttctgggtgccacaataataactgaaagagctctgaagaactatactactgtactttaactcagccctgcagaaaaatatcttgaaagatgtttacttctaaaggtgttcataacttggtgatatcattattccaaagaaacttgcctagatgctagtaagatagattatggaataacacacaaagtgtaagcatttctacccaaggaacttttccttagattatttcatagagacttaaactctcaaaaactaggctaagaatccttcattagttcgttcaacaattatgcactttgccagaacctgaggtatacaaagataaacaggacatagtctctgccttcactagacttacagttctgaaaaagagacaagcttgtgtacaaatggttctgggttaacttatacagtcagtggaggcctgagggagagagagtagttcattctcctggcagaaggaaaagagggtgaggtctgtaaagttttagttactccagcactatgccattggctaatgtaaggaacttagattttaaagattatatttttacttgtacagttttgttactaaaggggcagactaagttacttgtatatttcgagccaataaaactttatctggttcattctctctggcatcaaactggttttcttttttgggtaaatttctgggtacagagccaagtaagttgttatgtttattcattcttacacagagcaaccgagattctattcttgaaatgagtgcctaataaattttatcagtagtactttattccacccaataaaagtggttcttccttgacatactgtgtcctttattttcacttgtttcaattactcagaatgctattattagatttgcatattttcataagagaaatttagaaattacaaatgattgaaaacaaagaacaatctagattctttcctttgtgataagagaggatgatcccatatacatgtaaatgtgctttgagtatgttaatcttagaaatgactgaagaaaatgacattctaaagaaaatgagggccaggcatagtggctcacgcctgtaattccagcactttgggaggttgaggcaggtggatcccctgagctcaggagttcgagaccaccctaggcaacatggtgaaaccctgtctctactaaaatacaaaaaagtagctgggcttggtggcacgcccctgtagtcccagctactcgggaggctgtggcacaagaattgcttgagcctgggaggtgtaggttgcagtgagccaagatctgacacttcattccagcttgggctacagagtgagactccaacaaaaaagaaaaaaaaaaaaagaaagaaagacagaaagaaagatgaaagaaagaaaagaaagaaacagagagagagaaagagagaaagggaaaagaaagaggaaaaaaagaaaaaagagaaaaaggaaaaagaaaaaagaaaagaaaagaaaagaaaaaaatgaggttctggaacatcgaagttcaggctaatcacttaaggcaaaggtacaaggatccaaaaaagaaaaagaaattatgaaatatgatatgattcagtttggggaaactgaaaatctatgtatcccatattttagtaactgaataaattggaatcatacatgtattcttttctaagttgaattattaccaaatttgagattcagtgtttagattatttactgcttgcttaaaacttttatttttcaaattatcagagtatttttcaagcattaagaaagttcaataaaaaggcaatagaaatatcaagtaattccaccatacagagataactcctctttacatttgaatgtattctcttacatcattatcgaatactttcatttttatatttgggattgttttaggtatatatatttatttgtatcttttggaccaggaatttttagttgtgttattttataaacttttcctaataaaatattgtttaaaataactttaagaactatctaatttgcatatatgatatgtggtgatacatatggatattcaataatttaataatttctcgaattttgtaatttaagattttaaaatcttttttctcttttataaatgacattgtgataaacacctctgtacctaaatctttgtctgagattctatttcctctagacagatgcctagaagtaaaattaatgggtcagaggacatatttttaaagcaaggttctggataacataatgctacattactttgcagaattttgtgtcaatatatagatatccactatcactatgagtgtctatttcactgtaccattaccagcactgaaaattactatttttcataaatcatgactttgaatcctagtgaattatactttttcatgtttattagatatttgtatttcctttcataatttttctctttatattctttttagccattctatttgactgaacatatatctcaatatcttcatatctgttgcttcaacttcatttctgattgtaacaccatagtctgagctctccttaccttgctctgaatgatggcatcatgtctgcctggtctgtattccaggtttctttgattctgatttattctgcacactgatgccgaacagttattttgaaaatatgctttcatcatgtcagtcctgatcaagaacctatgacagctcctggttatttatctatcagctacattcaactgcctcattcaggggaaaattcatcccattcttggatattcccttatgagttctgttgaataatttaggttattgctatatggaccctatatgcacttacgtttttataagtgggtatttctatataaagacagggagacacaatgtggagtactagaatacaagaactggaaagggctttaaagtacatcaaaaccaactgtctacatttataaataaaaaaaagtggcctacagagtttaatgaactacccatggtcatggagccaattaaatgacagaactaggactagaaactaagttgcattattctcttttagtgacttttagatagagaataataaaagtcatttttacaatttaaaaaatagaaacagctaggaaggcagtttaatttcaatctgttgttatgtataaaagattgttaaaatcatgccacatagaaggcttgagtgttcttttaacatgaataatatgtacttcttataaatcaatcaaatgtatcattagaatttccataaaatttgcacatctgcaaatgacctagtttatttatactttgctttttcccttgctaatctatattgttttatttaatctgctttgccacaataaaagcacagtattttttatcctagcatattgcagattttcactaagtttcttaatcatatcaataaaaaatccaattttcccagcaaattcatataaaagatttcttttgactatagttagggatttgaagaactacctttaaaaaataaaaaaaaaaaaaataggaactacttcaaaatgcctctatttaaatagtaaacaacacgaactattgtggaagaatgtgggctgtcatccatttaatatgatatgatgattgctatatatattcaagaatcccactgtatttgccaaatgaaaacttaacggtagtcactggtttagaaacgagagttaccaaatatatttattatttgtggaagaggggtagggcataagaggtaaatgtggaaatagccatgaatggacctaactttgatagaagctcactgatttcaaagggctgattaacaaagcatgtgtttgcctaacaaaataattgacagaaaaggtatttattaaatcataaggtgattcaactgtttataaaatacaaggtttaaacaaaatggtagttcatcagcagcaatgagagctcagctatgttttctttctccgtgtgtgcatgtgtgtaaccaaacaggtccaccattcacttaacactcaaccaatatttattaagcacctactttgtgctagaaaccctctactatccaaaataagtaaccctgttattttgttacagaatactcgactactctggactgctgtaaaataaaaattaataataatttagccgggcgtggtggctcacgcctgtaatcccagcactttgggaggccaaggcgggcagatcatgaggtcaggagatcgagaccatcctggctaacacagtgaaaccccgtctctactaaaaatacaaaaagaaattagccaggcgtggtggcgggcgcctgtagtcccagctactcgggaggctgaggcaggagaacggcgtgaacccgggaggcggagcttgcagtgagtcgagatcgcgccgctgcactccagcctgggtgacagagcaagactccgtctcaaaaaaaaaaaaaaaaaaaaaaaaaaaaaaaaaaaaaaaaaaaaaaatgtatacctgatataaggtgttataacaaaaataataaattgagtgataagaggagacagatgaaacagcatcctaaatttctcatttcatgtaggatactacttcattaatgacaataattaaacaggcttgaatgtttttcagaaaaacaacagtgattattaccgaaagaataaactgtactttaaaacttcaaattgctagattgataaaagctaaaaaggtaatcacacatcaaaaaagacagagagtgagagtgagaaagtgagtgagaatagaccaagcaagcataaaaacatagaaaatataaaaaagatttatgagatagtactagatatattttttataaaacgaatattagttaatttaattaacattaaaaataataaccataataatgttaaaagataacaaaacataatttaaccataggatagcagtttaaggacactagctttggtagcaaaaacaggattcaaatattatttctgctatttacttgttataatctctttcctactggtgtatttatttagactatttacctcaactttctgctctaaaaaatggaaataagaataactgaacgtagaaaggattgggaaaaaataatatgtaatgcttagtgaccagcacaactaaacattcaataactgtaatttgtaatattatgtgttttaaatgatgtatctaactatgtacccatataaatttaaaaaaaaagaaaaaaatagaaaaatggtgctgatagattttctcaatgcagagttgccacaagccttcagtttgtgaaaaactcaatatctgcgaagtgcaataaagcaaagcacaataaaaataatataaaaaacataataaagagagataagaatcaaaggagtattgtccaagatgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaatattcatataagaatgaagctgaaagctaccattgtaagatctggattgggactgagaagatccagataaaggcaactgtaaaacccctagttagggacatgtgaacaaaacgaaacaaacaaaacaaaacctgtaaaacaaaattctaaagcataaccaagtaatggtaagaaaatcaataattgtaacattcactccagataaatttgattttatgaaattatctgacaatgacctcagcatgaatatgcttgagatgcttagtgataaagtactcatacctaaaaaagaacaagaaatgattaaagatagaaataaaataagaataggtgaataagagtaaaacttaatcagaaatcttaaaaaattaaaaatgttcattaatataaaagtacaataaatgaaataaaggaatttcaaggaaagaattgagtgtattggaaggtaatgttaaggaattcactcagaaaaaaattgtagcaagaagaattaattttttgaaaatgaaatagcaattgagatactaatcagtaagctgattagaaaataccaatgtttatcttataagaattccagaaaaagaaaatggaagtaatgacaaaggaacaataaagaaaaggataatagctgagaattttccaaaactggagtcctgagattaataagtatatcctgagttcatgactaataattcaaaataaatccacgtccagacacatttcagagaaactacaagatatttaggatatagaataacttttaaaagctaccaggagaaaaagcagattatttataaagagataaaaacagattgatagatttctcttaattaagaatagttgacagaacaatagtctaagatataattgagtaatgtctttaaaatactcaacaaaaaatacccagataaattgctatttaagataaaaaacaaaataagtacatttttagttatatgaaatatatgtattacccaaggtcctcattaaataattactaaaaaaaagtaacaagaaaagtgcacccagaaaggaagccacaggatctaagaataatggtaggcatagtaatatctaaaaatattagtaaatataattaagcattgattatagacaacagtgatcaccacttttgaatatggttaaaaacaaataggtaaaactaaaacttcatacacaattatagtaacaagattgatacttaataggtaattaaaagatgctatgttaaccaccttttttatactaagaagaaggtcagaaatactaaaaggtcgattttatattttcttagaaaaatacacagttcagtatacacaaaagaattttagaattagtgctaaagaaacagataaaccacctacagatttcaagccagaagtaaaatccatgtaccagataaaatcacaaaataagctaaaaaaagtttttcaattaaaaccacataaaacacatcattttattttaatgcgtttaaattcagaaataaataataaaaatagagcaaatatgtttacaaagtaaaagcatacccttctaaatacctcaagggctaaaaataaaacagatattatgaaatatttaaaattgaacaaaactacgtatcaaaacatggtatgcacctaatgagaaaccaggagaaaaatttagagtctgaaattcatttttaaagataataaaaattattgaaagtaaaagggtaataattcaattcaagaatctagaaaaagaaaaatggcctaaaaatataaaaaaaaagaaggaatgaaataacgctaatgctgataaaagcagaaagtaatgatttagactacaaataaataataaagtagataagcagaatcaaaagccagtttttgtaaagaagtaaatgaaacagaaaaatgtctagtgtctaataaaaaaaagcagaagggtcaaataaatattaggaataagaggggaacataaggacaaaaaattaaaaatcataagaatatataaataactttgtacaaataaattgaagtataaactgtgaactgtatttaaaaaaaataacttcccaaaattgactagagaagaatcagaaatttcctctgtggttattggtttattctgatattcaagtctgcctacctacaacctactgatgaaaattaccaagttcagatgacaaatactcagaataaaaaatcccaataatgtgaaaactgtttaagatatagaaaaaaatgaaatgttactcagcttattttgtgaggccagtattgtcacagcaaaactctatagtaacagttaagaaaataaaatttaaagattgatctccccatgtaaacatactacatgtcagtaaattaaactcaatagtagattaaaaaatacaccaagagcaagaatattttttccaagaatataagaactgtttaatatcaggaaatgtattaatatcttataaaatattaacatagtagtggaaaattttatcatattattgatgcagaaaatgcattagataaaatttaactagtatttctgattaaaaacacttagtaaactataaatagtttaggaacatattaagaacttccttaatacaataatttcgatttctcaaaatcccaagcaaatgttatgtttctaaaacatttccattaaaataagaaacagaatagatattcttaatgtgactatcctattcacactatactgaggtttagtaatgcaatatgacaggaaaaaattgaacatttaagaattagaatttaagagaatgactgtcattatttactgctgacatacatgttgctgtagaaaacttaagagaatttaccagtttagttattcaaagtagtaagagagctcagcaaagttgctgaatatataacaataataaccaataaacaatgaaatggaaaacagatatgaatataataatgtaagaatctaagttatatgaggaacaattttacaaaataggttcaagaaatttatgatggaaattttaaaacatgattataggatatgaagatgatcacaaatagagggatatagtatgtcactgggcagcaagacacattataaaaatgtcaattctccccagattattttctaatgttaatgtaattacaaataaaattcagcaagacttttgccaaacttgaccaactagccctaaaactcatattgaatagcaaaagaccaagggagctaaaagaatcttaaaaaggaacaaggtagagagacttatcttaccaagtaaaaagaatattataaagctatggtaattaagggttatggtgttagtacaaggatagaaaaacagtccatcggatcaaataaagatcatataaacagatttgatataggcaaaagatggcattataaattagttaataaagaatgactaattttttaaataatgctgggataactgggttatccatatggaaaaagaataaaatagggtgcatgtagggtaccagaaccaaaaataattccagaaggattagagatctaaatgtaaatgggaaatctttaaaactgttagaagaaaatacagaaaggtaaatgaccttggcatgtgaaaggatttcttaaatgacataaaagcacaaattatgaaggaaaatatcaataagcctagttgagttaatattaaaagctttataaaaacaaatactactaaagccacagttaaaagggcacctacaaattgggaaaaaatctttgtaatctctatggcccaaaatatgaaaatccagaatattacaacaacagcaacaactaataccaaaaaccaaatcaagccaaacaaaactcttccaaaataacaacagcacaacaaataacccaacagaaagatggacaaaagatgcaaattaggcaacacagaagagaaaatcccaatggcttacaactaaaaaaaaaaaaaaagttaatgagatattattcaattccgatcagactgacaaaaattttaaaaagtctgaccatcacaaatgttgtgaagcatgtggagaagctctcatagattgttactgagaatataaattggtacaaatacattggagggaggttttacaatacctagtaaagttcaaaatgcatatttcttaaagtttagcatttctacttctatgtatatatgtctataaaaatgttaactgtggtcttgtttgtgattgggaaacaattaaaataatgtccaacaatgagagaattgataaataaattttagtaatacatacagaagaatacatttcatataaaccaaaatatatagcttatgtaaaactaattcatgatgatagaggttacagtggttttgcttgttctttaccttttgttaaaactttggaaaatttcaccttcaaggggcacatacaaaggattcttcttaggtattataaatattctgcaccttgggttgggtgttgtcacatgtatactcatcaaggtatacacttaatttgtctaattcactgtatgtaacctataataaaataataaaaaataggttcagaaacaaatgttccaaattattaaacttcgtttaacctgggttctggattcttgtatttcatattatcctttatacttccatgtgttttaatttttttttttttttaaagacagagtctcactctgtccaccaggctggagtgcaatggtgccatctcagcccactacaacctccgcctcctgggtacaagcaattctcctgcctcagcctcccgagtagcttacaggcacgtgccatcatgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatcaccaagaacgttacagtatgacctacttaagtgaatacttattaaagaaacagattcatttaaaaaacatgtttttaggtaaataggaacggtgcaagtgtttctttgaaatcttacaaaagataaaaattaattgaactaactaaggttccttaccctatgcaaataagaaacggcttagaaagaaatgtcttcaaactgttgaaatgtatattccttagttggtgtaaccaatgtgaggtctcagttactataatagcaaatgttctattagatttaagcacatcagtgcaaattattaaaatgagactgtctttgtttaaaataaagctttaaaaaatgtaatgtaatctctgagggagtattgcctgaaatgaaagttttaggccgagctctgccacaatcctattgcgcatcttggttcatctgattaaacatctttgggtctcaaaattcacatacattcacatttctaaagtgagtgtgatataaagtcatagcttgatcatcaaactcctttctagccctaaaattctacgtatctaatgagattaatttatcatgaggtgtttttcttctttcctttgttaatttccttacaataaatagacaaataaatgatcaaataagcaaataaataaatattaaaaagacatacacacactgatagctatccatctgaataggaagaaagacttttttttgtttgccattatctatcccctaatgtgtatttaaaaagagagctcccacagaaaagatttttatttttttctaaatcaaaaatagtgtatcatttatttgccatttaagttctactaagaaggaaaacacaaaatcattatggaaatcctattaggaactttagaaagaaaaagctgatgaaattccatttacaattcaaattgttcattcacgtatttccttttgcagaaactttaaatgctgcctcaaactatcttcacctctttttccagggacaatatccctaactctgttaaaaaaaaaaaaaggctctcttctcacacccttcccacctgtcctctgaggtagttgttccacaaagctaaggtatagattacatcaagagatatttgggatgggagtaaaacatttcaccctggagacagtaatgtgtgcaatttgccaagtctaaaagaaagttaagcctcatcaccactttggcaagaaatgtggttctcatggatggacaatgattatcatttttacacagaacttttgaaaatgaaagtacctggggcaccagccagaaaataagtacgagaatgcaagttttttgcgtcaatatttaaatcagacaaaacactatcagtgtacccttaacagacctgaagcgtctagaaagaatacaaggcagctgacaccttggtgaataagagcagctcagttttatgaaaaggccaaagtcttagggcaaactctctgttgttccaagtgctgatatacctatggcatcaacaaaggcaaaacaccatagggggcaataggcaaggcttctcttacaggcaaggctcctgttaaaggctgggaccctctggactacacactcgaggaaccccaagtgtgggtccctgaggggaggaagtttcctcaaacagaacggcgagaggctgaagttacacagtgtaggagtactccctgctggcagctgaggttggaaatgaactggtgatgtcctagagagggctgcttaaattttctatgaggaggctaatggagataacagtgctcttgaggggacaagagcatgggtctgattaggtttagataactccagatattatgctgagtgaggaggaggttaagggaagctactgatgacaggaactccaacaattgacaaaaactatgtgtagagctggtatatacaattttcatttaagtttcccatctcatatcattctataaagcatacacagccgtatgtgcacatgtgtgtggggttcagaggatgcaggaagaaatctatttctgtgcagttcattttacccctgcaagaacaatctttgaaaccgtctaatgtattcacatttatgttttacaaggaatcccttccatacttctaatggacctgcctggtatgccccctgtaccactatacctaatccctaggcaggtggtctttgtatgggcctggggcaaccacactggtttctccccagtgctctgctctgttagggttcttctgcataataaaatgaaggtcaaaatggcagcctgctaaaagcagcagtatttcagttgcaggaataacttgcttgtcatcaacttgttaatgcaatagtcaaacatttctctgacatgtacagtatcagctaacttcagcagataaagggtctagaacaggaagatgctgcagatgctttagctcggaggaaggcttagcagagccaaaacgtcagcagggcctgtttgttccatactttccatcgggctctgtgaaagaaatgttagattactgcaatgacaagtttgtgacaagcaagtcatttgtgcaactggtgcgctcctgtttttatctgtttaccattcagacttgtgaatgccatttcaagcacttagaggatttctggctcccattaaggggaaatggttcctccatgtttagaattttctacctcaaagagaattactaagcaattatttgttcctgtggtcagtgtcacacaaaagcactcttgagttgtttagctggactctgaatcatgaaatgaagtcctgaagactggatagcttggagcatcaaaaatttcccatctagtttattggaatgactacaaagcaagcctgtgagagacaataaaattatggccagcttgaaataccttgcccttttgctctgggatcatatatcaaggccatatgcttcaagccacataaactcacttgtaacaagtagatcctgagaagctaaggcctggcgatgtcacactgacatgtgatttagcatatgactgttttggtgacaaggaccactttagctgttgagaagagaatttccactgacttctctctataccttgtgggtaactatagggtcaatactaatccagagaacattttaactgtggtaaaataaagtaatataatatcaaattaataactagggccatcctcactaggctgactttttaatagtgaatggagaccctggcagatttgagatcaagaattcaagatcctctcattaggtccttcacctgaagttgctgagtttcttcaagtcattttaacctcctgggacgaaggtagaaaataacagcacatgttcctttccatctgacataaatggtctcagggtcaatattacaaaagatgaagagtgccttcagactcaagaacaagaatgatactctctaaacatcatttattctttctacaattttacatttttgcccattgttggtactgaatttatacataactctaggtataactcccttttttttttttttttttttttttgagatgaagtctcactcttgtcacccaggctggagtgcaatggtgtgatcttggctcacggcaacctccatctcccgggttcaagcgattctcctgcctcagcctcctgagcagctgggactacaggcacccaccaccacacccggctaatttttgtatttttagtagagacggggtttcaccatgttggacaggctggtctcgaactcctgactacaggtgatctgcccacctcggcctctcaaagtgctgggattacaggtgtgagccaccgtgcctggcccaattctaggtataactcttaaagaacataacagaatgaggctttgaagcagacacagatgtacactatctggggaagcaagtcaaagccggaacaggtggaatgtcaaggactagacaaaagtaatgatgtaaagtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatattttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcggacagctttcttaccatgacaaggatcactgaaacagtctcaacttcaaactttgcacagaatgtatcctttgttcggtcttctgctttgtttctctttaatgatagctttgccatgagtcccattcgtatgtaactcagagctatgcaaatcaagctggtaagcaagcatttgcagttactcagtcttaaaatgaatatgtgtccaaccagtggaaacctgagtgaggaatgtctcctgaacattatgtgtggaatggctcctttccttgatgggtggcaaataataaactcagtgagatctgcattatattccctggtctcttttagtgtatgctcagagtgggtcacaagagtggttttagcttatgtaaaattttttcttatagtatttccaattttttttaacttcttgatgtctcccaaacacagaattcttaatagctactgaaaaatccccatgcctgaagaatcctaagatcccagggcaaaaatatggtaaagaacattaaacaacccatggtctgggtcttaatctggtgctcacagtgatcattcagtctctgctgcataccaccagggcacggaactctccactgtaggatacttctttctgttctgttcttccttatgctgaatcttaatccatattagtctgttctcatgctgctatgaagaaatacccaagactgggtaatttataaagaaaagaagtttatatgactcagtttcgcatggctggggaagcctcaggaaacttacaatcatagcagaaggcacctcttcaccgggcaacaggagagagaatgagtgctgagcaaagggggaaaagccccttataaaaccatcagatctcatgagaactcactcaccatcacgagaaaatcatgggagtaactgcttccatgattcaattacttctcaccaggtccctcccacgacacatgaagattatgggaactacaattcaagatgagatttgggtgaggacacagccaaaccatatcataatctatctttctaaaatccccccagtgcgtctagttctttctcaccctaaatttcagttcagagcttcagaaaattattagtttaatgactcatttaatgacaacccttgtgtgtattacataccaacaactgggtttagattgtcctgccttgtccctttctcctcacccaacatgatttaaattcccactctatccctctgacaagccggggagaaataaaagccagtcacacccatttctcatttccatttggatgcaggtagtactggtggcaaagcattcttaatctctttgattttctgtcctattctgtggaaaatctttcctgacaacctcaggcatctttgattgatatggctatttatagattgaccatttaatttattgtccaagcagggacacttttgacagtgaaagggccttataaataattataccaagactacagacttaaacaagaactttcccaggcaaacttacataacaccttgcatatacttttacttcaatacccatctttttgcataaaaactttcatgtctatttttcccaccaacctgtgaacactctttagcaacagaaacatatttttacctatgcagcttcagttcctagaaaagtgcttgtaagtataaagacctgggggtaaatatgtactgacgcacatgcatatgcctatatgcatgtgtatgtgtttgaattgatggtatatttttccataattacattctgtggacctctccccttatttcatagcaaataccaccaacacatgttaacttcatatttttggagatgaatcaaaaatatttcacttaatgccataggaaggaaatggtctgagtatattggtaatgggtttgcttttaatattgacagcaacaaacagaaagtgaaatgtgataaattttccactaaaagtctactgcatatttttttaacaaagcactgaacaataagctttaatcgctttcttcacaagtattataaattgtttcaggccgtgtgcgaaggctcacgcttgtaatcccagcattttgggagggcgaggcgggcggatcacctgaggtcaggagtttgagaccaagaacggccaacatggtgaaaccccgtctctactaaaaatacaaaaattagccagtcatgatggtgggcacctgttatcccagcaggaggctgaggcaagtgaatcgcttgaacttgggaggcggaggttgcagtgaagctgagatggtgccactgcactccagcctgcagcctgggcgaaagactgagactccgtctcaaaaaataaaaataaataaataaatttatttattaatttatttaataaaaaataaaaataaataaaaaataaacaaaaataaaaataaataaataaataaaaatttcagcagctgtatccacaatttcaagtttgtagtaaatgagttattataggaaatgatggtaatttaagagtgatcctttaatctccattaaaatgttggtggcatttctattgctttcaccctcgtcaagcacatttggaagtcctggtaacttttggcagtttttttgcttctgagtaactgtggctttaagaaaaagaaaggtaaggagaaagtgcctggaaaatgtgaaccacttagagaagtcatttcttcccttctcgctgacacatgcagaccattccagaaagatatgactctatactggttaaagagcttcatagaggataatctcacaacttccctttcagtgtttagcactcactattaataacctatctcattatcaaaccttaagattttctgttgcagcatattttgtcattatcagacctcagtgaagaaaagagagaaagccttgtttcccacttctcatcacttgcttaacagctactattagcgctctaccttaacattcctttttccaagataaaaaaagtcaatgtttttgactcttccttgagaatttttttccaaaatgttaaatttaaatttgtttggaggggtttgataattctgtctctctaagatgtttgtattcagtattatctgaaatcagaacaagcatgaataagtatgtaatctatgctcataagaaatcagagaaatatctatatttggcatgcttcttatacattccactattatagctattttaaaatttcagtttgacatttcacactcttgataaactttctataatctacttctagatgctatttttcccacagaggaagtcattctttattttcagtccatcaatgacatttaccaaaccatcacggataatgaaaaatataagacttataagattcaaaagaaacaaagttacatgtctattatttcagagtcttaaatatgtggaaaaaagaagacaatcccacacaaaagaagaaacatggataagcatgctcaggtgtttggtgctagctcaccagctattagtataggtgaactaatacagctatatggaattctctatacaagtgatgaagaagtagtggatgaaatgccacttttgaggtctgctttctctcctgaagaaaactaacaataacttttatttaacaacgttttgtttattcccagttttactgagtgttcatttcagtcctccctctgaagtggttagttatacttatctctcaaattgttgttatttggacactgtacgtaaaagcattgcactttgaaagcatgcatttcttgtcctcaacatctaaaataatgatttgcaaccatttagaagttctggtatcctgttgttaatgtgatttttgcatcactcttccttgcctattccttaaaatataattttaaatgaaaattaatttcattttgaggttttgaaatgcctctaacaataatttagaatacactgaatttgccaatattggaaaacatgtatgtagtctagattatcaagccagaatccaggaccgacctcaatagcatgtcacttctatatctctcaatactgagtctcatctcctactaatcatttcctgagaattctgaagtgctggccacaaaataaataggttagaattttttattttttggtcatttgagacagaattaaaggctctgctggttacgtggagttatatcataatactagctttgccttagttcagcaaaacttacattgggctaagaaagaagataatatattatcaaggcgttgtgtcctggtatcatcaaacgatgggcaaatcgatttcattaggtctctcctaggatatttcgtggaataaaagttagagttctatgtctataacttgcaggatagaattattaaaaatggttgtatttaagtgcattttcccaaatagtgagtttccttttggcagaaaagagacaatgaaggtaaatgtgaaagtatcatcaaccacaaactagtaagctgaactcaagtataatggcaatcttcctgggtgatcagccatagagcaccatttgtgcaagagtctgaatttctatactaacttacttttaaatttcgttgaatacaaacataacaatgtttttaataagtggcttatctattaagtttatagagaaccttccactaaagagattacttattctaatctattcttttgtccaatcttttccccatttttgcccagtgttttgtttatataatattttattctataaaaatctatattatacattttctacctgccttgtctattcttatacattcacaatctattctactcttagtatataatttgaacagattcacatacataaatcaacattcattacttctgggcatataaatggttgctgggtccatgacggctgtttaaataggtagcttccaggccactatgacatagggaaaaactgaaaagtgtatgttttataattattgagtaaaagaggattttcattatggagacatgtacagctatctcaaaggcttatttttccaaaaggaacaacgacactgtcccctgggatatgtgaattgaaaattcagtgtcaacctcttctaaaaaagtagatattttgaggtattaaaaagcgttcttttattagtgataacacctcttacttggggtcgttttgagatgaaagttggcaagtagatttttcaataaggcggggtgggaatcactataaattcataaactaaaaagaagaatgacaatttattggcccaaaaataggggagagggagagatttttttgttcttttttcttttctttttttttttttttttgagacggagtgtcgctcttgtggcccaggctggagtgcaatggcgtgatctcggctcaccgcaatctctgcctctggggtttaagcgattctcttgcctcagcctcctgagtagctgggattacaggcatgcgccaccacacatggctaattttgtatttttagtagagacagggtttgtccacgttggtcaggctggtctcgatctctcgacctctggtgatccacccaccttggcctcccaaagtgctgggattacaggtgtgagccactgcgcctggcctaggagattttggaataaaggtgtctctgtgactaaaaacatataactggtcatagatagtctgtttacctctagtgtcttttggagcaagggtgtgggtctctctgttgagtggtgcctatcattaggcatcacagcaacatcaacaaaactcatctccgtaatatagtagattttacattgtgttaaggtagaccttttaaacaactccttcaagttttctgttgatttcctgccagacagtcagacagctacttcttttttagtaggagtagtcaaggctaaagtcaatacatgtgccttccttgctgagttagaatcaggcatattccatcaacacatatgtcccactgttctcatttctctcactttactatgtgattagtagacaaagtatatactaaagaaagctgaggaagttgctaggatttctaaagaagaagaatccaaatcttgcctactttaggcaaaaaacattttagtattaattgaaaagagatggttaaattgcaacccataaattaaaatgtagttccaaagtgtgtctatagtgatctacaagcaaacataatttctcatattctttttttttttttttttttgagatagagtcttgctctgtcaccaggctggagtgcagtggtgcgatctcagctcactgcaacctccgccgcccgggttcaagtgattcccctgcctcagcctcccatgtagctgggattacaggcacatgtcactacaccgggctaattttttgtattttagtagagacggggtttcactatgttggccaagatggtctcgatctcctgaccttgtgatccgcccacctcggcctcccaatatattattaaaatatattctgcaggctaattctatgttcttatctcattcctgtttcttcctctgctccagaaaggattagtgtctagcataaaacaaacagtatataataaagaacagataatgtatagtcataaaattctgaatccacagcaaaaagagggtaaggtcttagtctagcaggtaagtcttattgacaataataaaggcatgtttctaagccacccatggaaaataccaaaaatgttctctattatatcttgaggtgaagttttggccgtgtaaaaaattatggttaatgctgtgtatgttatgttttatttgccttcattctgggaccacaaaaacggatctaactatagataggggcaggagagcatttgtgtttcttcattagaagctgtgcatgttagtctaatgtataagaattaggaaaacaatactaaatctcttgatgcaggccatgtcataaatccatttatacttatataatattttcctttttcttattctttcaaccttcatgcttcttttttcatttaaaaaactttggggtcagcccttatattaccagatgatttctagtagttgaagcccttgggaaattcatttgtccatccatgctgcctagtttagtacaacactccaaagggaacttccttctaccaaaggcaatgactgattggacttaaaaaataacttctataaatatgacataatatctggaggccacatttatagctggtcaaatgcactgttagccctacaaaaggctggctcataattatgaggcaataacatgtaaatttccctttctgatgagaaactaaaggtcacataggtcctgagttgtattaagactgcattaatactgttcgttagacatttcttttctcagtctcaacaagtcaccttaaaatctatggtatatagcagatcctgagcacctacatgaaaagcaagtactcaaatgttagagacctgaattgaaatcaagattgagatccatccaacttaggagttactgctggttcaatgagtccagggaagaggccatttaatgattcctccaaggaccattaagagttccagggtattcccttggatatctggaaacctgggttacttgatctgagcatgactaaaaactgggcaaagtcttgcatgcttatcctaggttggacacagatctctaagataagactggtatttggtaagctctcatctttcccattccttcctttagagttcatattcctgatgtattcttgtcacaagatacggtcaaggttacacatgggttaagagctcacagcagtccaataacaaacatgttgctgtaatactggtctcccttgtagaccttgaaagtccaatatgctatcatctagggcagttcatgggaaagttgacataataatgcttcaattattcaatttataaatgggacatttaactgatagagtagggaggacaactgagaaacgtttgaagatgtaaatagtttttgtttcagagaacaaccttatctctccaacacagtaatattttttctttgtgtagccaaatttctctaacacgaggctcacacagaagctatagagacttcacctagaaggtctcaatggccttagagccatatatatatttctactataaaacagcaacaacaattttggcccaaatatcataacctaagcaaaaatacaaacaaaatcaaacaaacgaaaactacctagaatataatcttaaaaagtactgcctatatgccatcaccatgtatactataaaacccaccaaacttagaatgcacaatgatgtcatttacttcaatttttataatactgctttttgaagattcctatttttatacgtaatgggaaacatgacatcatataaatgaggcaggcaaacagaaaggtgtagaaggcaaatgcaagatgcctatatattgtctaccaagtgttgccagttgtgaaaggatttgacatgctaatatccattcattcactaagagcatgatggctggcaggctctgcatttaagtgcggttatcgaggcccccaaatattgacagagtgccagattctaagaaactattgatgtacacagccggccacagctccagacacctctcagacagagtctttaaatgtcacagataaatgaattttcatgaaactgagagagaggaagagcaagaggagagaaagaacacagaatgagaggcaggaaagaaacaagaaagaagaaaatcacttccataacactgacatgaaagcatgtggcatctcatctctaaagctcaatcataactccttacacaggatgtgagatcaagccttctgaatgcattgcattaccaaagcactcaaacacttttaatcatttcattgcatggtattttaaaagttaagggagatacatgttacagaatagcttcaacaaactatttctgagcaaaatacagttcaaatataaatacttcccgactcaatcctaaagcaaattaaaaaaatatatatatatataaaggcccacaggcacagataagcattggagccttctaagcagttctccatatgcataaaaggtgaaaagtcaaggtgtcatgaaatctattttatgccaagacacaaatgtgtcctctgacattttcttctccacagtcctactgaaagtagtgacccctagtgggtttattgcacgatattaagggatgccttcttccttcacctctcttttcctgcctttccacagaaaacatctgccaggaaaatatacgagtcagttacttgacacatgataacaaaagtgagccatggttataactagaacgaccaagtattccttagaaatcatgtgtaactcaatatattttaaacgtaaaggaagcttttttactttgaaagttttccatctgctgagggcagcttctcttgaccttgatacactgtgccattgaaagcagtcacactttcaaggttagaatatggcttgtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccctgtctttaaaggcttttattttgaagacaaaatcagttttaactcaaatggaaattgcagtaaaatctcagacactgtaatcagtgactgcattaaaactctcaagaaggaagccaacttccatgtgaggccacaattcagccaggatcacaaagagacattatccactttgcctgtggccattctgtcattttagactgtaaaatttttatactgtaaaattaaggttcaaggaaatcttctctaactttcacatacatacacataaatatactgatttttgcctgtaaccatataataagcagagaggttttggcttactttagacataggtatagaagacacttaataaagattattaaaatttccttcattatataagtaatagtgttcaccaaatattcagtgattggttaacacaaactgtgttatacaccctacagaaaatactgtaaagttgctaaaaaaaaaaatagacttaaatgtgctatatgacaggatatgacattatatatgctcaatccctcttgtataaagaaaattagtatacatatatacacatatttatgatagataggcatatacacaaacattttcttctggaagtatatgtaagatacttttgatgtatttggggaaaataagatggagaattttacttctaattacatatttttctattctgtttgaattcttcaaacatgtttaaaatataatgccaatagggatatccgagtggtaaggttatgaggaatttttttctcttcatttttttatatactggaaaatttaatatatcatatttcaaaacggaagcatcttcaaaataattatgtaatagtaattcatgttagttacaagaaacttgaaaacactaaaaaagcatgaagtatatcaacaaacagccttgtaattctctgacccaacaataaccactgtcgaatttttgctgcgttgtgtccagtttgcaaagtctcttctgctttgtacagtgtaagtaagaaagatcctttacattcccttaacggggggggacccaaaacagctttatgtgtcatttgttctgctatataccttcttagacaccttcaccaccacaccgtttttagttgccaggacattgttgaaatagcatgctatatgtgacacctccctaaattacacaggttctttattcatctgctattgccccctgaaaaacatgatctctgtgctatttcataatagtacatggcatttcatgatggaagccatggagttgaaggcaacagtggcctcatgctccacaattattatagtatacatactgaaatagtttcgtgaggactcagaaatgttcttctcttctgaatgcacagagatgcttccctgtaaggagctctgtcttagaacttcttcaaagcctaataaagttgaaggaaaaacacagaaaggtgatatacttggtgtgatattttaagcaactgacctattaattataataccttttgatattttctttgctgaggatcattttctgaagaagggtatgaaccttctctttcatgcaaaataccttggtataactgttcatcttttaagtatcttatttgccttttggcaaattaaagaattttcctacctttgttgttgctgttattgaaaagaagataataatgacaataataatttttatagctaactcttattggttgctttctataggttgggcagtttacttacattatttgcatttaattccaaaaatacctctattattattgttgctgttattcccattttatagatgagaaaacccaggcatagaaatgttgaaaaacttgcccaatgtcacaaatctactaagaagtagacgaagaaatctacatcagactcattccaaatcttccttaagattattatctagattagggttacatgactgtactaagaggtccaaaccatgtccagagctttcttatttttctaatactatggggggtgaaggggagtgggaagagaaagagagcgagcgagcacataagattccaaataaaatgttataaaatttatctaagacttcattttcctcacctctaaaatggacagcacccatcacagaggtttatcttgaggaccagttgagataatataagtgaaagcatctagtacaactaaaataaaacaccattattgctctacaagtttccttcctttgcataatggatatgttctggataaggtgattatgaaaaggtataggcttaacttctgttgtcaaatcaaagagcaattacactataaaatctcagagaaggattcccaacagattgagatgaagacctgatgtaaggcaggggttcaggtggaggctgggtctacagatttactgggagcactctgtgggttggtaacacattctagatcctcttacctctctctcctcaggctccttggtctgaaaattcctgagtgtactacagcagtttccagagatgattgctttctttttcttttatctggttacaaagtctagtggaatttatttgcaatgatgatacttcacttgaaggccttatcccacacattatgatataaaatagttagaaattcctttaatgtgagattctcaatcagataaattcactgtgctctatttactctggatgtttggttacaggtttccatcatattattaataatacttgcattaacttcctcatattcattacattgaaaggctctgagttagaaaatatgtattctactttcttggaaaccctacactcactagtgaggcctataaataaaatgaaactttaaatagtacgaacttcaccttcaactcataactaaacccaactctgggcttaaagtgctattttctccctccagtctcatcagatataagtatatcatgttactaactgaggccaagctatatatttacacaattcacttcatactaacaacctgctgcattttgttgcttgccttttcttgaggtactgggacttactcttaaattaatgccttagtttttttttttttctctagggacatccttttacttatggaaaatattcagaaagaatggaatttttaaaataagccatctgctgcgcagacctcaagaaaaacagttatgtttgaaaataccagattcaactaatgaggggcacaaaagccttattaactgtgttagctttcttatctttagagctcaggtaggaagtaagagccgacctcagcatgccaacaggtatcaagtgagagaggtcagcacagtctacacccttatgatatagcttgaacacatcagctcagaagtactcttcataaattctaaaaagagaccttcttccagattatctcgcacatggcagcagcctgggagtccttaagacaaaactctctagttctagaacaattcaaacaaggtgcatttacattatatttaatattttgctgtaagcagacgatagaatctactcaaaactatctctatttcactgtttgcccatattcccatatccgtcctttatttctcagcttatatctttcttgaatttctaaagataagaaatctaatttattcatgtattcattatacaataaatattaagtatctcagaaaagggcaaataaatagatgatagatgattaatagatagctaaatatatagacagataatagataaatagctagataaaacagagatgagttatggcctaaagaaatggctaaggaagaagattgcatattgaggatgttttaaactaggtattgaaggatacttgggatttcaaagtatagagagcaaggagaaatcatttcgagcagaataaactgcatgaacaaaaaggtcatcacacgttgggaaaagcagattatttggtttgtgaaagagagtagtaaaaataaaactgagaaggtaaattagggttagatcacatgagagttcgagtgccaaccaaggaatattactctgtcaataatctaggtttgaggaaagcacagtcaacaactctctagctttcataatttaagtaatgagtattataatccaccaaacctctggtctttaggctccacaggggatacgttagatcagtggtagagaaaaggtcctcatatttaatgagtcctcctccagctgagattatcatgctgcatctattgaagttaatcatctcacatgatttgaacaagaatctcactagttcctaatcacactagcattggcccttcattctcaataacaagttctatagagttacctaaaggctgacactgaggctggctgagatgagagcggtgagtatcccaagcacatgtgagatgtctgtagaaagtttgacataagctgtcatttgattttgaataaagccaaattgttcataagtgattggttacttatatatgtctagttcaggttctccctatgatacagaaagtcattatagtatacgtggaactctgagatctccttacacatcttttaaggctcactcctaactgtttaggattctttgatagaaggtgtttcccagcaccttctgttatgctccctctttattgttctctagtggacttactgacttctgatatgctttgtttttatgtatgtatttgtttactttctgcctctcctctccaaatgttaggtctttgaaaacaaggattatttgaatgtgcctgttttgctcactgttgtatctccagcatgtagaagagatacctattgaaagactgcttttgaaactgaagacaaaatatagaggaaggtaagcacatattaactggtatatgggggaaaaaaggcttctgtataaaactccccccaaaaactcatatgctatataatttgaaaatatcatcagctaattatgtcacggacgaattttctataaaactcaaagcacttttaaattaaaagtatgtattttttcttcctgttactgaagtaacaatctcattctctctattttatacaaagggaaatcatggcagagagagagatactctggagtacagcagatgaattcagagcttctgactctaagggccatctatattctatgcactatttaatgttagtttatattttactaccagtgagatttaagtgctgaattgaatagagtcctagaatttgtaccaataaataatgttattaacttatgctctttctgctagcacatggccttctcacagatataagcaaacaaataaataaagagcaacacagaaagaggaaaggtgaataacttaaaggggtgaacatggttgttcttatttttaaaatccagattgttcattttcgttgtaattgtattgtattctactggcagaaagagatgagatttagtgtactatgcaaattatagtaggtccaccacagcttatcaagttctgagaacagtatggtttctttttcctcagatcctcttttacccttaaaatatcttctggattaaaattctcattcaatgaaccacatctttcaatataaaaaatgaaattataaaagtactaaaagaaaacattagtaaatttctttataatcttggcataagaaaggactttttacctataactcattatctagaagctacatagaaaagattagtaaatctgattatatttacaaacaaacttcagtatggccaaaaaatccataagtaatttttaaaagtgggaaaaacttatgcagctcacatagataaaaggattatcatcttaatgtataaatagcaagaaatacataagagaaagactaacaacccaatagaaagaaaaggctaaggagatgaacagacaccttatggaaaaataaacgctaatgacattaaacatattaaaaaagatggttgacatcacttataattttaaaaatgcaaactaaaactataccgagataccgtcttttaccaatacaattggcaaaaatccaaaagcttaaccaagcactattttatagttgaggcttgggtaaaaaggtacttttatatatgccaatggagctgctaattgatccaactcctgtcgagatcaatttggcaaaacttttcaaaattcaagatgcatataaccctttgatcaataattttatttctgagaatttatcctgcagataaacttgcacatctatgaaatgatttatatataaggttgttcactgtaatattgtttgaaatgaaaaaaattgtttatcaatcgggactgaataaaccatgatgcatttatataatggaatactgcaaaactataaaagagattaaggcagttctctatgtatcaatagcaaaagacctctaagagatactggagaatacaagattgagaacagtgtataaagtggtttaacttttgtgtaagaaggtggaaggagggaatatatattcactttttttgcataaaaagaccactggaaagttacacaaaaaaaataatgaataaaagtggttactaatgggaatagaaagagaaaaaggtggatggggagaagtgaagacgtttttacatagttttgatttttgaaccctggaaatatatagcctgcctcttcaaatatatttaaaatatatgtaaaatatatttaaacaaatatatttaaaaactaaatgaaagataatctcatattaaagtaaaaatgagaacagcatagcaatgataaaaatggttcctgagctccataaatttctcccaacttttagctaccggtgcagccaatatctgggtaaacgtggtaaaaaaaacttggcagtttggtccaaatggcgtctttggagcaaaaaatgattcaggttcttccctttgactttgtagcattcttcagatgttattaaacagttattcctttctaagctcaatcgagttaccagtaaaatataaaatgacattagtgttgcagctgtgaactagttgggatgaatccctttaaaagcctaggatgatttccatgtgttgagtggagaagacctggatgtttgcttgttgctacgtaataagaacaaaacacatttcttgaggaattttaatgtgtaaaattgtttttaaaaataagtaaaatctatttattaattatataatatttatcaatcttctataatacttaggcgatgtactcagtatgcataacattcttaacaggaggcagaatacatcattaggcagatgatgtatgttgagtacttagaagttcctaaaggagaagcctataaagacagtgcattataattaataataaatgtaatagtataatttttttgtaaaataagcaacacatttatccactagtcagaaattatagcttcaattcaataagctgctttctcatgtttgtattgagaatgccatctagaacaatctagaagccacagacaagagcaggggtgaaagctcctaaatttcctatttccgttgtcccatgactttttggtaaaaagataatcagtgaattacccattttgtgtaagaatttcttcctctgggttctgttcttattttaggcaatgattttaaaacatggaggtaggtaagtagggagtattcattcaatcattcatttgtattaattaaacaccaagtatgttctgtgtatttcgctaacattagaaatgcagagacaaaagacataatttttgcccccaaatatttcaatctagtggggagaaaggaaagtaaataaccaactaattataacacagggtgaataacctgctgtaattgacttaagcataaatagctgtgagagaacagaggcgtgggactctgacttttaatgaggaggctcaataacaagttttgaggagtgggtgccttagctgaaacttaaaggatggaagaagttaacaaggcaaagatttgagaggatagaaagggattctaggtataggtaacagaaaaaaaaaagtacagagcaagacagaatatgatccattcatgaactgcaggtggttccagacagaggatagagtgatggttgggaatgccaagaaatgagttttcaggcccatccagattgtgatggaagcactactttagataaggtgataagggaaggcggagatctgaatgaacagaaagagacagccatgaagagcttggtgagaacaacgttcccagcagagaactgtacttattgcacatatatgcctattttaaggaatggttaaagagctaggggaactgattcctggttgtcagagatgagcagcactattccaaatactcttcccctgacaattatctaatctcttttgttgtctctggaagcatggttctttcccatcaatgaattcattcagtccctgtaatcaactctgattagtgttgtttaacatcaatcttttctactttttttcaaagaaagataccaatcagttgctgcacacccctgcttgttaaaagcagcacctctcctgctgacttaccgttcttttaatcaaaagggcaggaggaagcagttgggattcacttttctttttttttctttcaaagtacacaaatgtcaacttccttaaggatgtctggcatagctgagttcagtcatgtaacatacaaagtcagcttgatcaaaaggttgcaggctgcccactgctaaaatggaagagaaaaggaaaccatgggcttccctgaagtgtgaatgagtgcataggccactgccacgtgtgtatttatactgaagacatgctgggctgacaagggagattaggaaacataaatccccaccactacactgctctatcttcacctttgaacctctggagcagcactttctctctttcctatttcttctgttgtgcccagtgaaggagttactatatagctttatagcaactgcaagccatggctatttttgaatatttaaaaaaaacatttttgcggccaggcactgtgcctcactcttgtaatcccagcattttaggaggttgaggcgggtggatcacttgaggtcaggagttcgaggccagccttgctaacatggtgaaactccgtctttactaaaaaaatacaaaaattaactgggcgtggtggtgggcacctgtagtcccagctacttgggaggctgaggcaggagaatagcttgaacccaggaggcacaggttgcagtgagccgagatcacgccactgcactccagcctcagtgacacagtgagactcaatctcaaataaataaataaataaataaatgaataaattcttttgccccaacatttagttgaagtttataattctcaatttgcaatatgaggttataattcacaatatgcaatatgaggttataataatctcaatatgcaatatgaggttataatcatttctatggatttaaaagtgttaataactagaaaaagcataaaactgttcattcattttttttttttttttgagacagagttttgctcttgttgcccaggttggagtgcaatggcatgatctcggctcactgcaacctccgcctcctgggttcaagcgattctcctgcctcaggctcccaaatagctgggattacaggcatgcacccccaacgccgggctaattttgtatttttagtagagacagcgtttctccatgtttgtcaggctggtctcgaactcccgacctcaggtgatccacccgcctcggcctcccaaagtgctgggattacaggtgtgagccatcacgcccagcctcattctcttactcttttaataaatcagtatgtatcatgtgacaaacctgtatctgccaatatgacaaacccttgtcaataattctcctggaagatgcttctggcaacccagaaccagaaaataatttttccaaagagttgattatcttagactaaactaatgactcaagttggttttacaaatagggaacactctgtaaatactcatggacatatctaaacctgaacatacattctcatgaagcacaaaaatcatcatatatggttacagtccccaaacaaggctgcagaagaatttaacattcgtaacaatgtacagctagtataattacattttgtgcaacctcgtaattctttaacagtacaactgaagtgatgagaaggtacatactgatataaggtaacatagctctgtgttctagccaaaactagaactcaggatccattatttttaatctaggaacttttatgtgatgaccatttactaggaagggttgggagtaaaaagcataaggcaattgatatagagaaacaaggatgctttaaaaaaacaaaaacaccagtctaaaagaagactattctttactcacttgaaatggctctgaattcctgggaagagcataggaagaaatgtaactataggatcacttttatatgagtaaattaataaatcatttcccctatgttctctaagaaatcttttagaacaatatttcccaaacttccctaatcataccaattgactagtttcttgtttcagatccaaatgccaaggccccttcgtgaaaatttcttattctctaggtttatggtagactcaggaatgtgcatatttcaagggtgaccctgatgattcttagttcagggatgtttgggaaacactgttctggagaaaactttgtacaatagctaaacatttcttcattcctaatgaatcatcccattttaatgtttctgtggtgtgtcttaagcaggtgcagactctcatagcaaaccataaactcctatgttcctttaaaatagcttaagatacatttactcagttttcaggattagcaaaaagtcaaatagggctgttaactagcccattcccacagaagcaccaacctgtaattcccaagtatcaattctaatgtgttcaaaaataaaagcatatgcttagtcatgtaacagagggtttctttttttacttttatttcattgtctgtcaatctggttgatcagattactaatttctactctactggaagtgatctttagaaaaacaggtctgccatgtttgcattacagagatattaacaataataatgatttttaaaaagtaaaccaaacataaataaacaggaaaagaaaccaccatatttgagtccagtctttgtcctgcctagtgaaacatctgtcttatacctttttgacaggcagaaataagacctttcacatcgcctcatctctctgataaatcagtctatttccttacaaatttggtctgagacaaaactcttctgctcttccacttaccatttagaaaggcacagtcagaaacaccatctaagatgagctcacttctgggtgtctttcagttagacttctattaaatggataacaagaaaactaaccaagaaacaaaaatattcctgtcacttcttttgcaacaattccacaatcttgaggaaaattgaattttgaagaaaagaatggtctatgccatcttacaagcatgagatggaggagcaatgactataaagaatattcgttaattttggttgtactgtagttatattacaaattgcacaattaattcccactatcaaattacactggtaaacaggcctagattaaaaacacaagcctgctctgcttgttttgctctgttatacacaaagtaatcttaaattcagtttattatcattagtatggtttcactttgggggaaaaaaactctttttcctcataaggcatattgcatattgagatgatgaagaccaaagtcaatgctgtagagagttgtagggatataactgctgctaaaataagcacttggtttagtagactatttcccttagacgcttggagcacaataattttttcctgctgggagacaatgtatatcctgaatggggtagggcctgaaagacagtgaaatacagccggaaatacacctgatggcagaatccaccaggatcagacagcatcaggacagcattaaacacagtgtttgaagatagcagaggtatgtggactctcaaggaacactgaaagattacagattgtaggtgagcatggttttgagagtctatctctgctagccacaagaaaattagcagtcaacatttgcaaggtctgtttaattatgtcagtgaccagagctagcctcccaggttaagtgagaacgagaactaacaagctgcccctagcctccttcaggacttaaatgataaagccatggcaatcacagcagcagcagcagcagcaaaagcagcaacagcagcagctgaagcagcaacagcagcagcaagaacatggttttgacccgcagttcttgcccatcaaagagctgtgccctgtctgctcccactgacaggcagataaatacagagatctgttggcaagtacatatttatgtgtatctacagttccctcacacagacttacagagaatgcataacagcttctagtggtataacaaatgcacccactaatggggtgagacccattactcacaaatgggtgaaaagaagcatcaatatgcaggtcttaaccccagtttgtgggcagaaacctgtcattccattgcaggccgataggtctcctattcacacagtccttgtttaattttccaaacaccctttctctaaatggtgctactctgagctgtgtagtgcagacagacaggtttgacaagcagagctgtcaatttcacatttttcatcccaactgcagggcaaaattaggccttgtacgtaactggggttgactggttaggaaggcaggagaggttggcatttaagaggtattttccacattagaaactcagaactcaagatagaaaactcaaaaagggttgtccctattcaacatccatgaaatcaggagagtccaaagatgtgtactggtggtctactgtggggcatatacattttgctgaaacgagaagatgaagggaaaagtaaagcttggtcctatctagaaggagctatgggtaagtaagtagtgaaagacactcactcaaataccataatataaaaatggggcacttgccgtaagagaggaacatagcaacgtgtacacacaattcttggttaaccaagaagttgaatatataagtaatatattagtcaaatttttatccttcaaaaaattttggaattgtccaaagaaaggccaacaggatacatgctaggcaatgatgggtggattaggcatacaacgaaagcaagttaaccagcgctgtttctaacaaccaagtcccagaatatccttgggatctctgggactatctcaagcatataacatgagtctgggatggttttgaaatctctgctagcatatgctctgccctgaggtttctttttggtgctgatttggttgaactgaagaaggaagggagaacacatagaagaagagttctctctattttcaggcggcagtcctatctataccggtggtacagttaagaacctagaatgaatgctcctccagaatcccctgtgcagatcgacactctatggtatatgagatctcacagagtcttgcatatcagaaactcacaaacgggaacacagaagagtctgtgtgtccctgagtttatgctcaagctgtcaaacatcaagagtaatttatgttgttcaggaacatactataacaaagctctcacaggttggaggcttcagtgagcctgagggctcacttcccaacctggacttaccccataaggagcaacggactttgctaacatgaaatcaaaaggcaaaggaaatcaggcatttaggaggtattttacagttacaattacccaatcctaggttggactaggattggggttggtggggaaggagacatggaaagtgctgttaaatgttgtttgaaatgtccctttttgatccccacagtcatgagtgtatttgagtcttgattgctctttacttaaattattgtcattgcccctcagttggcatctctgactaatcccaaccctctcaatctactctgcacactatagccaggttaacttctaaaacatgcctttcattatttttgcttgtctctgtaagtgtttcagttattcagcaaatccttattgcattctaactgtctgatagctattgttctcatcacccacaaaaaataaatctggactctgcctgccttttggaattcacatcctagtcttcaataacatggctctcatttctagtttcactacttcctgtatacaccaactttatttccattggttgatatttttcttcatcctccctacttctctgttttcccatattaaaccattggctaccatctttgcttctttccaaaagaccttttattccattatctttcaacgtccagcttttacatctacagctaaagttctccgtctactattaatcaagccttctatactcctttctaggccaccataatgcagattcttgtagtactcactacctttcgttattgctcatgttggtgcataatggcagattggtaatttccagttagttttaggatctaattactagtctctgcaataagagtataaaaaccataagctctctgtgagcaggtattgtgtttctgatagtaacattattaactgttgtgataactgtgaattaagtttagcatcatacttatttctaaatttaaattgtaccacttctaacaaaattttctccatcgttttattaaaaaaaagtccaaaagaggatgacaataacaggaacacaataaatatatatccacatgtaatggtcagtggtcttttccagtgacaataatgctgcattttgctattagctcctttcttttttacgtgatattcactattagacatactactacactaatgccaacattttccagtaaaaattgacattaattaagctttggatgttgtcagcactagcctagggatagggtaggtttagggccactgagaccaagttcagggtataagatctctgatattcatcaagcagctaagataagaagcataatgaaaggcaaaacaaatggtacaccatatagtatgccgaatatttttaatgctgatttttgtagatagaacttgatatcagcttttactcatttgttattgatatatgtgtattttcttaaaatataataaatatagaaaagggtttgtgaataacataatatgaagatcagaatcaagattagagccaagggcatcagattaaaatgcagatgaataatgaatcacctgtaagattaaagctctaattccaaatggaaagaaagcattggcaaaggcatacaaacatggttctagtgtggtgttcacagttccatgaaggaaaagatgaagcagataggagggtgggcctactgtatggactaggtactggtattaagggttttgtattaggcaagaagacaaaaataattaaaagagtttggactggaagactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggtttttttcctaacaagtattaaccatgatcctatagcataagagtgagtgatgatgaggaggatgataatggtaatgatgataacagcagctgtttattgagtgcttattatatactaggtattggtttaaatattttacatttattagattacttactccccacagtaattttataataaaaacaaatttatggtcccccacctccttctcctcatccttaatttacagataaagaaactgagtcatgagaattagttttcttaaggttacagtgttgtagaatctacgtagtcttcactcttaaccacactgctctactgcctaaattcaggtaaccaacaaaagagttgccctgcctcatcttggagcttatagatgtctacagaatatattgagaaatatatatgagaaatgatttaaggatattcttaccagagcagtagccattctaaaaattatcacaatggtatattatattgtttagacataaaatgagagtattggggtaacatatatcagagatttggctcttacagattttaatttttaattgtactatttaagggaaaaattgagtattgtgaggagcactggaacaatggaaaaggtaatatggaaagtaaaaagtttagtctcagcctggtaagtgtggctgtctatctcttcaagcttcctttcctcaacggggtgacataagggttaataggatgactgtaaaatgcagttaccttatgaagaatgaaaaatcccattattactgagatttttcaaaccctgataattctgctgggattttctgaaccatgataattctgctgggatctggtattaaacagcatgtagacagattaatcccaagcccagaaaagagcaaacaaataaaacataagtagcataatgactgaagaaagttagattgtagtgtccaatctcatagtggccactttttttgtttgtttgtttgtttgtttgtttgttttgagacggagtcttgctcggtcgcccaggctggagtgtgcagtggtgtgatctcagctcactgcaacctccacctccctcccagtttcaagcgattctcctgccttagcctcccgagtagctgggattataggtgtgtgccaccacatccagctaatttttgtatttttagtagagacgaggtttcatcatgttggctaggctggtcttgaactcctgacctcaggtgatctgcctgcctcgcctcccaaagtgcccaaagtgcttgggattacaggcatgagccaccgcgcccagcctgtagtgcccacttttgacaaagttgattgttcatgtgggagcatgaacatgaaaatttaattacaaactaaggagaaacatacttaactttgaatctttcctattggtttcctggagtcaattttaaagtatcacttaataaatactatttgacaatttgcaaatttatataaatgtattttccttagagtataagcattcaactccaatatgatggtttcctattttcagtttgagtaaatatcaaaatagaatgtccctgttagatatctagggaatcacttttaggggacactatataatgccttactaaataccaagactacagtactattattttcacaagtgagcatgggtcaaggcaaagaagggcaagttggggtaaggatgtataggctgttaaccttgctgcacaggtaaatgtaaaagttccttttttctagcctcaacatgctggaagatcctgactttaaactgagtagagaatgtcttaaagcaaagaaacaagaactcctgtactctgaactttgttggggagttctggccccttttatcatttgatcgtcaatgaataatataactgcgtttagcccttaagcctgtatcagctgcaaacgtgacagatacctgtcatattttagaacagcttatcgcctcagcctctggagtgattgagtatttatagacacaaagatagaaacataaagcacatatgtataggcaggagtcccctggaggtggcgattaggactaggcagtaattttagcttgaagttcctatgacttaaatagccacttgagctctgctcttgcagtttacgatgtcaatagaacccctaaatgaaattacagccttctgatacgcagcaggatatcctttctttgccatgcaatgtacacggccaggagaaattgctctgtatatggagtttcactaaagcagaatttatcataaggctgctctgctaaaatatcattatgctgttattcactggataacacatctaatgactcgaggtgcacttgatagccatgtttcagtgaacacagacgcatgccctgatgtgaactgggcactccagtacttcaaagcactatcgatttcaattctaccataatttacacctggcttgttttgccaatagcttgaacccatgctaacactggaacatacacatacaagctttagaaagatcagaaatgaggtgtatagcaaaaatgaatgcagcaaactctccaggattttgcctttataatcatctcccttgatgccgattaaatattttgcacgattttcctagttaagtttgggcattccctctgttagcattatcctttggttggtgatgatggtaataagaacctcttatatttggacaagctatggacacttctgcagcaggatctgggtgccagtcatcttggttctcccactatctagcacaatgactggcacataatagttgctcatgataatctctgcaggctcctcttcctctctccattccagaaatgcactgtatataaaggaccttctcccttttgtcatctttcaatatatttttcctgagaaatgtccactccataattttaactattaccatgatttggatgattcagatgactgccaaagtctgtccctgacatctccagcattcctgactaaatccaactgccagtctggatgctcccctaacacccccaaattaaacaccttcaaaagtaaatttgtaatcttcccccatcctccaaaatctactcttcctcctcatagcttttcttgcttagttgtataaggcagaaacctgggagcaatccaaaattccttctctccatgcccagcccaaaggttattaaattgtgtcaattttgcctatctcttgaacatatctcctcctctctgtctattcccacagttattgtcctagttcagggcttcattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccactgttgaaaatgcttttgcttagatatccacaaaacttgcttcttcactttcattgaggtcttttctcaaatgctgtcccccaatgaagacttccctctctacctctccaccctatttaaaattgcaaacttatccctgacacaaacacacatgtatacactctttctcctctttaaattttctccatagcacttatcataaaatgccacatattttacatatatatatatattttatcttctgtctctcctatctagaaagtaactacaaggagaacaaagatttctgtttttttttttctaaatctactgcagtatccccaacccctggaatagtgttgggtacataatatgaattcctcaataaatatttattaataaatgaatcaatctttagcttcttgaataataactgacacagagtagggattcaaaaatgtttctttcctttttttttttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgtgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattctttgcactttgttcatgatgtacctctgacatttgttatacaattttgcttcctcttgactaggaatgcaattagcaggaggtgcaaggtgctaacactttttattacaatttatgtctttccatattaggtgtttttcataaaaaagatcccctttctttaattttcacaagtggattaggcactcatataattttgcccttcggagtggtttgtacatgactacccaggaggacattgtgttacaaatcctgccagaatgaactggaaggtgagtgcagcattcatagcttaaggatgaacaggttgtttggtgccaggtttgtactaatggagatgttctccattagtgttaactcccaaaggagaataaattcaataacaaaacatttcagtttttggcatttctatggagagttaactttccattgttcaagggttaattatccattatgtgaatcacttttctttctgtggctgcttacatctaggaattcagtttactagagagtgagcagggaaaataaagagacgaaaaggaatattctatatatataaactccaggaaaaaaattggtttaggggacagaatgagatatagtttggggattgctaagttgattgacaattgaaaatgggtaagattaaagcatgttttattatacacaatattttgggttttttttttaaattgtttattagggtcagtttgtagtacatgcagttactctctggatgtgattcttgtcagcacaataccatctagggtgctagaatgggcatttagcaaatggtactttagaggctagctcgacttggtgcccctctcctctgaagaaggcttagtgtgctgcagcttaatgaatgaaacagcactaagtgattccacctatttctctactcattgatgagaaacaactgcagtaggctattttcagctattatttacctcaaacagggcatttaattagtgcttgttaagacagtgcaaatgatttggctgccagtcttcttgcccctgctctttattgtgctgtatgtctgccccgcctctctcctgtctagttcacagggcatccatagccagtcttcatgcctttccataactgacatcagcctgacctccacggatgtggaagtttgaggaaaggaagaacaagtattgacaagctggagggactgttggttaatatgatgcattataggtaagtctggtactttctgactacatgagctgaccaagctggatattcggtcaccctcataagtccaggaaaatgaatggaactactgcaaactgaagatcccatgttccatcagaaattacccaagcattgtggggaaccttagcaatcttagtaaatggttggaaatgctgtcagatagttggaagatctaatgtgggagttaaggaggctcagatatagaagactctgccaatttgtgttctagacatggacatgtttttttcttttcttttctttttttttgagatggagttttgctcttgttgcacaggctggagtgcaatggcacgactttggctcactgcaatctccacctcctaggttctagcgattctcctgcctcagcctcccgagcagctaggattacacgcatgcgccaccatgcccggctaatgttgtatttttagtagagagggggtttcttcatgtttatcaggctggtctcgaactcctgacctcaggtgatccgcccgcctcggcctcccaaagtgctgggattacaggcatgagccactgtgtccggctgtttctttcactatgataagcaagatgtattcactgtcaatgcactgacatgtagatatccattcattcatcacctattcattgatcctccactcagactgagccaatctgacactggttgggagagaaattaacaaacctaaaacacaaaacctgccctctaaccacttgcagtttcatatatagaaaaaacttcaacttaaaagcatatataaatgctaaatgaaggtagatttgtaaaatgctaccagtgtcagatcacttttaatttgggttttatggaaaacttcagagaaaaagtgtgacttgtcaaggatatgatttggctgatcttgaaaagttatcagaaaaattatggttgctgatgctaatatgtaaatacagcatcaaaatatttaacatatagtaaaatagctgagaaactaaaatgggatcatctgtatatgtactcagccttataaaataaaatgaattcattaaacatatgctcaattttaagatatcaattaatttctttctacttaattttaaacttttatatatatagcaattaatattttgaagctgtacataatagaatttaggttgataagctaatatgtatatttgctgaaggataattaccaaacttatcagctaactacatctttctttttgcaaatactgttcataaatatttgtgtaaactttcggtgttgtcagtgtgataaaaagtcagctacatttcatttatggtcattatgaccaaaacatttgactgaaatcaaaggcaagtaagcctggctagaatttggtcatatttttaatagctgaatatagatatatggttgtgcgtatatgtaggcatttataagctaacatacatatacaatcatatgatacaagcaatcaactcctttttaagtttttaaaatatatgtctttcttaggggaatcacataaatactaaaaaccacttctatataaataagaaagaacaatttcttattggggtaacaacaattctgttatttagcaatttgatttgtgtatatctgcgactgcctaattaaatgaatatagcatataggaagtacttacagctaaaatatgcacgcaagaaaatacacatttcacaacatgcatcctcattaatttaatgaaattagaatttccaggtgagcactaggaaattgagttattgacagtgcattgtgaaggcttatgatcaaggtattgaaaaaataagtaatattaatatagccattgaagcacaaaaaatacatcgtcttgcctttgtatcagaggtacactaatcaaattctgacttcttatatatttcaatttagtcatgaaattcttccacgaccacttggaactccaagccttagcaactataagaaaaatctctctggcagattatatttttttaaatgtcatgtcttgggaatactcttaaatatttgttttcacctattctcttcttaaagttgcttatataatttcatatgtagtcattaataacatgttttcaaagtgttagagatctagcttgccttcaacgcagttctaatagacatccctaccagaaactatgagacagttttcctgggagtctgggcagtttgaatattaactgaggaatgttaacctcctatgtaggtcttggtggtaatggcctaagagctagttacattttttataacgtattgtaaacaccatttccctttcaactttttttctttagaaaacaagataactaatgaaaattacccaagaaatattatacatataaatagtatagtcctaacacgagctaactacaataggcaaactttactattaatataacattaaacttttaccatactagccctaataaaactctgagactattttctatcacaatgacagctgatgaatttaatgtgcctcacaaactataggaattgtgataggaagctgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacgtttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgctctgattagtttgtcgagttcacagtgttccagagtgctgaagcacagaaattagggaggggaggtggaaggaaaatcactggagcctcttacgatctaacttccactaactgggaggaaatgtcttataaataaacaacagtaagagaaacaaaaaaaaaaaaaacccatcccgtcctgccagaggaatgtacattattgtctcccgacggaaaactttacaccacaccagaatgcagccatgtctcctgaaactacctccctcaaaacagaaagaaaaagagaatcaaaaaggaaaggagaacaaaacagaacaaaaaagatttcatccccttgaattctgttgggaagttcatgtgagttcccagtagacaaactaaactaagcaatttcaacagtgtcactgttccagaattttgtgcagaggctgcttattagccaaatttcatttctgcccagatcactgctgtaccatccagacattttcagaagggaagttcagggaaggggggaagggtacgactgtggagaagaggaagaagagaggacaaaggaaaactcctgatgaaccagaatgccctagccacggccatgatagagcgagcccccacccaccacccgactactgcttgttgaggacttggtgatgcggtgtgttttatctacttactctttctgctcgggaggctgaggttcctacatttccagctcatgctggactgtaccgtaagcaacaagtgaaatgagttcagtgatctcattctagtccttcgactcctgtccacatcactaagcgactgcacagcttggcacaggccaggatgagtcagcagtctctggtcatgagaggccaggcctggaatagcaggggggtttaggtcaggagcaaaatgaagcagaaaggcagtctagatggcagggctctgttctgcaatacacagaaatactgcaggtcaaaatgaaagcgcctcatcagctctggggtgaagattgtaggactgtaaaaaaagaagcatcaagagaaaaaaaaaagctgcctaccaaacatagcaaggacaaaacagagtaccacagtcagaaaaagagggcactggtagagccctggaggataaaagatgctcattaaggtttctgaaatgtcttttcttccacatgctcccaaacttgaattaagaaatggtgacttcctatatactatcctagtattttggtactgttttcccaattcagtaagtagcaaaacaaataaaatgcaaggcactgcagttaaatagcaagaaaagcctcatatttcataaaataatatgagtctgatatctcaaaggtgtacatttgggttaatagtgtctgtatatagcctgtatgaaatggttaaagaggagtactctttaagttgagcttgggtgggggtagagaagagcttagagaaaagagagttaccagttaatgataaaacataggggaactatgacactgtgaccatatttctactcaatggggccaacatagacctccattagacctccatcaagaagtgatgctcccactaacaggacttcaaacacttctccctctgcagtagtactgtaatatagcaaggggagagggaaaataaaatagatagaaaaacaaggttcaacataaaaaaaattagtgatagacattttgtttcagaggaggcaaattgctctataagtcaactgataaaaaaaagtcttggtatctgaacagacttagagaaaccatatctagatgaagatgccaggtggagactgataactatcaggaaatggtagtaatggccataaagaaggaagaaagcaatctcaagtcacatgatgtagaataaaacagcatggaaaacagaaggagagcaacagacttcgggaacacgagtaaaatatttctttaaagtccttttaagaggagtaatgaggacccaccacatattcctaaatgttgtccctcagagatgcacagatgtatatgggtaaggaaatgtaaaataaactttcagctttcatttcagagggtattaagtcatctgaacacatatttactaactgtttaatcttgggcaaatgagctttctagcctcagtttctctctctttgaaatggaaataatattatcatcctcatggaatcattgtaagcactgaatcaatgttcattaacccttatctcagcagtacctgtcacatggtgaacattcagtaaattgcttattattcatattatttgattatcatatcatatcatctttataagtatccagtgaaagaatccccctccagtgttgttccactggattgagaggaatcaatatgaagactctagtaaaatcagttgagtaacactgcttacactgctgctttaaaaagattatttctgtctgggtatgttaaacattatacttgaagacacaggatgttgaaaatctattatgtgaaatccttgaatttgggtatctatgttgtcaaagcaacttggagcctaacagttgtccagtaactagaggcccaaaaaagaaaagaggaatttttagaagcttctccaaaagcaacaggataaaagtgttattggccttaaccgcatgatgagggctttttaccaaaggggaaaacgtagtccagttgatcatcgcagcctaattgattaattgtgggtctgaccatctggctgatgaatgctgacacccagcagtgattactgtgtaacacaattccggatgtgctctccctgatgcctcccacaataatggcaactctgaacttaaggttagtttattcaggcctcttggctcaatctcttcatggaatagtggttgtggcagggaatattttactagacctggtcaagcattatcttctcttatttcagttacccactcttttccaactctactcctacccactcctaagccctctcttgtatataatcacttttcatgcaaagcattccatctgtagttttcatcatattatctgattctctcatttctggttgctctgttctgaaaaatatttgactaaactaggagatctatactgctagaatgccatttcacaggggatcctattgggacatgtttattgtatcttatttgctactggtttacttcaaattactctgcgcttccaaataaagaaaattattttacctaattcattagcctgattaaaagtcccacatatggcccaagttttccatgagattatcagaatacaagggttaatagacgataattcttacatcttaagcctacttctgaccctcagttaggagtatcccatgaagaagattcccctggagcatactttactgttagagaaggaaagtcagacccatgtaaatgacaaggttcaatagcaatgccatccacaaaccaatctacacctggagatgacttgtacatggagaattcaccaagcaaataaaacctgtacatataaatataaaccctggggaattataacaaaataattccattgtattttgtaggaatgcacaggggagtaactgacacaaaatatcttatacaaccttgaccaacaagtcacaatgacaaatcatccgtttcctcttttcttttcccagattgatttccagctctaaattcatcttttctttcactccccacagatgctgaattcttctatgttccaggctgagttagtgttaattttcagtagaggacggcagtagcatgctgaactgtagagttccgggctgggagttgggaaatgtttttggcctgactgtcagtaaacaactatgtgtcttgggcaagtcaagtcccttaactccccatgtctcagtctcttcattgaaaaatgatagggtaggactgcataaactccatagtctctgccaacactaagattctatggttctatagctcatttccttttttttctccctttggcatcaactgctcaacaactccgctcatagtaatctctatgctctcagttactaatggaaaaatatgtccttcatttactagttggtattttgtatttgtaatctctctctttttttatttgatgctagatattttgagtcataaacaccaacatatccaaatagatgctttaaatttgaaggcgtttaaggaaaatagctttcccatgtagaatatttagtgtagcagggcatggaggaagccagccatccaaaagtggagcaaaggggccaattcacaaatgagagaaagcctttcataataagagtctccacactctttaacttagataaagctaaaatgctaccaacttctaactacttttccaatcaatcccagacaccatcacagacacttaggactacaaatctgaggaccagcactggcagcaatgcagttcttatttcacctccaccacccattgccaagcaggatttaggatggcatactaataagagccaagaggacgatctgtcatttattttcctccaaactttttgaaatttcccatttgggctctgtttcccagttttaatttggtaactgccatttttcagcatttcttttaacaggttactaataatttctgatacaggatctcatatttcattttatgctgctagagctgctgttaatatttcatctgccttcaattcagctctgaataaaggctgctaggttttgatagactgttaacactttggttctggggatttgatcactatgttcatccagtttgtccatattttgttaaaaaaaaagtaataggttagctatctcagaaatatctcagggtgtgctatacattctagggatacttcagagtttctttttctggatctttgatgaaaaccaacaaaaacaagtatcctgggtttgttttcacaaatgacttgccatttgcttcagtgtcagtattctggaagcagtgggcagtggttaagattcagggctcataggcagatctagattcaaattttggctctgaaatttattatatatatcacctcaggccagttccttaaccttgccaagtctttcttttcccatttgtaaaatagggatgataataatatccacttctattaattaatatgaggatccaataaattaatataaagtgctgaggattttctcagttctcaataaatgatggctatcattatcctagcattaataatctacaaattcacattatagaattattattttgcaacatcttttcagggtcaacaaattattttttagtacagcctttgttgtttgcttcactatagcttacatttttaaaaagtctcagtaaaatcatgtaaaatatttaaaaatttgatatttaaactgtatgtacagttagactaatatatagcaccatattattattattgtagcacttttcagtgcagcagcaaattctcaaaagtttttgtccatctaatagccagccctagataaggcacattgtaccaatactaatctgttctataaaaagatgacttatcatatttatcttctcctactcccaaagaatatagattattttaatattctttgggtatgtgtcagtcaggccctgtttggatacagagaccatatagcaatttgaatagaaagttagtttaaattattaataataacgggattaaagtaataagagtagctagtaagaagtaaagaatactttaaagaatataagaataacatgggccaggcgcaggggctcatgcctgtaatcccagcacttagggccgaggtgggtcttcagcctaggagctgaagactagtttgggcaaaatggtgaaatgccgtttctacaaaatattagtcgagcatgatggtgtgtgcctgcagtcccagctacttgtggggctgaggtgagaggatcgcttgattccaggaggttgaggctgcagtgagctgtgttcatgccactgcattcaaccctgggtgacaaagcgagaccttgtcttaaaaaataaaaaagaatagaagaataacaaatgtaaggaacagccattatttgcagggctaagatagcatatccaaggaagagtctcctccatccctggactgagatctagacattgtaggactcaagacaaaaatctcctggacccctggaccaggatccagaccttgttggacaacacacagccataactcattggatggcagagaagttgctggggagctgcatcagtagcacctgcactctagggtgctaatgaaagctatttacagggatgtatctcatctgaggcactctgctataaattgcccaatgtgtgtgtacacatgtgtgtgtacgtgtgtgtgtatggtgggtgctaggggtagctgctacctgccacgtactggagaagctacctgtgcttcagctgctgggtaccaggttagctgcatttgctgcaggagctacatgctgtaaaggttgcttatgttgtagaagccaggctctggagaaaccgtgcacattgcaggaggctgccaaagtagtgcatgacaaccaggaaggaaaatttcttctttctgcaacgtctccctaccttctctactgacaaagcaccctcaaaccagctagcaaagaaaaaatatttaaagaatccagatacatttttgcagagcaggcaaggagaactacatttggaaggaggcaatgggaggtaatacattggtaactggcacagatattattatttgctcacacacttcatgaaataactcacattagagattataatccagtattttcaactgattgcactactgttcacatttactaataaaccaactccctttgcatagttaagcaaatactgtcagaattaagaaaaataagaggccagtagataaatacctataatagaatattttaaagtgacagtactagtatatgtacataaccttttcccccaagtgctgcccacatacattttaattacatgtttataatttacttaagaaaaaaatatacagaagtactaagctattgacctaaatgtatgcatcagtgatctcacaccagaatctcaactaagtgggtattcagaagagtcattacaaacaaccaaaagctttgagagaggtaaaaattgcctcgattatcatttttcctttctctttccttttctttttaattaactctagaactcatatttgcttcttctatgacatttttgtggaggggtggggtggctcttaaataggttattcttttttttttttttttttttttttttttgagatggcgtcttgctctgttgcccaggctggagtgcagtggtgcaatcttggctcactgcaacctctgccttccgggttcaagcaattctcctgcctcagcctcttgagtagctgggattacagacatgtgccaccacacccagctaatttttgtatttttagtagagacagggtttcaccatattggtcaggctggtcttgaactcctgacctcgtgatccgcctgcctcggcctcccaaagtgctgggattacaggcatgagccacgtgcccagcaaaatataggttactgtttttcagaaaaatacatatttagaaattttttcttatgattctggtcctatattgttctactcttaatattaaatagagaagcatcaataaatgaccaatttggtaaactatgatactgtgatcattgttagaactagttttacatatggggagagagtatattccaaaatacctcccctacttttgcctaattcccttaagaagggaacaggtgcttttgctgtataattacaggtagagtttaaaaccacaaacacctgacattagcaaggagcgtggttgtgagaggctgagagcagaaaagctaattgggtgaggagagtcctgtagagagtagactatactgaggtcaggaccacagaacatctttctcaccattcatccgtttttacctatgtctggccatcagcactatctgttctcactattatggaaggggtctacttgttacctcacagttgtgttttcttaaagccagtggtatccagcaaagcaagccatgttgggttgtctcacaatcacactgtaggcatctctgccagctgcaggtggttatccttatgatttccttttgtttgtgctatgcgtgagtactgaggataaatttaatgaccctatgtttagttctctcctccaacacacatgcacacccccctctcccctgcaattcctgagttcaaaaagagatgaagacaaaggaatgtcataagtccgtgtgattcaggcaggcaagtccattttattttagtttgcccttctgttctgctggcttttctgctatgacccactatacttaacctgtcggctgttcttagtagcaacatgcctttttaatcagccttcctggggtctgcatttgattacagcatttgtgttctattttgattcttttgtactgtgccctgtggtgttcgcttgaaaggtgttatttataaaatgaaattctattgtattgccacttggattcaaagaggacatataatattaatgcagaatgtatttaataatatcttcaatctattaaatcaatttcttcatgagaatacagaatggaagggaggcacatgggctgataatcaggtaataagacttaagaatcacctgaacttttccttcacaagctttcctgaaagctggcacaagaatcattctcttaatgtcagggtttccaagtggaggagactacctttcttcagccagaccagtgcagtgcgcacctgtttaaacattcaactgtgcaggccaaacattttcctaggcttttagatgcaaattttttgactaaggaaactatgagaccaaacatgaatatgacttttttactacatagaaagaattaggttatgaaggaaatgtaatcacctatttctaaggatctactttcaagatttgtaaaaagaagtatatttgttctcacactgactcttctcaaaagcaggataggaaaattctagtgataccaagaactgatgcaaagtttccaaggtggcatgttcagaatgatgttctcacctagcaaaagggcaggtttcattgtgggctgctgggcctacagtcaaatgtttctagattagattgatggaggagtccccaagttttttcaacttctaattttaattccagctaaagactgaaacattgtacactgtatcacagcttgcacagcacatttcttgctgcatacattctattctttcactacaatttttttttcctgttgatctatctgaaatcatcaatggctatgctgctgtttggatagggaataagaaagaatttggtttgaaagatgatttaggaatcaggctctgcagaacttactaaaagaaactgtaacatacaaaggaacctggctgggcagtcttgaaatgagagttcctggatttttacctgttctcattcagtggcatattatataactccagaaaaatcagggtccagttttctaatcactaaaaggggaataactgtccttttctacttgcactgggctactttagggatggataagaaaatgattccagaatcttgtaaatgctttgcaatgaagaggaaatacaaatgcacaatattattaaaatgatagtttaggccacatttttgtttctccaaatctagagatgaaaaatagtaacaaaggaataaatttcttccacttcaaaaataaataatatacccttatttataaatgacatgtcaaacataaggaactaggatgtgttggggaatacacatctcagttttgaaggcatcaaattataagctatttgcatgaaggaatcacattcatctctgtatccacccaagttctacctcattgatttacattatgtaagtattccattcgttaacatatgttgaattgaaatgacaaatgagatcgcacaattttagagctcgaattaactagagaccatgttaaatcctgttgcctcattttgcagatgatacaactgaggcccagataagtaacttaactaagtccaatactaaaaatattacaagttttagaagagttattttaaagatctgccactgaaaatatatcactgaattaaaacaaaatagacattcttctgtcaaaataagaagcactattcagctcaaataatccgatgtatcctaacctaatcaagaaggctgaagcctaaagtaacaagtaaacataattaaatagctatagacccataggcatgttagaaatgccaagttactgaggggtgcatatcttaatactttgtctatcagccagtccaaatggcatatttttttcaagtaaaattaatgtcttaacaaataataggggtgaagtcagcaagatggcagagtggaaaactctacctctcattcttccacagaaatactgataaaacaatgttggaaccaaaataccttgcaaatatattcagattgtagctaagaaatagaggcaccctagaggatcccaaactaaaagcagttgcatttgcatgggtaaaaagtgcaatttcatgttagaatgtcatatcagtacttcccccagactggcttagctcaacactgagaggactgcttcagctcatgatttctcctgtgccacagaaagtgagattggagtgtgtatctggcttcctggcctctggcctctcagagaaccctctgttgggtcagttcctatattgcctcatactgtgtactgacgcacctgtagaacttcgttcccagggatgcgtaggagcaaagaaatgaggagggcaactccttacagttagagctgccttgcaagattaggaatggggcagaactgaggttattcttagatgagggaggaaagggaatgaagggggccttattctcagcatttcagagttccctctgtgaagccagtttccatttcaccttgtactgagccttgtgcgaccattagaacttggttctgagggatagttagcaaaaactaaaaggagcaggcatccctttgcagctggcactgctctgtataataagaaaaaaacatagaaccgagccttttccttgagaaggcaaggaaagaagtgtaaagggccttgcccccagtcttagattgtgctccccaaggtgtatgtctctatcttgtctcatattaagcaccatgaactggtaaaggtctctactcatcaaaactcatctgtagagactgggaaaggtagctgctacttcaaatatacagatcacaaagaaaatctacaaggaacacaaagagtcatctccaataaccatcctgaaagaaacagagatccctgaattaactgacaaagaatgcaaaataaatgtcttaaagaagcccagtgagttacaagagaacactgagagatagctaaataaaattaggaaaaagatacaagaacaaaatgagaagttaaataaagagatagagactattaaaaagaacccaatagaattactgaagctggagaatacaaaaattgaactgaaagattcactagaggagttcaaaagcagacctaatcaagcagaagaaagaaacagtgaacataaagacagatcatttgaaattatgtagtcaggagcacaaagaaaaaacaaggatgaaaagtgaggaaagcctaagtgacttatgggactcaaacaagtgaatcaataaacacattagggaattctggggagaagagagggaaaggggtagaaagcctatttaaagaaataatggtaaggaacttcccaaatcaggggagagaaatcaacatccagattcatgaagtccaaagagctccaaagatctacaccaagacccattataatccaattgtcaaaagtcaaagacagaattttgagagaaacaagagcgaagcaactcatcacattcaaaggagtccccataagactgtcagcaaatttctcagcagaatcctcacaggcaaagagagagtaagatgacatattcaaagtactgaagatcaaaaaacaacaacaacctgtcaaccaagaacgctatactcagaaaagccatccttcaataataaagaagaggtaaagactttcctagacaaacatgcagaggggtgttcaccatcactgtacctgctttgcatgaaatgctacagaaagttctttaagctgaaatgaaaggatgttgattagcagcatgaaaagatgaaagtataaaacttgccaataaagtcaagtatatagtcaaatactagagacctctagtactctaatgatagtgtgtaaatcactttcaactctggtataaacattaaaagacaaaactataaaagtaatgacatgatttgttaatggatacacagtataaaaagacgtaaattgtgacaccaataacatgaagtgtgtatataggagaagtaaaagagtagagattttgtatgtgatcaaatttaagttgctatcagcttaaaatagatgattataagttgttttatggaagcctcatggtaaatacaagaaaaacacctgtagtagatatataaaacataaagagaaaggaatcaaagcatattgctacaaaagataatcaaatcacaaaaaaagacagcaacagagggacaaaggaactacaaaacaaccagacaataatttaaaaatggcagtaataagttctcacctattaataattaagtgtaaatggattagcttccccaatcaaaagatacaaactggctgaagagattaagaggaagactatccatatgctgttaaaacagcaacaacaacaacaacaaaaaacaacaacaacacactttagctttagggacaaacatagactcaaagtaaaaggtgggaaaaatatattccaagcaaacgataaccaaaagctagtaagagtggctattcttatatcatacaaaatagactttcagccaaaaattgtcacaagagacagagagaaggtcattatataacaagaaagtgattaattcattaaaatgatataataatccccttgattaggatccttttgattggaatcctcttgactggagtagaacaaaaactgaataattgtaaactattattatgaagtagagatctccaatacactactttttatttttccaaagctttcctggagatcacagagaactgaacatggagaaaaagtgagcaagagacagcagtaggctttatgccttaaatggctgtatagcttgttaaagattattgtttgtgtattaaaaaaacatgattctagaaacataattggggtttcacagatcaaattcaaattattaacttagtatttcagcctccattacttgctctatcttgcttaggcatcctaggttccagtacttcccaacaagtgttctgtggtgtatgcagactatgttagtgtttccctttattttggtatttccacaggagacctaattttaaattttctgttctatcatctccatgatttcttaaattatgtctagacttctggattagaatattattcatgtacttactatgattcaataaacatcttctatgtgtgagacagtaggaataagatacaaataagacttatttcctatcttcaaagaataaaggaattcacaatacagtggccacttaaatatataacatgtgttcctgcttttaagcttttattctttctataattagagtatcctatcattattttattgattgaattcctttaattatcttatagtccagcttatgttctgcttcttccataaattaatttttactttttatagcccacactgtttccttttccccccactattacagtggaagtggacactattccctaaccaaacttcattccctcattcttcctagccgcagacctctattttgtgcagagtgtcaatgtgctcagtgctggatgatgagttttgaaatttataagccaattatgacaagtgtattctctaatttgcttgcttctctagcaaagaagggtggcctagggattcagttatagccaataagatctatgtggcaatccacttgagaggcaagtttctgagaaagctttttttttccgttacaaagaggaaggtaaaaggcaatccttctgtttcctcctccttccctctttgaacatagacatgatgcttggagttgtggcagctattttgtgatcataaagtgacaagcatgaaagaaagacaaaaagaatcccagagatatcagcacagactttatcatataccaggaatttcctacctctcaacttctggacttcctgttaggtgagaaaactgaatctctatttgtttaagccacttaagtcaggatttgctacctgctgctgaacacatttctaaccaaagtaataatagtaacattcataatttgaattcaccaaactgttcttcctaactagataacagacattggtcacattcttggcacttcataaacattcatttgcttcacatcttgattaaatatgctagacttttatatgtaatgaaattctcacacagaaaggaaggggggaatttggattagtatcagaaaagaggatgaaaccaggtcaaaaaaggaaaatttgattctataataaaaaattatatgacaaaaatttgttacaatgtagctcaattattatatacaataaaagcaaatttttaaatattttccaaaattaatagcaacatattttaagaaataagacagtagaataagcccccaaatgataaatgttttaaaggagagatgatataaacaagtcttctattaaatgtgaagacaataccatgcagttctactgaaacctaagtgaggaaccagcgtttgtcaaataccaccagcaataagactttttctctgtcctttaggttgtatgactgtgattcaccccaatgctacaggctccttagcatgctcattatttctaaaatctttcacctgaggtttgaacccatgacttaggaaactattatcgcatttgcttttggagaaaagactacataagttgggacagaagctattttcaaggcttccaaatattacaagtaagtagtggggaactgttgagaagagaaatgagtagctttgggtcattttaggttagtgaccttaaacataaggtgtgatttaatcagaagccagagtaattatggcaggaggtggggaaaaagactcagagctgtctggagttagggaggactttggtggcagctttcagcttgagctaaaactgcaggattctgtcagaggctccacaaacaaagggctgcattatgtaaggaatcttgtatttctttgtgaactagtccacaacaaaatttcattagtttttttttttttctctcctagagatttttttttaccacttccagcccgtaacttgttgctcagaagggaaactttctaccttaaataaaagtttaaattgtaagcaaactgacatttttttaggaacaaatcaaattaatttgaactttataataactgggaaaatgctttttaagttaggtggatgataagtaatcttatatgaagaatttccaaataatttagcaatagttggcaataatttagcaatagttagcaatacgagttcatatctctctccctctctgtctctatcattttctgatagtctgtttacacatgtaacacttttgggtcacctttcaatggagcatttcataggcagaattggaagatagcaagacacatggatggcacatagcaataggttctcataaatattatctgttttcaaaagaatatttatttttttgcccattataaagatattctaagattaattacagtcctaatactgtcaaatttagctttgatatacaaaaatctattttttagtagtttaatttttttttatcaattactaacttgaggctttcattttacaacattattttggtcagttataaaaataatttaactgccaaatgggttttcccatttgacatttcaaatgttggtttaatacttatcacttagacctctatgaaggttgactcaggtttactgggggatattgcatagatcatgtcttttggtccaacagtttgggctgtgaatagtctaaatttgcatggaagctcccaactaccaagctatccaaaaactacagggacagggcggggtgaatgattctcagcaggtggcactcttccttctaattaggtcttgaatgaatgcaccagcattctgctatctcttgggtggagtgtgagactgaatcattcaataatgcttatagcgcttaagaaccaaattcaagggaactgtggaatgaaggcaagttataggtaacatacaaggattttcattctgctggactttttcattcaaaacagcatcattctcagactcagaattatggataaccatgcctctcagtctactcaggagagtttccagtttcagttccaatggcccagtcacaattattagtagtgttcattttcactttcaaaagtgtcctagtttggatgataaaatatggggttaccctgtatataagctttaaaaaagttagtcataacaccatttacagtgataatcattctatttaggacaaattaaagtagactctattggccaacttctataaagagaaagagataaactaaaacattattaatttaatctcagagctttaatcagaaaaagtttattttaagatgacaacaaaatttctatgaattatttaggatttctaattttaggtcatttttttttagccttattttatacaagcaagcacgtatgcccttaagatttgtggtggagaaagaagtacaatatctgaaataaagttctttgaagcttaggtttgaattctaattctactatttactcggtgtgcaaatttaaataatttctgtgaacattattattaaccctttctaaaatatgtttaaaaacattttaaaaaccagaagggaaagaactacatatgctgtgaaaagctgtaagttattaacagttactattatttctctttataaataatgatagtttttccctttcaacttctatgacacttttacagactgtagaaaaatttggccaagcatgttgtagcaagggtccttaactgtaatcacctttgacacagatccatgatatttctgggtgacatctctacatggacattgatggcctgcaaagatctagaaaagaaagactatagatcttgtacaccaaggccaaagactaaaaggctgaaatttaaagtacaaaagtattgtgaacagttttgttagtagtataatatataccacttatatagataatttttcttatatagatataagaataatttttcttatatagatataaaatagggtttcttatatagataatttttccatggaaggaaggggaaacgaggcgaaaagtggctggagtagaaagactagtttgtaaggcagaaagattttctaattactaggtagattttattttattttacttgtttttactagctaaattttaaaaaagagattcctagatctctatagacatgttcctctttctttttgctgatattttcctatttcttttctgaaatcttaatttgactagaaaaaaaatgatgttctgatttaattctcttagtctacctgacatcaaaaagtatatggagggtgtctttagttttttatttatatgaatgtaatcaaataattttattttttaaaaaaagactctcactgtttttcattgtttaacagacatttctttaaaactttgaagtaattatagaaaatgttctcataaattttccctccaaattaaccaggtagaaagggctaatcctgttatgcatgccatttttgtttgtttaaattgactattctgagaattaagtctgtagtacctagtttgaggcctcaagattttcaggtatgcacaaggttctatcaactaattctttgtctcactgatgatcctttattttaaatatactctacttgcaaaggtggtagggtaaaaagaggagtggctgacaagagactaaagaggggaaaggattcccaacatccttaatatctcagggctgaaaaagagcattagaaatcttctccaatctcttggagaaaaaatatctttcacacactctgtctattagaacttcatttgtgtttaacaagcccctcttttaaaatgcaaatttgccttgtgaacctgtaaacctcattcacaccttattgttaattactttgatgttctagaatatgatcaacacttaactgatattggcaatctaggaatgaacaaattgctcagggtgaaaaaaggaaaattttgttggagtggggctgtaggtggtagtgtgagaatttcatttgtgagaaatagagcatactgatattctgaagttttgtctaggagaatggcagtagttacggtaccacaaaacgagcacttttcccgactgccgatgtctagttgagatcagaaaaagcctggaagcctgcaaacctaagttttaaatatttagccatagcaagctaatcaagcttgcaattttctgaaaacgttttaagttaattcataatagctctacaactcggtgaccttgggttctaagactcatttggttcaaccttccaggtttaaaattcaaccaataaatgaattccaaggaaaaaaagtgaatatggcccagtccttttttactgtctccctagtcattcacttcagagattttggaatgcaatcctagaacatactgtaagcaatttcagaagaatacacaggatgcagtatttctctatgtgtcttagtaaatgtcacttgacccgatatatcaaaaaggttgcaaaatttgaattagactttagttgacttaagctacacatcttagcttggcagaaattcaaggaaaaaaatattttatggcctcttgtaacattattaatcacccctccttttatataaaaaataaatatgctaaactcttcactgttcagaaaaggggtcatttttcctgccaaaatggctaattttagtttttatgtagttggatacatttgtaaactattacatgaaaacatatggttggaacatgcttactccttcatgagtgttccccttttgaggctgcaaaattttccttagttgctccatgtgctactttgttgtgctgatgacttcttgttctaaataattttcttcattttccattgttaatgaaatgagttctaataaggaacaaagaaaccctctgatgaaaatccctttcttgtagaatggactgggaactgatataggacacaggggaacagcaaatgctgtgttgcacattcttcaattaaatgatccctttgtagtttattcacctgaatgcattttggcaaagagtgaagcaatagtgggaaaaggattgtttgtgtggctaatctttggttactcagaaagtactagacatgttttcctgcatgtttgattgatttcctgcacagtttgattggtgaatcaacactttaaggtatctaacccataaggaagagtgaaaaacttccccagaggtattgaaatttcactaaacctcttcttggagttttggtgtatgattctcagttgatctttgagtgtaacagtcaactattaaattggcatgactgaagtacagttttttcaaatagaagagtattttagaacaaatgagaattctaactctttaactgaatttctaactttacattttgcccgtacctctccttgtaacattcttccctttttccctatatatttttaccagtaatcctttcaactgctccttaacagtgagattctactgttctggcacattataggttctctttaactattttttgagtgcacaaatgaccatttggacaaatattataaaatgaacaataaaaaaccttaattatgcaaattaataagtctatacctttgggaaaaaagccatgatagtaacaaaatgaataacaattccaaggatatttaggaaggataaagcctagaagattaaaaatgagaaattttagaatcataaaaaacaaaacgaaataaaatagctcaataccattgaaagcacatgtatgcagaaagaagctaatatattattgtaaaaaattaaatggaaagaaattagaaatctattggtattattacatcaaaagcaggaagttctttctttctggtccaactttagagagaagaacaaatttgccagtgccaccaagggcagaatagagagagatgtttggaatttaagagttacaggttatgttatggttcatttatatcattgccatcactgcagttcattcattttgtgtctaattattgatgttgccacggttgtcaataaacgctcagcattactaatcatcagagaaacgcaagtcaaaaccacaatgaaataccatcttataccagtcagaatggctgttgttaaaaaatcaaagaacaacaggtgctgcatgattgtggaggagagggaatgcttacacattgttggtgggaatgtaaactagtcctacctattaggtactgtgctcattaccataggaattagggtgggattcctattccaaacctcagcatcacacaatattcctatggactaaatctgcatatgcaccctctgtatctaaaataaaagttgaaattttaataaagatggaactaatccctcatatcacagaattatgtagttgtgggtagtcaggataaagaatatttaggatataatttaaatgaattcactagctctgaaaatgaaagaataaacagaaaactaatctagacattaaatttttttctttccctaaggataatgtatagtccctaaggataatgaatattcaaggacatactgtaataaatcatatacatttattattaatataatatagtttattgcacacacacactatgagctccacgatgttcgttgaactattacaaagtttaaagacatacgaaattacagtaagagccatccatataaaaataaaatgttagtgtttggaaggaccaattgtaggagactatattggcgagttaatacaaaagatcatcttttgtttaagagttcatatatttttgtgtaaattatatctatttacagaaattttctttactaccaactgttctcaaacccattcactaataaataattactatatgtgattacttaatatttacctcaaacctttatgaatatcactgaaagcattactggcaaattaattatataggcaaatggtgaggatctctcaacctcacctctcaccttcttcccaatcactcgaagactgactatatcaatttgtcttgttatccagaaattggctttatttgttaattccagagatgcttcaactgtagtttcagccagctgtttccttacatctttctgggtggcatcagtttacaatgcatagcattgttgagggtcaaagttattttattttggtattactattggatttttcccccagtgcctcaaaggggaatgttgagtcatggagatgtaatgtgactccttaaactaagtagacttctaatacaagtatacttttattatggagaaaccaaattaattttatcaattaaatgagaatttatttaccatttgcctttaccagatatttcattagacacaattctcagactttacacaattacaaagaatgttgtataaaaactatctataaagcaggagatatttcattcttagttttttgccaaacaaattatgttgcttcgaggaacagagggaaaagaaacattgatgaaacacagccctcaactatggcataaagtccaaagcacagagaaggtcagaaaagaataaagcagttttgcagaattattatgatagggagtactgataaagaagagtcaactttttggccttagtcatttactgagttcctttattaaaaatagagcataaacattttagaaataattttttctcaatctttttttataaaacctctacagaaaaaagaagcgttatgtgaaaagcagctaaatgggaggaaagtaggggtctgtgggtgaaacaggaggttaccattgcaaaccctgtccttgatgccctcactcagtaggactggtggatggaagaagtttgaaaaacttttatgtagagatgaagaaaagtagaagccctagtttacagagaacgaaagatacatttttcttctgtgtaggtagagtttgtatttggagaaggaggagactcctttcttctgatgaaaactccttcttccaagagaaaactccattaggaaaaatggagcagcagtgagtgagagagaccaggtttaagatttgttttggaggttaaatttgttgtggaagttgacagaatgtggtgaaagcaagacacatcataaaataagccaaaaaaaatctctctcttccagctcattgtatattggagagttagttgacttttctactgtaaatgtaaagaaaacaaaagtttcattcatcctcctgtaatgatgccaatctaatttgctattaaatttctattcaaaagccctattttgtttagttacaagggatttgatccccttaaactttcccaggcaatttgtatggaaaggcggttgctaagggtattcctaagggaactggcaaacgttggaagataaataacctcagtacaatatgcagattaagtagaagggatggtttaagagttaccttttgaaggaaaaataaaagattcagaattcagggctagagttgctagttaatcactgatttgaaggtacttaatcaaggcagttttattttattttattttatttatttatttttttttagacagagtcttgctctgttgcccaggctggagtgcagtggcgcgatcttggctaactgcaagctctgcctcccgggttcatgccattctcctgcctcagcctcccgagtagctgggaccacaggcacctgccaccacgcccagctaattttttgtatttttagtagagactggctttcatcgtgttaaccaggatggtctcgatctcctgaccttgtaatccacccgccttggcctcccaaaatgctgggattacaggcgtgagccaccaagcccggccaaggcagttttatacttctcaagaaagtagaactttcacattgttcctcttgggaataaaggtaaaattatcatagagaggaaattagagagaaatgttcaccatttccttccttatattcttcctttctttcctctctctatctctagagctcttcctcaaagattcaaataaccaaaaatatgaagccatgggtggcagcttggagttctcaaaagtccaaagtgaggttagcttctgaccaaaacttttggcaatttccttaggttgagtgaaagaagcaatgtgaaaaagcatgagtttagagtcagtcagccatcaatttaaaatcaaactccactatttattattggtgtgatcttgaatacattagccaacctctttatagtccagtcatttctaaagaggtgattatctatgaaacctgtattacatatacaatgtgtaagtactcagtaaatactcagtacttctctagtatctctctaattggatttggctagtaatcatgacaattgtgggagagaaaaaaaaagatatgtaatcctgagggcactcagtctctgtaacaatcacttgataaataatcaggtgatacttcgttgacatctctttaatcttccaattgagaaaacattaggagtagaagaaaaatgattaatctccaacttctgtcattggaaaataactaaagatcagaactataagaaacataaaacttttctagattattaaagttaaccttttagacattttccacaatcacatggtatgcaaattttaactaaattattttacattaaatgtattttgtgctatgttttgactagttgattttactgtagtatagaatgtattatgacattccattatcctcttattactcatcaataaaaaatttattgagaaaacaattaattataattaatatttattattcattactagtaggcattgtagtaattacactattattggtattttaaatatcattaatagctataaacatgttatacataataataatagaaaccatttgtggagtgcttactgtgtaatacattttgctaagcattttatatacattcttaaaattaataatttcaaagatttaatgagctaagtgtcaccagataaacgagaagacataataatctttatttattaaaggaaaacttgccatatccacacaatcttccaaagcactgatagaacagaatgatggcatgatggcatcttaaatttagaaagtgtcattcataaaagtgtactgttaactactaatttgtgctatctgcaataataatattatattacacaagatggaaaggctaccccctaaaagatagcatttgataaattgtacataaaaatctagaagaataagagtataacagaggagtgaaatttgatctgaaatacagagaaaattaagaaaaacaaaacatgttagccctactggaatttgtctcaatgtatttcaaggttcaaagtatagcagaggaagatcattgacactgtcagaggattatcattaaatttcaacccaaaggcaactaactcaaactatgcagatatggaaagtagtgtttcctaaaatgaaactaaggcaaatattatttattctagcttctactcttttgactaatcagctgacccagaaattaaatatttaaaggcttaaaaataatatagttttaagaagttgacctatacgttactaaataaaatgatcctcgttgtatttgaagtagctcaccatttaaaaatttaatctatgtccacccattttctttcttcccaaataatacaatgatttaattaccccacagtttaatttgacagaggagccaaaaagatacactattccttcattgttaactttaaggagaaaaatacactataaactatattagaaatcttattttttgggtgtccaccacaatgttttcactacaaaatcccttgctgcctgaatacaaaatgttaccattcaatcagatgagtctccatgaagttagaaacattcaagtgaaactcataaaataaagaagatatactctaaaaattccagttcttgagaagctgtttacacacaaaagggctattaaaagtgaaagggtaagtagaaaatcttctgggctcatttaataaaagaatgtagagttccatgggattcttttctaaagaaaccactaacaatgttgcagatctacaaatcctaaaagagtgcataatggactcaagtctctgctttgtgactcatgggtgtacttcatcaggatgtacttcctcttttagggggtcatataggtgaataagctgacaacaccttcagagagagaaattccacatgtgtcataggaatagaatttatttgatctcaagctttctatatatagaaaaaaaacaaattctaatccaaactttaatgaattcagtattgttgttgttggtttgcctctagaatgtctcttttgaccaagtcacattcctttaaatttacactaggtaaattatatattttccaaatcttttataaaagcataagctaaatgagataacattaaaaggctgattggagatttccctttaaaagcagtcataagaacaacagcaataataatataacaacaatatacactacattttgggcaccatgctttgaatttatatacactaatattattaaggcaatctgtgcttttgagaagctactccagactaggcactacacaaactctgccacacacaagagagaaacaatttcaattacaaagagagctagaaaataaaatggataagagtatcatgaaagattttttgtaaaactgaatagatcctttcatgtttctcagttttaatctctccaaatatccctattgtctgctttttaaaagaaaaaacactgtaaaaattctgaaaaaattattcacaaagaaaacttccactcgtttatataaagcattattattaacttcataacatgcataatatcatctatttctgaaagaccattgaaaagtagccataaaaacttaaaaaattgaaaataatctttagagatcaacaggccaggaagagttctaagaatatgcattggcctttactaaccattttcaatgccatgcacttttgtctgtcaatactttctcctgttatttttaatatccctagattaagaaatattaacatctatttacaaaaaaatattctaacagtttcccccacaaaagcatattcccatgaagatcaagaaaacaaaaaacatagcagggagtcagtattctgacagccttttagtcttcttcatcttcttcctactattattattagacctactgcctattaccagtaggctttttaaaggtcttggacataaatatcagttgttaagttgctattttcatggtcatttaaaattatttcaaccataaatgcttttaatttcctgaatatcttaaagctgtctaagtataaatattctcccattatattcctctgtgctaacacaataatctagttggagtcaagtttcatgaaaataagaaaattggtacattataacattttaaacactgaaaaataaacgtgatagctgtaggatgtaaagtgtagtcaggcctgtagaacttcggatgcatcattttacaatatcatttatcattttgataaaactgaggtcaagtttctaaaaatacaacttgttaaaagcaggaataaatgaatgagagatgagtcagctcgtttgatggaaagggtttaaaaaatacttcaaaagcataccacatgacttggtaaatattcagtgtatcaaaatgtagttgccatctggcattgatagactgggctagaatatgtgtttaaaaagaacaagaaaggaaataactcagccaggttaatgtgcacttgtctacatttcataattcaggtattaagtgctttaataaatattcactatgaaagaaaggctgcattacaatcagacttgggcagtatttgttggggacagctagaaagaaatgaaagaagacaagacctgatggcacttaagaaagctaaaaacaacaataaaaaagtggtttaggtaaacagaattctcaatcatatgtaatattgccagaacactagtatcacagttaaatgcagggaagtggtaagcttatatttgaaaataaactgaaatcttgcttattttcagctttgaatattttaattattcttttctttggctttgacaatttaaaagtatagagaaatccagggaataagtaaaacccttggttggatagtaaaaaaaaaaaaaaaaaaaaaaggaaaaacgaaaaagtcctgacattctttgaagttttaaacctagagtttgatattaactttgcaatatgcaacaaaacaaaaagtaaatttgaaggactcctcttttctccctcttgctcaagaaataaaatatatttagaaagcagtatcattcacaaaagagaaaagtgaacacgagcagtgaacacttgcccaagcgttcgactgtccaaggctgtatctgggcttgttaattagatatttctgtctttaaccttgaacattctccagatttccaaatcttgacaatttacattctaccacatctcttggaatcagagcaataggcagaagagaaaagttttaaaacagctttgaaggttaattaggacagggaccagggtagccattaggaaaatagatgaagcacttcaggtgagagttgattagggtcaacatgaaatttttcagagttgaggtataatttatattcagcaaaattcatggacttcaaaatgtacacagaatgagttttgattttgataaatttatacacctatgtataaatatgtatatataaaaatgtatatatttaccaccataacagagacatagaaagttcctttgtgcccccttccagttaatttctatctcccataaacaaccagcattctgatttttatcacgatagaatagtttcgccttcacataacttatgtatactcttgtgtcctggctcttctgcataccatgtttctggaattcatctacattgttgtatcatactctgttttgttttatttgcttgttagtatttcattatatgaatataccacaatttgtatatccactttccacatttgggtgcttccagttttaggcaattacaaataaagtcagtataaacttgcctgtacaaatctttttgagggcattattttcattattttttggtaaataactaggaatgtaattaccaaacaatatggtaggcatatgcttaaccttagaagatactgatccaatgttccaaagtagaactatatatttacagaaagtcttgaaattaggtaatgtgagtctttcaactttattctttttctaagttttctgcaatctcatatacattttaaaataaatttgacaatttatcttaatgttagaaaaacaagatgttgatattttgatggtgattgcattgaatctacagataatttggggaaaaatgacactttagaaatactgagtattcatctataaataacggatttttctctaaggccttttaaaattttgagtggggaatcttacattcttttgttaaacttttatttaaatgtcttatatttataggctactgtaaattgattttaaaacttcattttcaaattatttgccggtactacataaatgcaatcaatttttgtatattgatcttgtgaccttcctaaatgcactgttagctctattagttgttttgtatatcccctaagagtttctaatgtaaacaatcatggtatttgtgaataaacacaatgttacttcttcctttcctatgcttatacctttaatttattttactcgtcttattgctctggctaggatctttagaacaacgctgaacagaagtagtaagaatatatatctttgccttctactatatcccaggaggaaagcattcagattttatcattaaggacggtattaattatatgttttcatagaggcccttcatcagattgaggaagtttcaatctgttctaattttctgagagttttcactgtgaatgactgtcaaattttttcaattgctttttctgcatctattgagatcatatttttcttctttattaggatgcatttacagtgatttattttcaaacgttaaactaaagttgcttttctgagataaatcctacttgatcatgaggtattatactttttactttttattgttgaagtttgtttgctaatattttgttaaagattattgtgcctagaaccatgaggaatattggcctatacttttattttcctgtaatatctgtcaggttttgctgttgggattatgcctgtctcataaatcaggaagtgttttgtttttacctcctatgttttctgaaagagtccgtgtaggattaatattatttcctccttaaatgttatatagaattctccagggaaactatctaaacctgaagttctttttttaggaatgcttttgacgacaaattcaatttctttaatcaataaaggaatattttgatttctttggtttactatgccagttttgttaatatgtttttaaataaatttacctattttatcaaagttgttgaaattattgacatgaagttttcataatattcccttgttatcctttaatattgttatgatatgtaatgataatctctcattactgatattcataatttgtatcatctcttttttcttgaacttttctgttatagcttataaattctgttaatcttttcaaatattcatgttttgctttcattaatcttctttgtagtttgtttttatttcacagttttctgcctttgttatttgttttctttttttactgcttttgggtttaaaatgattatactttcccactttcttaaagtggaaacctacgctattgatcttaaacctttcttcttccttctaatttaggattaaaagctcaaaatttctgctaagcttctctctggctcatattataaatgtcaatatattgtattttcatttaatcagtttcataaatttcaatatactgcataacttaatttaattattttaaaatttcatgactttcaaccatgaggtattaagtttgttgtgtagtttccaactggtcttttctagatattttattgttttctttttttatttctaatttaattaattataaacaagaagcatattttgtagtatctcaatcttttgaaaatgtttgaaactcatttgatgaaccagattagggtctactttaataaataaagtagaacatacatacaggactctattcctgtatgttttaaatatgttttaaagaacacatattctccaggtgggaatagaacacattctccaagtgggaatagtgttctgtaaacatcaaacaggtcaaggcagttgatggtgtttttaatttcttgtgtattcttactgattttctgcctatttgttctatcaagttctagaacaagaatgttaaaatctccaattgttattgtagattttactatttctctctagttttctgtcagtttgtgtctacatgtttatgacttatgcattcatgataatttcacacatatgattaggaaatatccctccttatctctaatagtactccttggcataaagtctattctttgtaatattaatattccaacctagctttctcatgcttattgtttgcattgtatatatctttctatcttttcactctcaagatatccatgttattacatttaaagtgtattcctgtagacagcatatgttgactcttgcctttttattcagcctaatactctctcttttaattgtagtatttataccatttacagtgaatggaattattgctacaattaagtttaggtctaccatttatttcattatatgcttttgatttttttcttttgggtttttgtcattgttattcttctgttttcctttcctttttttttttttttttttttgagacggagtctcgctttgtcgcccaggccagactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttcctttccttttttaatgagttaaactgatcaattatttttccattcaattgcacaactggctttttagctgtaccttttttgttattttttagcagttgttctaaggattacaatatgcctctttaattatcactgtttacacagagttaatattttaccactttatgcaaatgtgagtatcttataagtataatttcatttactgccacccagtactttgtagtatttttacatacttcatatctgcaagtactatagactcatgagaaaatactataatttatgcattagtcagtttttcttttaaagaaattaaaagaataaaaggatattcttttacatgtaaatagatactttaaaatttttagtgaaaattttctgtaaaaacaagtttctatcttggttcatagtgtcatttcccttcaccctgaagcactcactgcctttcacactacttataggaattccactgacaacagaaaattcatttcttcattattgcaagatcacattgctctacataaaattctggttttgcagttgtttttcttttcaatcattaagaaatggcattacatttagtatgaggaatgagtcgatgtttgattattcccctgtaggtgatctattgtttccacccttagggctgcctttgagatttttctttgtatctttggtgtacagaagtttgaatacagtgcctacatgtgattttctttgcatatttttgtgttttttctcagcaaattttggacattttcagctatgatttcctcaaatatcatttctgtcccattttctcatctgccacccacaatctgctgttaagattctccaacaaatcattttttatttcagattctgtactttaacctttggttctttttagtaatttcatttcttttttcttcttctgagacatgcaaagtatagtggactggttgatattgttgtacagatcactctgcacatttttgaatcctttttctctctgttctttacattaataatttctattgacctgtattcaagtttactgacactttcttctgccatctacaatctattgttaagccacttcaatgactcttcaaaaaaatttcaggtattataccttaactttttacttatttttgaaaattttcatttctctgcttattttctcatctgttccctcattatgactatatatatacatatatttttagagacagggtctcactctgttgcccaggctagagtgcagtggagcaatctcggctcactgcaacctccacctcctgggttcaagctatctattctcatgcctcagccttctgagtagctgggattataagcatacgccaccacatctggtggattataggcgtgagctaccgcaccgggcctgaaaacatatttttttaaaatcctgaatatatttataatttctgctttaaagtccttgtctacaacttctgaatcatcgaggaatctatttccatggactttaaaaaaaaattacatgtcacatttttctgtatccatcactggtaatttttgaattacagttgaacattgtgcatgatatttatacaaactctgggtttggttatctttctctaatgcaatgcatttttcttctagcaggttattaaattactagtcgaccactttgatttgaagaggactggttttattatttgacagaaactttcaatgcttcaggtttgtctctctttctataattaatttcttagttcttagctatcatctatatttctaaggtttgatccttctgggattcataaagcctgagacatttaccaaacccttctaactttgtaaactcaaactcctaactttgtctcctcttcatctaatgtatctgttcagctcttttagctttctagttgttgcttttctccaggcacttataggctcccacatacatgcacagtttatatcagccagaatgttagggtaacttatatgtagattcatgggagccttccctcgatggctccatcctttctaatacttccttcctcaatttcagctactttgccaatgccagctccattcgctaacatcacaaaccaataagattgtggttttctgcctgaattctaacttctctataccatacagactgggaagttccttgagggaagaagctgtaacaaacgtgaattttacccgggacagttcactccagattccaactgcttttggtcactctccggtgccttcaaataattgtggtgttttttttttaagtttttaattggagtttagttttatttttaacccataccatggtttggaactgttatctgtggaaatatttgtcctgaaacagtacaagttactcctttattaccaaaatcacaactaccaaaattgtggttttatgttagatagcacttgaactgatatggaaaactgcattagaatcaaagtgtctatagggcttcctctctcaatattcagtattttaaaattgagacaagactattttttaaccttaaaaaaatcactcatagtgccctaggaaagtgctatatattccactcagtcgctaaatatggccaatgaatatttctataattaaatttagcagaataatctgtgaataaaatgaaacagacctgtatgtaaagaaaactaccttaatgaacttgcttgggagatcagtggtatgtgatatttctaatcatgacagagaagttgaacatgtggtacagttgtgtagggaaaatggataactcttatcttcattattttttaagtcattctaagagaagcatttgctaagtagtttatatatatgaacttatataattttcataacaatttttaaaaatagtattgtaacattattttgtagatcacaaaactacaaagtatcccaggccatcagactccagagttaaattccaaccattccctctaactacctgctcagaattgagataaaactcatccacagcagtcatcattttttctaagaatatacatcacctattaatgttctttcccatctcccatgttaacaactttcttcctctatcatgtaaacttgctctctatcatctccgtgcctttcttgttcattttcatggagcagccataaaatggagaataacaattgaagcagtgaatagccaagaagcatctctcaatcaatgaacctgagacagcctgttcacttctgtccatcattcttgtcctttagatctcagtttcaaattcatttcttctagacattcatctcttcccatgtttaatctggaaccatctacccttccaccagaccaattatcctggcaaattaatgtaatagaccagtattaattatttgcttgtatgtcttaacaacattctaggtgctgtgccaaaaacaaatgaatagcaacacaaggtcttctggttacaagcacattacattttggttggggagattttgacccatctcacagtcataatcttcatccaggttatctcgtcaacctctatgtatgcatatattccaatattttgttttgcttttctttcttccttgtagtaatttcacacagactattcgcttcaagaacctaactaacttcctgttggtacccaatcctttaactctagagggtcaaatggagccctgtggctcctggcagtgttcctgaagatcaggtccctctggtggaactcagttctcactgccttatctaaccttcctcactcagcttgtaatcaacttaacttttaaagtctttgtacacattaggtaatatttgttctctgaactcccagaggggctgtggtaactgcccaactaggaagccctacccttcattattcagcaacagcttgaagaatattctaattctaactttccgccctctgacagaccagctgcatcaaaggctgtgttcccctgtttgtttttttcctgaagcagagtcaccatttcaaactaagtaatctatgagaaaagtaagagctctgggtccaaatgtttaaaacatggctcttctgtgaaccacggcaaatctaaactggattatgccttatgctggagtcagaacttacttggtcccttgttctttgccctctggctccctgcatgctgttcaggggaagttactggcttttgaactggcggtttgaaaacgaaggcatttttcttttagggagaacagtctttcagtgatttaaacaacaagccttgtgatcaaaataattcataaaggaaaagatttatgaagtgacttcactagcacacaatgcattttaaaaactttgttttttaaataaatctgtcagtacagaagccaagacaacacatctgaatgcaatatcagtggacacaccctgaatctcttcttctttgcttgtccaagactgtggtagaaaagggaaatgattctctttgtcttttcttatttaatattattattaaaaattttttaaaaattctagttccatgaaaagactttgaaaaattgtgcctacttttgtttcctgcaggaaaacctgccttgtaaaaatgtattttccattgaccacttgtgcttgtttaagaaaataaaaaataaataaagaactccaacttataatgaatacctctggcattagggagcctgttctaatctccctttatcaagtttgagtgatagttctgctcaacgagtattgacagggccgtcctgtttctcaggctttcgtttccctcggttggagaaggatacagtgcattttcacattctcaaagtctgcagttgtttttatataagaagcaatttgcttgggtcacgtcaggtcgaatgggatgcctgcccagctcttggttttaaaggaaaaacatacagaaagacacaaaaacacagcagtttccttcattaaattccactctacctgccatgggcttctagccacaatggaatttcccaccctggcctagcctagcctaacttttatttttagggattttttttcccctttaaatcttatgagctttctttcaagtgaactttgaggtaaggattattaaatgatagagtaattgcctggttaaaaaagaatcagacataaaaaacaaatgcctagtgaccttccataatatcgctggataaccaccccctggataacagcctttcaaaaactgttcataatcagcacaacaagacaggtcatgtaatttaaaattaaaacctgaatcatttaatgaatagggatcagcatttttttcaatagtaccctcttcttacctaattgcattggatgaagataattttggagaagaaaatgaataaatgaaaacacaaggaactagataaatagatggggcgggtggatggggggtggagagagagacagcaagtgagagagagaagcttttggacctctctctccaaaaagccatttatgcttttccccattgcctaggggcaactgatttaatcaggattgttcatgtggattatctaaactatgaaaagcaacagggagcacttcccaagaaatccagactgggtgtgctgcagaatacttggtttggggcctggagctaagtagactgttcacattgtactcagggtcctaagaaaagtggctcagtgtctctgtaattctttgtccctttgatctacctcaacatttggtgtctcttggcattaggaaagctcacgaaaatgaccctgcctagttaacagattcatagtctgggcacacaaaaaaagggtaagaaagaaaaaaagctttggtaatgagggagagaaacgtaccttcttgctatctttgctgggcataaataaaaatcgaaagatgtgatttttggagatgtgaatcccgttcttcccatatttagtaatagccttttcagagccaattcaagaccttctatcaaccacctctgttaaacatatcaagttagatttctcattcattattttcaagctggattttgcataatcttccttcaaatgaagaagtttacttttcgaacatgtcatttgctcttagcactgttgttctccttcacccattttggcttcttatcctcaaatccctgattccttattaaagtggattgttaatgcagccattctttagcaccacagcacatttataaatcaaaaattagtttactctgcctggcttccaaaaccatttgctgcttgaaaccatttcatgagtttgtctactcatgtgaataaataaaaacttgcctataatgtgactttgggaaaggaaagagcaactatatgaaacgaattctacagaggccaaaattattttcacgagtttcatggattcagcccttgcatgtgccattctacattaactttatctctgagattaggattttgcttctctttttttttttaattatactttaagttttaggctacatgtgcacattgtgcaggttagttacatatgtatacatgtgccatgctggtgcactgcacccactaactcgtcatctagccttaggtatatctcccaatgctatccctcccccctccccccaccccaccacagtccccagagtgtggtattccccttcatgtgtccatgtgatctcattgttcaattcccacctatgagtgagaatatacggtgtttggttttttgttcttgcgatagtttactgagaatgatgatttccaatttcatccatgtccctacaaaggatacgaactcatcattttttatggctgcatagtattccatggtgtatatatgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactcacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccatgagtaggttgtgaaaattttctcccatgttgtaggttgcctgttcactctgatggtagtttcttttgctgtgcagaagctctttagtttaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacacaattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactatgcttcataagtgaaggagaaataaaatactttacagacaagcaaatgctgagagattttgtcaccaccaagcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaatccacacataacaatattaactttaaatgtaaatggactaaattctccaattaaaagacacagactggcaagttggataaagagtcaagacccatcagtgtgctatattcaggaaacccatctcacgtgcagagacacacataggctcaaaataaaaggatggaggaagatctaccaagcaaatggaaaactaaaaaaggcaggggttgcaatcctagtctctgataaaacagactttaaaccaacaaagatcaaaagagataaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacaggattttgcttcttaagtagatgtcatttttctccagtaaaaccaagtggtttaccctgacatttagtagtaatttagtgatttcagagttccttctaaatctaaagtaaatgttcatgagactcatgaacttgtatctagacaattaatctgagcattttaagacttccctgaggctacatataatctctcacaaccccttgcaaaacctgagattttgaaccactgtcaagtttgtggttgccctggtaaggagtaaagcaaaatcattacttatggcaactaccacacaaacattgtagtgaactgaagtataagaaaatcactactatactttagacagaacattaggattaatgctggtaaccaaggaactaagagcctgtaaatataactggcttaagaaggagaacaggattaaacaatattggagtttagaaacaaaagtagtactgtatcaacctgtcactatgcagccagtcattacaataaaactaaccaaaggatggcggcagaaagaaataaaagtatttttgtgtacaattcttcttgaagcactacttgaattgcatctgtagggaacaggtctcataggtctattatttgcccacctccccaacacacacacacacacacacacacgtactagcctaggccgatatctactgtggtaagtttgcatctgtgagccactgagcagctgctttatatatgcagcataggatgaaagagagaaaactggggtactcatggtttttgtgtaatatcacaaagaaaagaaaacaaaaaaaggcttagagaaagttaaaggaaaatgggcagtggtacatatacagaacaagttaggattccctaggaactggtaataggactaaacttgcttaacatctatcaaaatgacttacttattccagggtcttgcatatacatagcagaagcacaattaatttttgctgaatgaataatctggaacaaggaatgtaaaataaattatccaaaaatgttgatggaatgaaacttttctgagcaaggaaaagctaaactgatggaacacaatatttatccaggtgtgcagaaaggtgccagtgcaaatagagaaaaacaaaatattcaaatacagtcgtttgccgtgtaatgacattttggtcaacaatgaaccacatatatctataccatggtggtcccatagattataatactgtatttttgctgtaccttttctatgtttagatatgtttacatatgtaaatacttaccatctactctgttacaattgcctacagtattcagttcagtaacatactgtacaggtttataaggtttatggcctaggagcaataagttatactatatagcctatatgttagtagtatataccatctaggtttgtttaagtacactctatgatgtttccacaatgatgaaattgcctaaggatgcatttctcagattgtatccccatcatcaagtgatgcatgtctagtttaattataagtcttacctaggaaagggacttaaaggctatgagctctttcaggcaaaaaggccttcaaaattttggcactcattaagtaaagtaatgaaaataaggtttataattcccttatattaaaccctctgcaattatgtgaaactatctgtacttcaaatgccatgttcctataacataacaactcagggtgtcttacacaggacagtcattaaagagtttaaggtagattaaaataatctgcattagtagagaacaaattattttgcggtattataacaattcattgaacatgagaaaaagcaaacaaacacgcttgttaataaatgttacttaacagacatcacactgacatttcttagtgactgactgccatggaagctttctaataagtctaatttttcccacgctctgagtttataagatagcaatattgtagctttgggtgtttacctttgtttatttattgggcggagttttattgcgtgcctcctccagctgtgccaatctggtaagatcaaatggaatcctttagctattgtcactatcctaaatggaccgcatgcttcctttgtcccttgcattctctgattttcgctgggggttatctatcatggctgtacatccaagtctctaatctatctcctttctcatccgtttttcctgacttatttcccttttccctttgtctatttccctgtgagaagccaaaagactgtatagttcttagtagcggtagtagtgctatctagagttggcatccaacagcaccagtgttataatacactttctacaatcaagaaatgatttgatttccttgcctcagtagaaattttacaagttaacagtggttcacctgatataaaccataatatttctatcatatcatgaaagaattctaaaaaatctgttagactttcttctacaagtttgcctatttcctctgaatacagttaattcacctggcaacaaaggagattagctatttctttttgtatgcagacagaaagaagtgtgatctttctttgccaataaaaacttctagtaagtggtgatagacttcaaaacccttctttttatttgaaaatcatggttcagttatcaggaattccaaattcagaatctaagaacagtgatcctatatagtcttgtgattttgcacatgctagggattggtaagttgctgaagacttcttaaataagagaggaagcatttttcttttcacttgcaaagaaccaggaggtacattaaaagaggttttagagtaactagaatgtgtgataaactgttcactttctgttttaaaactgtccatgaggttccctttagagataggacagactacagagaacgtggtgtctcgtttctatgggttgaaattccacagaacaatgctttgcaaagagtcataccaccagttccttttcctgtgagatgcaaatactaaaaacagatatgggctggacaagattattttaaaaatagatagaaggcaataaaagctttggtgatattctagattacatatgaaatgtgtaaaagcgtaaaatgaaaagttctctactttttaaaagctgcatcaaaatttccttcctacactgtaatcgtgccccttaacccatctatgcctgaggttgcaatttctttgaatttctgcaatcagaccatggcgatgaccttgagcagtaggatataaataactcctccatgcttagcgttccaataatggaacactaggcataaatgggataaaacacaaattgctaggttcatgataaacagagcacatctgtaaacaaaataacttttaaaaaatatgcctacatatataattttattacttctagaaacacaagtgttattagacttaaagagagccagtgaattgaatcaacttattctgatatgaacctcaatgtgatctgattgcaggctgcaatgattaacacgttttaaaagaaatgggtccatactatactttccaactgcccacccttctgttcttcttatgctacagatttatggcagcctaacctccagccaacaagttagagaattgggtaagacatcattttggctttttaagaaaattatggataatcaaaaaacatgacacaaaagatttagtggctattatcagggtataaactaataactaaaggcatttatgtgttaggtaataatgatgcttagaaaattataaatatcaagatgctctttcaacaactatattccagatttaggaattttgtagaggatatggcataagagtgttaagaaatgtatacttttttgaaaataaaataaagtctgatttatttattatccaagttcctgtgttttctgggaaaaatgtattaatgagaggtagcattatttgatagttaatggagagtggaaatcatctgttacaggcccacatgctcacaagcaaaataatattctctcaatcctcaaatggaaatggggattataaaatgctataagactctgtcaacatttctgataaattccatgaaaattttgtgttacatattttaaaaattgtgtactatgattataacatagttgattattaaatatgtaatcctttctttcagattattcttcttccttaaatgtaaagggtatattattttcttgatttattcttttggataaatatcctgtacatagatgtctgaaatccagcccgtcagtttccctttaaattctagcatattttaaaggaccttaaaagatgactgtggagtactgcctgatttggaacttgcctctgtctcttacacactgtatgacgttgggcaagccacttaacttctcagtacttcagtttcatcatcagtcagaacagcacaataatagtaccctgctcctatggttactatgaggattagtgggtttcatactgtcaataataagttgcctttctgggtctttgaagtacttgaaatcaggttaattaaattaagcagagctttggtccctttgtttgacaagtaatctccaattttcatttccaggttctgatcccctaaaatcagtggaataaaaccttgtttgtgtaactgccatcttcctgccccaaagccaagattaatttacctgttggttttagttttcactaggtctctctttagctaggtgcttctaagggtaaaatatcaactattaaactatttgaggcaggagatgttgaaaggggaatttaattgttaagtcaatagcagtgtgccagcttagtctgcctttcagaaagatcaccatagtaataacgagaccaataaataaataaaaagtataaaatatacatctatgcagaatcttagaaccctttctctaacacataagtcattaaaggaagctctgaggtctgcctatgtgattcaacatttacacacatcatagttctatggaagaaattctcagttgagagctaccagctttcttcagatcggatcagatttttctatactccattataaacaacaaaaacaaaagcaaacaagtgaacaacaacaacaaaactgtagttgtggttcactccagtaatatatactaccaattcagtggttcttaactgggggacaattttgccacccccttccccaccaggggagaactggcaacatctggagacaattttgataatccaaactgaggggtgctccaatggggagaggtcagaaataccactaaacatcctacagtgcacagaacagacatctaccctgcatcccggcaaagaattatctactccaaagtatcatagtgccactgttgaaaaaccctgtgctaaactaacatctgagagccactggccttaaaccatcagccacatcaacacgtaagacactcagcctatgggatagtctaacagttaaagaagacaccttagagggaactacttcaaaaatatataaactgacaaatctggataccatactaaggaaaaaactggtaaaacaggtagttgtttgaaagcttcttatgcccattattataaaccaataattttagattactgaaccaaccagactaatattccctttgaattccaggaggtataaaaatatgaagtcatcgactatgcaacattatcctgctatggagacattctgaaatggtttataaaagcagtgaacacattaaaaaaaaaaaaactagcccaaatgagttatgcaaagttaaagtcattttttctaggaccagttttttttcctgtgcatagtattttccatatgtaccgcaaacattcatttgtgcagaacatagcaccacatttctaatacaactcctctctgaagacaaatcaggctaaagctaagagttgcagaaccatttctgtatgagtcatttttagcacaacataagccctagagtaaaatttattttctaaataagccacaattattctgcaaacatttaacctagcacctctcaactgttaaagaatgtcaattatatatgaaaggaagaacaaatataaaggaaatttgaaaatcaagaaaattttttctgagaaaagtttgtgagaattattatgaatacagctaaaattcaaatatgtgacattttatttttttaagggtttccctgtcaaagacaacacatatttttctaatgaaagaggatgcctgaagttgacattcataagagcatttggatactaccaatgtgaagttgtacagatttactcatttctgcaattaccctcttgtgtttgaattctactttggttagtggtagcaagcactaaactgtactgagggcttcgcaaaagttgactttatttctttacacttagaaccccaaaaatttacttcctaggaagatactagggaatcatatcttactgaggaggaaataagaggtggaataactggattagcctcacaaagaatgaaagctcagtaatttctgagttggcaatatttttcaccctccttttctccatttaaatttctagatttaccttcaaaacacttgcctttttctaccttaagggaagttctaggatcagggagatggagatagagaaggtagagatagttttaggttttcacagaagttcaattaaaaactgccaagtacctcctaccaagagaccaccactaaaatttatttctagaacaaggtgcagaaaaataaaaggtagaaagcaggaatgttctggtactgtaaaatatttggggaaaaagtctaatttctgttctcaaaatggttactatcttgctctagagaaaaacataaaccctcttaaaataactgaagaacaataagaaacagtataattaagtgtaaaaatgggtggtagaagcaaaatgctgtggggcacccatgtgtcttacatctttccaacacagagaaaagagacaatgggtcaaatgcagcctactctagtctctgatattagtttcattacacagctataatcccattacaaagaacttgaaggaactgttgacattttttgctgccctggagtttattgtctcaagtattgcttgaaataccagggtacatgcagagatgtctgctctaatggtatttgttgacctacattatgttagggttagcctgaataaatggagaggaacgctacatggaatcagttagttagattgtttgtaagtaggcgtgcattatttttaccatgttttattatttttaacctaaagactacgcatttaaagtagggtattatctgtaagtaatcttgttgttatatgaaacagtaatatttattaaaagtgcttttgtaaagcccaaaaaggggatctgcagaggcagatttactgcatatttaatggagcttaaacctcagggaccttcacttgcgcagccccccttccaaggtcctgtacttaactctgtaatcataattttgtattctttttcttcaagaggaccccccaaatagtttaagcttctggtaaaatcttgatctagcctaggtataaaataatcttgaagggatccaaactgatagttctaaaaggctgatgctgagaaagatacaaaatgtgcttttacaaggatatcatatcaattatattttccaaatgtatctctcttattgttgtcgctcccccttccctgccaataaataaatgccattttttttttttacctcactgttaaaaggttattagacccttttaaataagatcggtctgttcagtgactgggaataaccagagtgttaaaaaaaagatgaaaaattcagaggcagaagataatttccaagaatgaaaagatatcttagagagactcacaaaatgtttcactaaaacagcaataattattatccatacctaaggagtacatgcatttgagaaaaggaagggcatggaaagtctctcaatacaatttacagtagtacctactgaaaactgtgctgagtttacacagagtgtgggaatttttaccaccagtaacaccacgtgtctgtttttctggtttctgaaaaccccaaataaatcccacaagcgcctctaaactccaccatggaattctcacacttctgagtaagaagttcagaacagaataaaaactttggatgcagtatgtctgtctatagtttttcctataatgccttgtcccagtttttgaagaaaactgaataaaaattaattcaagaaaaaaaatgaatgaaattacctcaaatggaatattaaattgaaaaataatagtcaaattgctcataaccacttcctgttaattttttttctcttttagaaatggagtaagaatgcttcaaataaaaaacgtaaaacccatcccatcccataaagggcccactcacgtaaacaggaagcttattaaaagaacttttcttggtttcctggcaaaatccagcttttattttggtggcagcatctattaaggaggagactcattttgtgggcaggatgaaaaattaaacattgcaaatccatcaggtacttgctggattagagttagttgactgacttgttggctacagggaacaaggtagttctgaaaccaaggaacaagctgccaaggaacagtccagccctgcccaaaagatgatggtcttctccatccaggcagcacaaatcaactcgaggttccaagagggccagtagacgccagcctaccttactgtaaagtgtctcacatgcatatctaactgttctctcctttcctttacatttaaatcctgttgtattggcttctctgttttccctttcctggaagcgctgtagcgtaattaaaagagtatgagttttggaatttcaaaacttggtttatagtccagcctctgccaaatactgtgacatgttacctgcttgagccatcattttctgatatgtagattgggactaacaattcttccttaatcagctcaagtttcacaaaatatgggtaaacatcacgtgactcaaaatcaactgaggcaaaaattcagatgtcaatggccctttcttgacttattagaacctccatgagctagaaattcttggaatctgaattttaaactcactcccaagtgatttccatacacacagaagtttgagaaccacatcccaccttgtcttgtgtcaggattaaataaaaccatataggtgaaacttatctgtaaattgcatatcaagacatgcttagctgctctcaatagtatcattttccagatagcccaaagcaccaaagtaaggacagcgggccattttcccaagatctttcttccagcttttccctgccatgccaacagcattcttcatcttcaggtaggcagggcaggttcactgggggttggggtagagctcagcactgtgacacaggcagtacttccgtagaatttcatttatgtgactgtacctaccccacagggtgatataaggattaattcctatttggtaatttactgtgtgtaaaatgccttgagccccttggaggaaagtgctatataaatgtaaaataattattataataataataacctcgactatttaactgatcagtgaattagccagaagatttaggctgccaagggacaaggctgaaaccattataagtagaaacactttacatcatcatatctcaaactgttatcacgaaaaagggaaacaaagggtgaaaattaagataaatccatgttctcaactgatttaaatgacagaggatcactagtaatgattcatgaaagccaggaaatgcaaaaatgacagctgcattgtaattctaactcagccacatgtcctgaggttttgtacactttggtcttttatttgtagggaaaatatctcatcagtgcaacatctaaaatttagcattatgaaggcacttgactatgcttttgcttagttgaaatacgttcataatgtatcccctatttgtaggtaatgatttttctacctaaaaagcattgacattattctatgaagttccaggtaaattttgaatcggttgcttacaatctgcctccccacatacacaccctaagaatacactctaacaaaacaatggtgtatttctagatctaaatttaggaaaccaaaatatatagaagataccttttcttcccaggaagaaaatgctttggtatataaactcacatgagctcaaccgtcttcagctcttacattatttgttttatttatttattagattcatgaagattcttctaccaaaagctcaaggggctgaacccagaactttcatatattgaatgtgaatcacttcttaaaccacagaaaggaaaataaagggctatagaaatcttaatgggcaagctccagatgctcaaaagcaattgtttagttactctacttagttatgcatcattcaaaacactttctaacaatcgggcaagaaaggttcctttgtgaagaacaggctttggggtcttggacaagttttaattctagttgttttatagctcatacaaaatagttgtggtgcatatgtaaagaggtactgtacttacatgcaataaagtttgcagatgaatattttgaaaatcaaagaaaagaaaacaaggggaggaatgagcatgtggtaccttgctctatttttaattattaacttgtagcctcaaagatttccatttagtagaaacacatgtaaactacaatgaaggagtactagaaaataaagtcaattggtataactcaaattattttgtaaaatgtgaaattaagctttaacctgtctatgtggaagggtgatgaataaatgaatgaatgaagtaaaaaatcaaagatacagagttgtaactgattttctttgcatgaagtagtaaatattaatattagaaatatcttttgatttagataaaactggccttgggtatataatacacaacactgaaaaacatttcaaatgtggtatttgtttaaatatatacatacataaacacacacatacacacacaagtcaaaaatatgggtgttctggtatagttttctgccttcaaagggtctctggaaaaaacagaagaaaaggtatcctataaactgcttttgctgaggtctctagtagagagcaaatcgaggcaagtgctgcccaaaataatctctattacaaacatttaaaaaatctatctttcatatatatatatgaatatatattatatatattatatatatacacaatatttttaatttttaattttattttatttgctgtatagctaacagcatagccaatgccctgatcttctagccacactgtaatttcttgtccttgcatcacaaccccagctgtagtcatcaaagtggaaaaactgacagcattgtctgaaagacacagcttgggaaaattgctccttgtagctcccctgtcaatgaatattatcatatttttctcatggataaggttactgtgttttttttgctgggccgggggtggggaggcttctacatacttagctactaagcacattaccattccgtttgtggaatggactaaacgtgacaatgcgagctgtagggttagcattcccaacattctgttttaaagtttttgtgtgtatatcttcaaaaataatattcctttatgtattcagaagaagtaaaatcacaattatattttacttgacattactattttcttaaggaggctaacagaaaaatcaatgggtgggcataaagagaaagaaatcatatgaggctaccacacatattctgttactgaatttctttcacctaaatatacaatggaatgctctgaattgtatgttttcttttcccatcatattaaactaaagcaaagttcttgggctgaaagtagaaaaactgcactttagtgttctaatgatccacacctttcacatattcacttcgcttacaattctagatgctaactcaataagaaagaaagaaacaaattcagagtatttcagtcaccaacaacaacagcagtaacaataacaataatattaatatcagttaatatttatttaactcttagatatactagatgccattgtaatcacatgtattaactcgctaaatcttcacaactctaccagagagtactgttattactccgattttattggtgaggaaatagaggcacagagagatcagaaacttgcccaagatcacacagtcagtaagtagaggagtcaggattcaaacctaggaagccagactctgttacaggatgaatattttggttgctaaaggccccatcttccttacttctcctgatcctcttccccaactgatcagcttgcagcattcatttgatcttctcaacaaattacgtattcatttgcacaccgtccatttagaataacacagtagttaaaaacttaggctctggagtctaatatgagggtttactgccacatattggtagtgcttaacttttctgtgcctcagtttccttctgtataaagtagtaataataaaagcaatttcatgtatttgttgtgagggttaaatgagataatgtatgttggagctcaatggaaggtcaatgttctataaacattaagttcattattattgatttttatctcttaataaatagaatccctttttccaattagattgtttttcagaaaaattgtgaatatgaatcttttttgtctcgtgtaggggttcccaaatgttcagtatgttgaactcttagatgtcctaggtactactgaaatcacgtgtattaacattcataacaactctgtcaggtaatacttacatttacccataatattataaatgatataatataccaatgtctaaaatttagtgagaacttactcactggacaagtgcattatggcattatctcattctccctctaagcctctgaactaggggatttttttttttttttttttttggagatggagtgtcactctgtcgccaggctggagtgcagtggcacgatctgggctcactgcaatgtccgactccctggttcaagcgattctcctgcctcagcctcctgagtagctgggattacaggtgtgcaacaccacgcccagctaatttttgtatctttagtagagacggggtttcaccctgttggccaggatggtcttgatctcctgacctcgtgatgcctgcctcggcctcccaaagtgctgggattacaggtgtgagccactgtgcccagccaactaggggatttttataatctcaagtttatgcaggaggaaacagaagctcacctcggtcatcagctggtaaatgttcacaaatgtaaattcttaaccacaatgccatactacctgctaaaaaatgaatttaaggtagatctttagtaaatatatttggtcttgatgatgaatcaattgaattctttatttctgttaccagaaaccttgcacttaacaataaactaatgtggccttgaccagcagccgccagtccccaggcttcagacactggtacctgttaggaacttagctgtacgggaggagatgaacagtggacaagcaagcattactgcctgagctctgcctactgtcagatcagcagcagcattagattctcattggagcacaaaccctactgtgaactgtgtatgcgagggattgagtctgcacactccttatgagaatctaatgcctgatgatctgaggtggaacagtttcatcctgaaaccatccccacacctccagtccatggaaacattgtcttccatgaaactggtccctggtggcaaaaacgttggtggctgctggcccagacaatatcactcattctgttaactattgaaaagagatgactgtatgtcaggtacatgccaaatactggaaatttgaaaaatatatatatatacattgtgggtctaaaactgtatcattaaaagcagctaatgatttaatatcatttcatttactatcattttctgtttactcttacaaaaatcaaacttcttcctctccccttcctctctctgcctactctttcttattccttcttttaaatcaaagttttacagtattaaccttacaaagatttttgcccataagaaggttatatgttaaggcaaggaactgttttaattatatttactcttcattttgagtatatttctttttcatacctgacaaagacttttgaaatgactaaagaaaggcaaagcaatctgattctttataaaaaaatctttcatatgcaatcttttgtctgtagtattctcataatagcttagaaattttaaaagaaggttttagctggttttgttcttttcaaattggcagaatttgatttttttcctcttcacatttggattcactttaaaaatcaacaaacaagaaaataaaaacatattcaatttaaaaaatatgctctccattggtgccttggcatcatcaaccaatatcagcatcactctgaaaaccatttctattctgtttttaaaaaaaagagttttaaaatgcacacataaaatgcacttaaaattgatcctactgtattaaggagagagaaaatttaagggcaatggagagctttgctgtaaccaactcttcagtcaactataggatattgttaatactgccttcacctccacactgaagatataggtaccattttgactgtgcttttgaacaatatatagctaaagatttgaagtgagtaacttcaaagtcagtagttttcatgtatacgtcgcagaatcactgcatcttatgtatgactttaagttgtattaagctgataatttcaaaaagagagactttcaatgaaagaaaattcctgaaatttggtcattaaatggttcgagtacgtagaattacttacaatgtaatgccaaagaaaggtatattgtatttatccagaaagcacgagcataagaatgacctcagaaagttattataatttattacttcattaaagatacatttctagtccatctattatgtgctaggccttataatagacaacaaaaatgcaaagaacaacaaatgtgatctgaaaagtagtaaaggttagggaagatgggactagtaagagagaacagaagtaagaaaataaagtgattataattgtaactgccatgagctgagggcatatcatgcattgaggtaaggtcctaggtgcttaatatgaacaagccctgcaagacaggtatcataatctttgtctcacaggtggtgttgggaaaactggctagtcatatgcagaaaaatgaaactggaccccttccttacaccttatacaaaaattaattcaagatggattaaagacttaaatgtaagacctaaaaccataaaaaccctagaagaaaacctaggcaataccattcaggacacaggcatgggcaaagacttcatgactaaaacaccaaaggcaatggcaacaaaaacccaaaattgacaaatgggatctaattaaactaaagagctcctgcacagcaaaagaaactatcatcagagtaaacaggcaacctacaaaatgggagaaaatgtttgccatctatccatgtgacaaagggctaatatctagaatctacaaggaacttaaacaaatttacaagaataaaacaaataaccccatcaaaaagtgggcaaagatatgaacagacacgtctcaaaagaagataattatgcggccaaaaaacatatgaaaaaaacctcatcatcactggtcaatagagaaatgcaaatcaaaatcacaataagatactatctcacgccagttagaatggcaatcattaaaaagtcaggaaacaacagatgctggaaaggatggggagaaataggaatgcttttacactgtttgtgggaatgtaaatatagttcaatgattgtggaagatagtgtggtgattcctcaaggatctagaatcagaaataccatttgacccagcaatcccattactgggtatatacccaaaaaaattataaatcattctactataaagactcatgcacacatatgtttattgcagcactattcacaatgtcaaaaacttggaaccgacccaaatgcccatcaatgattgactggataaagaaaatgtagcacatatacacatggaatactatgcagccataaaaaaggatgacatcatgtcccttgcagggacatggatgaagctggaaaccatcattctcagcaaactaacacaggaacagaaaaccaaacaccacatgttctcactcatacatgggagctgaacaatgagaatacatgaacacagcgaggggaacattacacaccagggcctatctgggggtctacggctaggggagggatagcattaggacaaatacctaatgtagatgttgggttgatgggtgcagcaaaccaccatggcatgtgtatacctatgtaataaacctgtatattctgcacatgtaccccagaacttaaagtataacttaaaagtttttttaaaaaatatgtgataaaataaaaaaaagaattaaccacagtgccttgcctattcttctataacagtatctatttcactctattttattttgaagctatttatctccaagtttctttctagaatctaaacagttaacagcctgagggcattgaccttgactcttgtctaagttttacaaacaaacaaaccaaaaagcacactgcattgatatacttggccaagtaatgatgtccaaatgctacaatgtcacaaccagtgctcagtaactattagataaataagatagagtcattcactcaatcattcactcctgcatgtttcacttagtaatcttgtacgctcattgaataaattaaaagctgctttatgaaaatgttttctgttaatttgaataaaaacctttacacatcaactagatacaaaagagaaatctattgtttgacaatgatcgttactgaatcaaaaaacagtggggccatctgcagggtacagatcatgctagagtcagggaaaactggtgataaacttcagaaagccaagaaatataccagcttacaacttagcagcactgcctccacacagtcttcaggtatttattgactgtctcacactaatgcatgagtgcctgtggtaatggtaaaagtatataaatttacttgcccagagatactaattgttaaaacaaatacaacaatttaatggcaatgcaagagaagacagactaacatttacaaagctatttcttgtttaggcaagatagtagactctaaacatatattatctcatttaaattatcatttaaaaacccttagattgttagtatttacccattttaattaaaaacataactgagcgtataatttttttttttttttttttgagacggagtctcactccgtaacccagattgcagtgcagtggtgcgatcttggctcactgcaacctccgtctcccgggtttaagcgatccttctgccttagcctccaaagtagctgggactattaggcgtgtgccaccacgcccggttaatttttgtattgttagtagagttggggttttgccatgttggctaggctggtctcaaactcctgacttcaggtgatccacctcccttggcctcccaaagtgctgggattacaggcgtgagccaccacgcccagcctgtaaatcttgacaaaattcccagaggcaaaattattagaaggctgggagccaggattaaaaaacataaaatccttggcttttccatttatttcacattgcctcttcttagaatccacttctacaccaaagcagttaaaatcaatgtggatttgtattttaatagagggtttatggagtagtgggaaagatagcaaataataactatgtttattgaatactactgttcctaacattttgaacctatccaatcatttaatcctacaacaatcttttggaagtgagtgctattattattattgccactttgtaacagagaaactaagccaaaaagaagataaacatttgaaaagtcataaagctagttagccgctgtgcagctgaacttgacagcctatagcccacagagtttaaccatcatgctatattgcttcattaggttgaaaggttattaaatgaaatggcttaaacaaagttctaagcacatggcatggcacagagtaggtcttcattaaatgttagtttctgttttttctttaatctctaaaattctataataataatacctttattttcaaagtaattctgctttttaaagactttatgacatctgatttaaatttcacaaaaaaaggatggtgaatgtggaataaatcttcacaaaaatgacactgaagattatttaaaggcatagaatgttactcacaacacagatttaagagacaaaagtagaaacagtgttcacagtgttttaccaaaaacaaaaagggtatatatgcacaggaaaaaaaatgattagaaaggtatatccccaaagtttgaaaacaaattacttctagacgattgtggggattttaatcgtcctcttgtaatttatgctacgcacagaattctacaatgccttttgtatgctttctatactaagaaaaaataaaaaagaagagtagtactccttttttgagatcataatactgaggggggagaaaatcagtagaaatgtgtgagatttcaccctcagtgatagagctggaatagaattcgcactcttcatctctaacctactgtgttttatctgacccttattttctattcagtgcttaccataattgatgaattcaaaactaatctatgatgaaaacccctgaaagtgattagagagactgtgattgtaaatgtggtatcaatcactaacacaaaagtcccttataactcatcaggcttcttaagttgtttattcaaaccatttgtttctgagtccaaaccaataatatatgtgatagaccggattactttctctaattcttcactccctctctataatagaactttacatccataaactttaccatatgacttgaatgtaactctcagtagagtatgtgttaatgtgggagatgggatatatatctctgtctcttggctttgagcttggttaagtgacttgctttgactaatgaaatattagtaaacatgaaatgagcagagactttaggtattttctgcgggaacaaattctgtagttgtcaatagtttattctcctagattaaatgtttgataaacttttctaaaagaaggaatttttttttcagagagaaatatagctaacatggaatatcatgtccttttgtacttacctggagccaaagtaaactacttggaaaattaaggtaccttttgctggactattcctcatcctttagtttcttcagtccagactgggacattttggttaaaaaggagtaggcttgtgatgttaaggtgatcatcttggtcaccataccccagaaaaaatctttacatatccatgtcttagacactgaggtacagaaagagagttctgaactttccattccattgtcatttgtgttgtggagtcttattaatctgtctcatggaaggtgggaatcaggctatgaatggacaataattcatggggggcagtcaacagtagagaagaagttgctgcaaattgattaatacaaacaaaccaacctgagtacctggctcattttaggttccctccaaaggcttcagtacaggcagtaacttagaaggtaatctcagagggtaagataataataaggattgacaataataaggattggccaggatctctgagatttacacaaaatggctccagaggtagacattataaagaaatagaggctagaacatctctttttccagctctattcctcctttagttgagagtttccccagggcattaagccctgggggcttaatgtaagccccactctccccatcctagattttttgagatctcccagcattggaaaaggtcctggggcagaaggaaaagcatacttgaggtgggagtctgggttagcagagaacggcttcaggtgcagctgaagggaccatgacagcactgcctgacatctctgagggactatgacaggattctgacagccatatctgctacagaagcctgtaaagacttggggtggggggcagtggtgtataatatactgtgtagtctgatattgcatcctttaaagtatgatctggggaaggttaggctgcatcttctttattaaattatattccaaacaagttgtctcctctgactcctgcatgaagtcagactttgggacagtaaatcctacactgtccagctaagaaaaatgacatgttgttaataggcttaactgattctcttgctatgatggcaagatcagatttttagcagtgcttctgaaaatcctgacactcattcaccaattattttcttctaggagtctaatatgtattcatcttcccatatttcagggaagaaatagttgaacgactttagggagcttttcccaaaatgctgacgcatttttgcagcattttgccataatggggcctattgaaaatttttctgacattctgaattcatagcattaagatttgtggtgttgtttttgtatctggtttgtatttatttttgtttttattaaaatacaggagaaattgggacaggttaagagttgcacctaaatgtatgaagcttgaggtctttgaacataaatgagttagatatacagaaagttattaagacctttaagcattcgtaaacatttcatcattgctgacaatatctatttactttaggtaaccctgcctgagcagctcctgcattgctacaaggatgaaggtggggttatttaaaaatttaccaagctgtgaaagagttttctggagaaaactggtttggggactcagagcataaggataaacaatggatacttttatggttacaggagaggagttgataaacccctcattcctctaatgtaatgtataaaagaaaatattgtattcctggtcctcacaaatggggaggtggtagggtaggtaggttatatgaacacacatgtcttccctttgacaatgagtgggcaggcctttaaaaaaaagtctgaaaaaataaagagccctggggaccatttaggctctatcagtgagttctatcctgagatatcaaatccagttgcacagaatctaaatgtcaatatttacaaagctctttccatcttatatcccgcttcctttttcttttatgctctttctaccccttttccttcctccctattcccttgatcccctacatcattctgttttcccatttgctctcatttcctaacaacccccatccccattagtcagtccaaaatctgttcatcccgctataggcttcagtgatggaaaagaaagggccccaaacaaagccaccatccaagacaaggagctccagagggtggtgaattggtgattgaggtaaagcctggggactgagaatgttcaccgctctggaggttcttagcccgaaaagtgattaggcatcagcaggcttgatagctgtatcaagcctcatgatttcaaagctttcatgagctgacaaggacttgctaatttcaaactttctaaccaattacaatcacaaagaactcaggacaacaatcagtgagcaaaatgaaactgctggagtgaagcagccctcggcaggtttcactcttgtagctctgctacgcaatgtgcagctgggactctgcttcaataagtaaataaaaatacattataaaatacaaacatacacaatggatcccacttgctgtcttgttcccagtaaaggggtatgtaggaacgctgtcttgcattcattcagtccattaatttctgatggtgttaattaaaaacttttgatgctggtttgaatggaaaatacctcaaacagtgtttcctttattgaaacaccaagttccaagtcttggattattaggttaagctctgtcagtagtgagaccaacataaatgcttttcataccgtatgctttgacaaaagagaatagtaataataataaataaataaatgaaaaggaagaagaaataaagtgtttagactgaaaactcctttacttcaccaacctgtttttttaaggactaaactaaaaatccaggtccctgaatgtagaacatataattttaaaaaaatcttttttcaaatctttatagaacattcaaatcacccaatgttccaggacctgaattttttatattttaaaatgaagaaagctgcttaaaataagtgaatcagctgctaagtgatttctctctgtcttttcctctactctctctttaaaaagactggaaaatgcttaaaatggtatatgcaattgatatgtgcagcttaaggagcttaatataattactgaggactcagactttctatttaaaaataagatagggtagggtaacagaaactctgagtggtgagtattcatcccttgtgatggtgaggtgtgggaaatgtttccaaatgtttaatccactgagcaaggtaaagagtgcgaagcagttattcacagaatttggtgtccttctgaaaacctagggaagcctaggaaatccagagaacaactgaggaggatagtatgagagatgctgtgcaggaaacaagcaaataaaatatccatttcttcaatccaatgcttttgtgaagtattaagccaaccaccaaaacattctgattgatttttaagactcttctctaattttattttttaattactcttccctttgtgtattggggtctgaagccttgggcacccattctgagaggtcttgtaaatgtgtctcacatatgcccgtttctcttttgttttctaatatacctttctctatcatttttcatttcccaacctgtttattcacactgtctgcaatgtcatctgaatcctcgaaaaaccacaagactttctctttattccccctgaaggccttcatcactcttgttcttgttttgatctacatatctctaacgagaatgaagttctccataaaggctaagcagtttggcagaacttccttccttccctccctaaccgcaggctgtattgacctcaccctcttggatcagtttgctaaaatggcctccaaactttatgtgatatgatagtgaaccttcaacaacaacaacagcaataacaacaacaacaacaagagcaacaggataacttcagtgtaaggcatgtgagaaaaatacgcagagtaatagaactaaaactccatgagggaaatgggcctgagcaaaccacagcatgggtctttttgttaacaaaatgtatgatttttccccagagtacattgatagaggacatagcctacaaaggaccagtaaatgtaaattaactaacagatatgtagcaaatgaatgcatttaaagatgatttccagctgaaatgtttttttttttttttttctggagaccaagtttttgttaaacttaatccttactctctttcctttccagcagcagaaacatctggtcggttttagattccccttggatttccaacttcaaagggaattataaagaataacaaattcatgtaccggcactaaaaaaaaattagagcagcaggagagaatggtaaaattgtccttatttgactgctagtgacaggcgccacaggcagaactatgagaaaagacaaaggcaagatcaccagttgacaaccagagttcctgcaagagactgaatctttggctacatgcaaatatgcacagggcccttaacaatccatagggagatttacttgcttaaggaaaataaataggtaaataaataaaaggagttgaaaggtaaaaaaaaaaaaaaaaagaaagaaagaaatgagttcatgtttgcctgtcacatagtttgttgaaataataacaaataaaccaataaatgtttattgaaagaatgacctggaaataattttaaagatccacttaaccccttgggttttatttgatttaaagaaaattgtgagagttctgattctacaaagggctggataagtcatccaagaaataatacaggctcttaagagtccactaaacttggatctccaaagttcttaaaagtagtttctgtttctcctttggctccagatccttattatcaaaagatgtgacgagaaatcaaagtcttcttagtggccgggcgcggtgtctcacatctgtaatcccagtactttgggaggccaaggcaggtggatcacttgaggccaggagtttgagacaagcctggacaacatggtgaaaccctgtctctactaaaaatacaaaaattagctgggtatgatggcgcgcatctgtaatcccagctacttgggaggctaaggcacaagaatcacttgaaccggggggacggaggttgcagtgagccaagattgcaccactgcaatccagcctgggtgacaaaatgagactccatctcaaaacaacaacaaaacaacaacaacaaaaaaccaaactaactgttcagtacatgctcagtacttgggtgatgggatcatacataccccaaacctcagcatcacacaatatacccaggtaacaagcctgcacatgtatcctctgaatctaaaataaaagttgaaaaaaaaaaaaaagaaatttgtaactgtgtcaagttgtgtttgacaccactttatagaaatggatttattcttctcctctatcattttcttagcaaaactgaaacacacttctagagtgcaggtcttgatataatcagacatgagaaaatgagaacagttagagaaaatacaattttgccattgtaattacctcttacaaacagcctttcctctttcctgttttatgtgcaatgtgtacagcaacaacaataaaaataaacaaagacatgattaaccgatcaatttgtttctccaaagagagaaatagttaagggctaaagtgcctttcaataattaattataagagtctttaaacttagtattgagaggttacagatttccataccacaaatacattaggttgattcacagagtggccatcaaatacccagaaagcaaattacttttgaccgaaatgtatacatcaacagtacggttaggaatgttttcatagaggaggacagaacatacataaccagttctctatggagcctagcatagtgtcccatggaccaatccacataagataagaccatctacagagcatattcttcatatcacagactctaggtaagaagaaagtattctctaggtaagaggagaaaaataagtgaagatttctttcgttaacacttccaccatgaaaggaatgagctgactacagaaccattttcttgaatatttttgtcttgagtggggtttttatccttccttcaccactctaggtagagcagaatcaccaaagttctctcattacggtaatgtcataaatcccatcctatagcagttgtgcatgatcctgtgttatgcatccaataaagtttattcagaaaatatgtcagcttcattaaacagggatctgatgatctgaacaaaccacttatcttgcttttgtgacatgtattggtatccttaggtctaaaatgaaaatcttggttggtgggggtatctgccaaggattccctgcctcatgtaagcagaatcatctaaccacaattctgagcttaactgggggaaaggaggtggaaggtgtatcgtactagttcgttctaagaaatgtcttatagcttgaggatacgtgaggtcacaaatgtaacaacaactgaactagcaccaagagccaaagaggccaagcataaggaaacctgaagcaagagaaaaaggtgtacgcgtacatacaccaagaagcaaatgctatcattaataataattattgttattacagctattagaatgatgaggcattgatggttcacttgggtgaaatatataatacataagctagaaagaactgtgggtaaacttatggatctttttaaaaggcagtttatattctaggtttatgtgatatgagacacataatttaacaccacatataagaacaggatgctgaaaaaagtgaagaagacttgcagctttaaaatagtataatggctagttcctactggtcttttcttgtgacacctgccttagtcaagccatccgatatagttctaaccttttctgatattttaatgatgatgacaggcccagagtaaaggagacaaaataatcagaagattcagaggggaaaaagaaatggaaagaaaaaaaaagagtttgtattgtttataccatctaatctgacaaattttatatatgctctctgtttgctcaggatagtttattgctaatgttatgactttctcttttttttccatgtgctttgctctaccagttttggctgaaaatattttgtatatgtccatactgtaaaccctcatatttttctagagatttagtgtggtggggaaacttttttttcttccccaagggttaggcacatcaatattctagctactcacttttgaggccaatggaaaatgtgctcctaagattaaatagacctgagtaacacataaattcagtttatactgatgcagtatgttgcatagttacatcctgaatttctgatgcgtgtaatacacctgttggacaacacatcactactgaatagtcactgacctacaattcaaagacagtgagacagcacaagactacagatacaggttctctacagacagcctgatttgtacagagcattcctcatctgtggaactctgtgtgtaaaggatctaggctagccatgggaagctggctcatagagggttctaaatatttttagaataaactagagcaataatacaagcacagagagcaccctttgttatacaatgcataatttctttccccccaaacatgttgtttaaaaatgattcagatttttattatataattcccccttttacatatttctaaatgcctcacatacccatcacatgttttccatgtctgccaataatcttaattaaaaattataaacttttaaagccagtgttacatttgatttaagtagatttgccatatttatctggtattggttggctgtagccagactggagttctaagtaataaggggactatgctttcctttcacctcaggtaagaaattgtattcaacacatgcttaaacccaataataagtataattaatgctgtatagatctggcaggcaaattagcatcctaaatttgagtcaagtaaaaaaagtaccaaaagaaaatagttcccccaagaaacctagccaaatctgtgaaatatttctctaggcaaccaaattgccctgtggcttacagatgtgtctaagaatattaggcaactcactgatgagattttacaatcaactgttacatgttagaaaatatgatgtcaggatactatgaagaaaaatactactatatacaataataagaactatttatctgaatagtttttaacattaacgtgtaaaaaatatcctgatggatctgaaataatgatgtactaaatactacaatgtctggggtttgcttcaacataacatggtgatatagtgagaaaataacaggccatcagttagtcattgtgcaagctggtgatgagtacatgggagttcattatagtaatttgtttatattcatgaatttaagattttttatcataaaaaatttaaaaacatatactgatttgaacttttattcatttattatttgttgactgattcatttactgtttatgcaaggtattattgagatataaataataataataatgctcttattgggcatttaggttaaatgagctattcctcttcaggaatattatatatttattttaaatgtttataaggtctatgtaattacatatttcttaggttaaattttgaaagcaggacacaaaattatatagaaagtatgataacatcatgttttaaaaatatatcctcggggaaaatgagagtaaggaaatatatcaaatggttattaatgattggatttaaattatagaaataattactttaatttttcttcattttactcctatgtgtttttctaaattatttttaatgagcatgtatcattttaaaatgaaaataaatatttcttcattactggaaaagatatgttctccttccccaaggagcttttcatttactgaaacagagaaactgcaaacacacagcattgcccagatagtttaaatctccatacctagaagggaaatacacccacaggaaaagaaacgtcaatacagattttatctgatcatagaaacataaagagctttctctgtgttggacagcaatagggaagaaactggcttgtttgcaagccagcaaaagcgtgaaattcagtcctttttgtgatgagatcattttgtgataaatgcaaaaggagtgacaaattaaagtcaccaaataagcctttcccttgagctcctgaggcttactaatacgagtttcttttggggtagcatagcaagtaaagcgtgggagtggggagggaggcggagctacaatcccgaaggctcctggccttcactggtgagatggatatgctcagagagacagagatagatgtgcaacagaatcagaaacaacaacacagtgacaactatggattatgcacaatggatatggaaagtctctgttagaaaactatctttattaccccaagagattatttccctcagtttatgcacgttcatataaagcgaagtcaagagtgtaacttttaaaggtttggatgaatatgatgttcatgactaaacaggcctagatggagccaggcagaacacagttagatgccagggaagtcacccttttcctcctcctccctctccagtacagttgccagtgcatttcaatgcaggtcagcctctagcaaagtcagctgtttcaagctctgattggataatactttatctatacacccccagtcttgacctgcactcttctcccagtcatggaaatatcaagaattctagaaggccacaataccaatctttttgaaactttacaaactttacaaattttcactacaagacacctagaaaaatcttcaagcctatgcttacctgtagccctggtcttggtcctcttacttaactggtaaaagaggatagccttatttatgtctttgaagggtattttccttttttgcttgttggtaagtacaagagcaaccatgtctaattttaagattgatccaaatgaagcaaatgcatttcaaatttacagaataccatagaatactaatgggtagttcaaagtatcactaaatgtgtttggagggttttgagttttttcaaaacatacaatgttccacacaggaaacatcagtgccaacttcaccctatcactctttctgtccactcaggagtctcctttggaaatatatctctctggagggtcttccaaacaaatcctttgaatacttccatcttgtttagcagagtattctaaaatatttgtcaaaatctgtgataataggttctggagatcatgtttcttattcttctaaatgctggtatttcaaatgaacaaataggatattaaagatctgtcctttaccaatgtcaaaatatgttctgtcaaaatttagtattgctaaagtttagacccaaagactcaccacagcctttggatctcatattttctgaggttcatggaaagatatttgacttctttgcacctcaatattttggactgccatttagagataatgagagttacttaccagacagcaatgtcatgaggaatatcctgttagtaatgatgaaacattctgaaataaaaagagtacaggtaagtgctaggtatttattttaataaatgtatgataacatggtaatcatagaaaataacccatttattcctcactttgggatactgactaagtggtagtatataaaaagtaaaggatgtttccctttgggaatggaaatagaattgtgcactaagaaagtatcttttgtaactgcctgcatgtttaactttaaggtctctaaccagttgcaaccagttatgaatgacttgctgcccatttctgcaattcactgtaacttgtgttgagaaggttatgttttatggttaattatccatggtctgtttaaaaaaataaatcaaaccactgtaaaccactaggatttgcagctccatttgagctttactgtagttttgatcaaacattttgtacataaaaacaagctggtttctctttgtttttagttgtttgttatttgtgttataaatattgtggcaatggtgggagaataagctatggattatttaccctcggtttcatgagttgtgagttattggccttatcctcctttataagtataaataaatgtataatattatattccaagtcttgtaagacaaatggaacgagtgaactgaaaccttttagacccaaaatcttttatgcgaagtcatagaacaacaaaacaaaacccaaattaacatttaaaaagcttctactgtggagcaacaaagtctttaaatattatataatctgcatttaaaaaactgctcatctaacaggcagcagtctatcattctacaagcttttcaatgcctttaacattcagaagctacaggtggttttcccaaagatcactcagcacccccaatatcactaccacaatgaaagccttgaaaatggccagcatgattactttaagccaaaatggatttagaaaaatcaggaattcgtgtagctaaaagtaatgaaacactgtataaaagaagaaccctatagaattttttttatagttaccatcctaggacttatataaacaaaagaagtccaaaaacaattgtccagagaaaatgagaaaagccaagattcaaaggaccctgtggcagagtgcatgaggagcatactcgatagctagaatcataagtatctaacacatttgcatatgaaacttaatgaggatcaccaaagtagcttgccaaaaattatgtttgttaaatcagccaacagtctatgtagcacagacccctaaaaagaacctctaggaaagatgtaaaattgtcttctgaaatttgcttcttttataaaggcagaaaggataaaaaggcctttctcataaaatgaagtgattggtccactactacagtctgaagagttctgtatcagatttcttcttaccctttattacttgtatggcttactgcttacctgcatcagcagtctgcagggttggccatagcaggtcccttacgagttcactgaaacacggaaaatatttatgatggtactattatgtgccagacacaactggatggattctgcttgaaaaggtaagtcagtaactgaggttcttgttgccacattaaaagaaaaaatctatccctactgccaacagcaataagaagagaagctagggtgaaagagttgtcaaagacttatgaaaaattcgaaactgtttaaaattctccctagcttcttttcttgcatgtccaagtaacagaaagcttaggcctgccacctgtcttaagcctggatcccatattaaaaaaataaaaaaaaacagaaaaatgagaaacagctaatgtgttcccaaggccttggttacaacagaaaatgagagccgagaagtctacattggcacacatcgagatttgaaaggtcagtcctgccctagtatggttcagagaccgtgaaaacccaccaagatgaaaatggaagctattctgacaacaagaggcagggaaaaagttcaaagacttttcctctgcttcttttataacgagatactttcaactatttttgacaatcaataaaatgcaaatctccctcacttttgtgttctaagttttttttttttaaatttaaacaacccatttgaaaattagggtactcagaataacttcttgtatacagaactacacatttaaaaagctttgtgcagattgttaatcatattaaaattacatcataaacaatgcactttacatggtgcaaatgttttatgtttttttcttttgacaatcaggcacctacatgcaaaactgcatattggaatccaaactcaactataatacatgtagaggaacccttagaaaaatgcatgtgggaatatgatatcccagttagagactagaatattctgaccaattttcattatttctctgtaataaatttatctgagctatagatcctgttaagaaaataaagctaaatggaaaagtattgataaaatacattaaatatatatatactagcttagtcattattcatattaagatcagaaaagatttccgcaagtcatcacaaatacagagatgggataataccaataatctcgatcacccagttgttaaaacagagaacctcacatttgggcaataatagttttgatttttatcttgtgcaccagatttttccatacaaaggaattctaaattgcaatagttaacacataagacagtgttaaacaaattcataactttagtaaaattaaatgaaccaatttcttatggctttaatatccagaagtaaagtatgatcttaaagaatgatgctgatctgagatacaaggagatcaagcgcttcaatagttcctcctcacacactaatgatcgcatccatcctctcttccacccacctcccaccttttctggttgtattaaaaacaatcaaaactaccaccactgctgctacccttcacacacctgaacttaatttcttctaagagatgcctaacagtgcctagggctgtgctatcactttatatccattttatgaccgcttgagaggcagaaactaaaaaggaagaccaaaacaaaacaaaaaatccctccaacctcccttatcagacaaatgcctggttcccagaggacaccagtcagttaagcaaaaccaaatattacaacagggatgaaggacttataaattgcatacaaatctcactgtgctcccacttaaggtggaaagggagttactccaatgaaagaaaagggggagggggttgtgggaaggagcgaagggctacagaaagagcgagagaaaaagagagagagaaagagagagatttattgtacatttgagacattaagaaggcagtacagtgaaaccaaaggtgttccagggagaaatgtgacagaaagctctaaatgagaattacagaaactattccttcttaaataaaactgttgtttagatgatgaattctataggaagtctgaattaactgtctctgttgtagcatctagatgttttctctttcattaagactttggagtttgaatgtactttgttaaaaaaaaaaaaaaagaagaagaaagagaaaaaaagaaaaaaaaaaaagcattagagctttatatagctcccaaagtaaaaagcaagagaaagatgggtttatataactggcttttttacataaatattacatcaggatacatttcaagtgaaaacacacaaacacacacacacccgtcttccttatactctttctattttaaaattcatttcatactttaaatgttgttggtttttcacaaaataagtaaaaacgaagtcaaaacatctcaaaataagttgccttatattacctggaaaattaacccatcatacaggtcacgatgtctcatttaaagccagttaaggtgctgacaattatgggacattttgctgcagcctagggcaactagaaagggccatggatgttaactaactcccttttaaacagtctgagaaaagggaaaaaaaactgtaagtttccccatctgttatttccttttttttttctttttggctgtggaaaagtaaaattatgcaagagcttttgaatgtaaaggctgtgtgtgctttttccctttttgtctctgtgtaccggttaagtgatgttgcgtaactgagtacagagtaggcggttagcgtttactattgatttacactatgccatctaatgaattcagaacactaaaaagaaaggagcaggagagggagggaggaaaaagagaaagggagaaatagggagaggaaaaaataggaatgaaggagaggaagaaagagcttattcagagaaacagttctaatgactggaataggttcatttttattcctatagctctgacttttggttattgttcagctctcacaaaaaaatggtcttgagctggtgaccccaatattccaatcctatttctaataaggattactggcaggtgaatgcctgaaagttctaatgtgtcaaattacttgaaaccaatttcactatactgtcagactcctccatatgcatctatttatgattctctctatgcatttgtgaatctgtatctgtgatcaccatggatttggtcctactggcttacccaatcaaaaatattatttgaaatatatcacgggaatgtcatcagggtaaagagaaatacattctattttacccatctcctttaaaaatacataaagaacacatttagaactttaaatatatcactattttactttgaaaacagacatgctacaaattgtttggctgaacaaaacagcccaatataggataataaaagagaaataggcaaaatgaggaagaacgctaaattgaggaacaatattcataaagaaatttaaataatttcttatgtctatggagagccttttacttttgtttgggtggaatgcctgtagcattctcagtctttgaatgctgctcagtgcttcccatgccatataatgaattcccaaagcgtggaccagaaagaaagggtgaagttgtttctgctgctaggtacaggtccttcctgtacctgagtgccctcctatggctgagaacaaccactaaggtgagaaagagaaagagaagttctctttagtaatcagctgaaaagctgggcagggaacttgatttctccctcaatgtgtgtttgcaaatgatgactgggaaaaatcacaggaggttatccaaaggaaagaacaagagttggggtttctagtcatccagttgtcttctcttttcagccatctgagcttagaaaatattaaacagatgcgtactctgtccacttgtcaaagatgctttaatgacccatggtggtatgcacacagttgtatacctagcacttgccatggtgcttggcacattttctatactcagcaaatatttattgaaactgaaaaatgatgatgggagaaatatctctgtagaaagaatgcactagaaaggcctgaaaaaatatattccgatgttttacaagaaatcttaggctatattgctctatcattaatctgcacacaaaataatactgtaagagaaatatcaggcagttatttaggggtcagttgacttcagttccattttattaggaaaaagcttaacaaaaattataatactgataacatcagcaaagttttgtgttcatttccaccagcccttttgggctgtctttcatttcagtcttgggcacagaaaagtctattttaatttccatggacacattctaaagaaaaagtcatgggatatcaacgtaattcatcttttaaaaaatactgagacaaatgtagccatttagtaatggaagagaatatggctttttgttgaagggcaaggcaggtggagttttgattaggttacacaaatttaaattactagaaggacaccaagaatgtactgatttccattttcttggttaaacagtttttttttggaaaaaaaaaattctggtttagaaagtcagaaatgccatctttcagttaattggagaataagacctttagaaaaagaattgcaactacaatttctcaaaaattccagcgaagattcaacttaaagcatgtttagcaatagtagccatattcttttaaaaaatggggctaccatcttgttaattctgtaggactgagcatgtagatattagtcaaaaccttcaaaaagttttttatttctctctcttggtcatctatttaatgtaatcggattcagcaacttccttcaataagcattctggcaatatgtcaacaagatcattcatttcatgattcttaaaagtggatgagaacttacctgttcttcttcattttatatatgaagattctgagactcagaattaattttctcaaaagcatatattttgaggcagagctgggactagtatctaaagctcacagttcatttttttcacagcacagactaaatcaaagttgtataaattcaatcttattttaaatgccataggggaagatttcaaaggattcttttataagacaaggaattcttacattatgtaaaatgttcacctcaaagctatcttatacttttttttatcttaaatgtgagcctactgttcaaattgttgcttctccttttccttgtcttaatttttgactctttagagtctttgcctcctgtcctctcacttgtactctgtgtctagttcatatatggcccttcctgacttcatattcttccttctctctctcttttcatctttttatcaaacttttatttattcttgttcctcacagaaataatttccttgttaatgtgatatcctcagaaactacaaaggaagaaaaagtgtaaatttagtattattataataaataggcctttggtttatatttaaaacaaaactgcaataagatattgacaaacagagtaaactacagctataggcttccctatagaaagttacagctgtctagacctccatattatcaatatgaaaacttgggggctagcatttcaaagtatctcatcaaagacagagagcaaaggctcatgatctccagaccactcattttccactacatcaggacacctttcgtttcccttttctttctttccattctacattattgatatttgagactgattacggcacagcaggaggagattcagagaaatctccttggcttaatgtggtcaaactctctcaattccaaaaaaagtcagaaagacctgcacactaaaattgtagttacacagaaaaagaactctgaggaggttaaaagagtcctctgacatgagaaagtagtctctggatagcagggacattgctgccaaaatcattgtaattaagattgggtcattgtttccattataaaccttatgcttatggggtttgtaattcagttaaaatgatcagctgtaggctgaaatgcagccccaagtatcttagagtgggaggtgtttctcccctcctatttcttaaaaaagaaaacacatagcaactatttaataatttcaatgagagttgtattctgacccttcccctacaaagggtagttaatcaatgagcttaatctagagtgagccaaggtgagcaacatccactgtggaatgaagcacattaacctggcatatgaatgggcaataaaaggatttcctattatttcataaggtttaatgtacatcactccattccactgtattgatgtgaataggctttcagcaacaccgtgttgaaaaatctcccacttctgtttgttaactcattattgtaggaaacattacaattataggagacaggaatttctgatggtttccttagatttctttcctcataagctcattcccagggtcagtattagataatcaataatttctaaaatttcttgctcctatttctttagcattgtctacaatatctgatacctatagtgtaatgctatgtgccaccatgatgtagagggattggggaggaaatcatagctatatattaaaattaacaggccagaggaaactggtatttactgagtacatactacatgacatatattccattaatattatttcatttaatacaaacctgcagtgaagtagctgtggcccatgttttatagattagcaacatagttaaagagctgttagctaacctgcgtaaggaaacagagctaatttaaaaagttgcgaagtgaggtttgaatcaagatctgtttgactcccaggcccatatgtactgcaatgcaatgcaacaccaggaacagaatatgaaaccatctaactgaaaaaaaaaagtctccatgccaatgatgagagctacctcatgctccaagtaggaggtagaaagggtaaatgactcctaaaaagagattcttgctttgctcttggctctgataaatccctgtttattcatatgcaaatatccaaatgcatatttggaaaatgttttgtcttagataagaaaatgcacaatctcctagaaacctttaaatgagaccagacatttgaatgtttacaaaaattcctttgaagatttatattaggagaaagttttaaaacataatgcataaaaaaaaatcagatgattggctaggcatggtgactatcgtcaccatgggagtcgctttgggaggctgaggtgggtgcatggcttgagcccaggagtttgagaccagcctagacaacatggtggaaccccatctctacaaaacacagtgaaaaaaaaattagcaggcatggtggcacgtgcctatagtcccagctactctggaggctgaggctgaggctgaggattgattgagcccaggagaccgaggctgcagtgagccatgatcgtgctactgcactccagtctgagcgagagaacgagaccctgtctcaaaccctccacccccaaaaatcagatgattaatacaacattaacatttcaatctggatgtgtgtgtttgtgtgtgtgtgtctatgtgcatataaacctataaatatacacatacacagatgaatttttttgtctttgtcaaaatttctggtaattattataaagtatttgacaaaagctaaacagtaaatatgttacaccaggagaaaaggaaacaaagaacaagaaaagaggagtatgtgtatgtacatacttccctcagaaatctaatcctaaaacattttttaagctaaatgggacatagtgctttagtctaaattgtgtgtgtgtgtgtgtgtgtgtgtatgtaaagataaaggacttttactatgttattttggcaagtgattatttttctaaaatctttgctgaatcgttttatgtagatatactataatactcttgaataaataaatacttgttcaagttaaccttagagctcatcaggtaaataacagaatttaaaaaagaatctgtagtctgaaacactgtagagtatgccaactttacacattacattaagtattcgttcaaaataatttataaattgaaaagtatactccattttattcaaacaatgcaattttttaaatgaatcttacacaaatttgtgtgtgtgtgtgtgtgttagagagagtgtgtgtgtgatcctcaagaccactgagtcattctttaaaaatattttaaaatcataatttggtgaagaacttaacaacaaagtaactgaagccagatttgagagaagaagaatgaacagttcttcaggaagcaccaattcattccttaacattcaataagtctttattgcttcgcccttccctcctttttttcctctagtctaaactctgatttggagcagaagttaggaggaacacgtattctggtccctcttctctcatccctgtaaggaaaagcaatggtagactaatgacagaaaaagcaattgcaacaactttggcagttttgtggtactgggaaaaagcaggctttgtatttgtacatttcaaggaatttcttcaaattttagcttctttgaatgttcctacaacaagctgaaggggagataagatctgctagggaaatagatgaggtttagagagggaaaatggagggactactttttttttattcaaatagcattcaaacacatgagcaagatataacttgcaacattaaaaagtaaattagctagctaaaaataactcacaatacccttctcactaaaacaaaataaaataaagcaaaaactcacaaccaattattttgactggtaaaaacagacagtgatatgaaagtaacagatggaagcccagttttactcacacaacacactcactaaagacaattgcaagtgtccccatgacaataacttaacaatggtcactttagcctgagatatctcctttaggtgagtttccttaaagacttcagaggggcttgtagaaaatactgtagaacgaaaccaactcatttgtctatatgtagaaataggcaagagttgcaaatcacagcctgtggacgaaagggatccaggtgtcacatttgccaaatctttttgcaagactggaatagatattcttttcttatttattttttgttgtatggcagtatttttaggagtggtgacatttctgtacttttaaaaacacaacactacacagcacctaaaaactttcctaaatcaaataattaacagtaataaatcttcctgctaatttctcctcaaagttgaaagaaaggttattttcttacctcacactgagccttctgatatgacagtgtcattcagtcaataatttcaatgtcagttactgatttctaactcttttattacaaagacttcaagcaataatgaaatggtgctgatctgcttgctttcactctatataacgtctatatttatatgcttatgcttctatttggatctatatttatctgctttatctgcctacagtgcatctgtttctcatacacacagacatatatttatatatatacacacatactgtatatatatatataggttatatataaacacacatacccacaaaaatgtatgaatgtatgctagtgagcttacttcaacaaccatgcaggtgcataaatattcaggcacatgacaaatatacaaagaacataaatgaacatgtaaacatagttacacaggaaaaagaatatcttaacaacagccctgtctgccatacttggctgttggcctttgagacttatacactgttgaatgatatgtcatagactactctgagaagcagaaaaatcttctgaaggcaaaagtatatgactaaatcaagataatgaattctaactctctcattttcgcaatgaggagtctgagatactaaggtgaacagcaaagattttacagctttctggaggcagagctggaagttttacccaagtctctgcctgctagacaaatgctctttctactactatgctgaattgaaaggatgaaaacaattttttcaaacccaatatcattattttctaattgccactctttcccatttttcccttttcttgctgtgtgaaatgtaaacaaacaacattcactcagggtcaggcactgttctaaatattctatatgtactataccatttaatctgtaaaatatctctatatagtaggtattattattcaaaatcttagtttagtgaattaaataactcactcaaagctacacagctagtaaggaaaagggctgagctcccataatactcaagacccatgtttttctcacttaactatgatgccttccctaatacatatttgtatataatactaacccttccctcaccaccacagcctgatagtcttagaaatctaatatttgatctgtttcagaacacataacaagtttaaaggttctctcagcctgaggaaaaaaaataaagggaagtagagcaggtataagttacatccctagtatgcagcacatgccctatactagagaactgaaatatgcaaaattcccccccaaaattactccaatgatagtgtgatgtgatttaaagccttaataacttccagtctatgaacattttatgtcttttgcaaaggattatggcaaactgataatatagaatcagattggaaataagaccacaagaaggcaaagggaaaatagcaaaaggaagaaagacccacacccacttcttcttcctctcttggcacaacacttccaaaaacaaacacccattaaaaacaacaaacccagtatcaaaatttggtatttttttccccactcaagtgttagagacaaattcagaaaagaaactaagtctacgtatggtaggtagttttatacaaatctcttcagatagtaaccagttgtgagccatccgaacacggaggaattttacactttggccagctaacccagaacccagcactgggagatgtcatgtggatttgtgaaactccctggggcatactgcatccataagccaaagaacagaaattatactgatccatacatgcagctcttcatctgtgccatattgataattactcttcatttgtgaattaaatcctagttataaaaacaactttcagacatttgtcacaaatggcacattttacttaactctttcataacaccatctagccacggtctataggaaatgggagctaccatactcccatataggtcatgatattataggaagaatatgatgtagagaaagagagagagagagagagacagacttgagtttgaatcccaggttttccatttattaacaataaagctgtaggcacatcacttaaatgattctgaaacctcattttcatcacctgtggaataaagaataaaaccacctattttgcaggaacgttgtgaagattagagacatcccagcacaaagaccccctcataaaagggggcattaaatattaattattgtatatttaagaagtctatttgtgtgtgactttctcttgtattaatgatacataaatctgctgggagtaacagaagatgtgaggtactttttatgcttttttaatcaaagacaaactttttggtgatcacatgtgttccatgtaaaagtggaaataaaagcatatcacagtgtaacattttcagtggacgattttaaagcacttaataacccttgactttttgtgattgctggcactctcatttaacagttgggcaaaatggggttcagagatacatcctccaaatcagtaataataataaagaaatcaccagcaggggttagtagaaagtctgtttttaacatctaaatcccacagtgtccagctaaggaataactgctgcaaggtcacagatacaaaaggccacactttccccaaagctctttgagattattcactgaggccaaaacattaggtaatgctgtgtacatctgctgagataacaagggtgagtcagggttaggtcacggtttcaggttagaggggtggggtgaagagtggctttcagatcaaatgacgagagtagtttaatttaagcaaagaacaaaccatacagtattttaagtaagaggggaaaaaaagggggtgcaactacagccaagagaaggtgggtgggaatatagaccctgtgggggtcaaatgggtaactgtggctcaaagaggaaacccacccacattcacacacactgaaaagcgaacaaaaagcccagggtgcagcataaatcctgctatcccaataacacacacagatgttccaccattgttttcttttatgcacattttaattaagagatcagaatcaagcattaaaatgttattaaatggcttgtttacatttttgctatatgtcatttataatgcattttctaaatgtgtgtatatctattcggaaggactatttggaatttttacatcagtgctacaattgtcccactaactcacagtcatttttgctaaccaaatatgtgtcagaaatccttttcagtttaagcaactggacaggagctctcactctttaattctcagtcaagcaattccctacccccaatcacacctcctttaagcatgacaaagtccaccacagtacttcaagacaataggaaggcccaggtacactggcaacctttctgatttttcacaagagtcccagtttcaaatattctcccattgtgctcacaagaaaatagtcttcatatacatgcccgaccctttccctagaacagttttgaaaatgtcgggaactcaaagctaccacatgaaggaccctgacctatgagtgtcccctggaggggacacagtggaagaagcgggaactagtagatttttttttcctccccacaatccatcttctatttgcagtctacaacttatccctatttgcctgggcaggaatttgagttctctatattattctggagttaaaacaggtatgcctttcccgtctctcagattccacagatatcatgactgatgcacacaatccacctgcatatgtggatcacaagtatcctgtagtctgctggcaccatataacttaattacttttaaccacagggcattgtcctagaagcccactatttatattgtaccttatcaatcatggtacttggaattgcaaagtctcagaaagcaggaatcatatctcctccacgttcagttcaatgcctaatgcattgtgagtgttcagttaggacaagcaagagaggtaaggttttttctttctttttgttatttgtttgttatccaggataagcagaatgcttgtacagaacatgcataagaaagaaacgcaatctaatctcactgtcaatttatattctgtaaactgtctcatttgcagcataaatgactacaaaaatgttttggttactctaagtgttaaccttaaggtaagagttaaattaagtctgctataactggtggaccagaaaggactcagagaaaagcaacagcatggctttgaatcaaatcacttttggaagaaaactttaagatgttaccaccgaaaaaataaaactggcaaaatgctctggagggcatcttagcaatatgcatcaaaaatttaaaaaatatatgaagactgttgacccagaaatctcacctctaggaatgtatctaaaggaattactcaaagatctacacaaagatttagaagcaagaatgtttaccatggcattatttataattgtgaaagactggtaaccttgtctgacaatagagagttgattaaataaatgacagtacattcctagacttaaatactatgcagtttaagaaatcatattttagataccacttaattacatgaagaaatgtttttggaatactgttaagtgaaaaggcatataaccaacaatatatgtacaggaaaatatattgtttaagtaaatattgctaagttaaatattgttaacttaaatattgtttaagaagtgatagttgtgtacacacaaagtgcaaaaagaccagaaaacactagaagtgcttgtttctgggtagagaaattataaataatttttgtttatttgaacttttccataataaaagcacatttatttcatagtaaaatattacttaaaatattcatctataccaaccttccttctctaaaggcctaaaagtgaccctctgtaggcactcttttgtctctagaagtcttccttctcctgtttttatagatgtatgtgttgcattctaaaatcttaagtatttgggactatgtagttataaaagataccctaccaattaaacaaataaaaaatcttattaaatctgtggttttaatcttaggttcctgcttagaaaaaataccaatttctctttaagtcctatattttgctttcaattcagcctccatagtattaattagttatattatttaggcctgcagcagaacagtttcatagttcttctcattctcacagttctttgtaagagacaccacccctctcatggttcttactcacccctacacccacaattgaccataggtaattgtgcaagagaccacaaatagaaagaaaatgaaggaagccttaaaaggccaaggtagttccaagttataaaacagagaaaggctgaaaatttaggcagagatgtggagaaaatccgagccatgacacttaagaatgaactggagtaaagatccatgagcacctggtgcagggagagacaactctacctatcaatccagtacatgctactcacacaggactattaattctagtaaataaccacagctttaggaggggcaaatgttctggaataggctgcctgttgaaaatacaagtgctagggcctttccataacctataatcaggacttccagaagtaatatccaggcatcttcattgaaagctccaaatgtgattctgaattatactagaggtgagaaccaatgggctactggggaagttcaaatcccttagctctagccaacttttataaattcatctcccttaacttcacaaacatatacactctgctgatgctagaccggtgtccttgttctccatccttgctccgtcataaagagaaagctagtttatgtctttgtacaatctacttatgactttatatcttgaatgccctgactgctccttactacctgtttaaatcttcactaattccaacaatgggttagagtttcaccttcctatgaattcacattgatttttcctacacattaaactacagaatctgtgtcttcccctatttctactcttacatcaatatgaaacaataatttgtttgtcttacaactcaatatgatcataaaccatatgtgcccttagaaagtgttcacatggttttgttggtacctctttgcaatgtatatcagggaattttaaaaaatagcagactgaattgagaccagtacttgcatgttcatcatcatataatatgggacatgtatatttacctccaaacattctcagagttcattcttcgtaccctgtaggcttatgctgtaaagaaaatacatatgcagaaataaaaacagagtttgaatctccagtcctaatccttcctctgaactcctgtctcatgtatccaactgcctactacatctctttatttggaaaagaatttcaaattcaacattctccaatactaactcataatcatctctttcccaaatctgctcatttctccatatcccctatagctcccaactccatgggatattgccatttatccagtggctggggtgaaatgcctgaaattcatcacacctgatgtctctctcatgtaaaaccacattgagaccctcagcaacttttgtcagccctaccttcaagttatgcagagttgaaccacttttcatcccctccccactgccattgccctttgcataactgggctactatgataactactacatgctcttcctgtatcaccctgaccctgtagactgttctccacagtgtagccctggaactcttttaatatgtaaatgagatcatacatgcttaaaaaaatcctctatagctttctgtcagtctttatcatggcctgtgtgagctggtccctacttatctacatgatcattcttactttggtccacttgagccacacatttcttcttgctcttcctggaaaatttcaagttgttcctactccaaagtctttacaatatccatcccctttccctaaaatgttcttcctgctggtcaccacatgcttaggttcttctaataatttaaatatttgctcaaatatcttccactcggtgagacctttcctacttaccctatttcaaatagcactttctaaattatatatccctattttctacctccttattatgcattattttcttcctagatctgatcattatttaaaatgatttttttttgtttacataattattggctgtctctccttccactataaaataagtttcataggaaactttgtttaatttctcactatattcccagtaattagaacaatgtctgaaacattataggtacttgatagctattaaatgactgaatgaataagtagatgaataaagtgttccagtacttataaatctcatcccagtcacataaactttaaataggaaatctttattctgcatggtgcagcggcttctctggattgtcccagaggcctctattctttccatctgactgcacaggccagtctgggaaaccacctacatgcaatagctcacatgtcttataataaacttcttgggaggagtaagtcaaattagatagttaactaaaaatagtatctctgagtttataaaggagacgttttcccagcccaactggtcctggtaagttagactggcatcaaatgctgacatggcaatcttatgcttgatgaaccctcaatctggagaggagtgagctatacttttatactatttattttgtgaaagttccaagtatagttcatctttgtatccacaatgtcaagaacattgctgagcagagagtagagcttcaataaatgtttattaaacagatgaacaaactaatccatgaagcaaacaacattctaagtgctattcttctatgtctaagctttgacgatgcgctatataaaattcattcttgcaattttccttcatagattagactgaaaaactcatcgtgaaggaccatgtcttatccatcttgtatcccaagttcttagtacagtgctggatgtaaaaggaagaaaaactccaaagcaaaggatagagaagttagaagtcctggcagcgatcagtgagtattaaagaatgccagtatgacgtgattatcagatgttaggtgatgaaaatcatgccagctaacatatggatttctaccctgtttctgtataagacttgagctctaaatttagttcctgaacacaggggatcagagttgaaggtgattatttactatgaaactgctattttccacagtatacatgatcaaagtgctagaaacttaatgcatgaaaatctacacttctttactcaacctctcttacagttatataaaattctttagaaaattaatgttataaaaaagagttcaggccgggcgcggtggctcacacctgtaatcccagcactttgggaggctgaggcgggctgatcacctgaggtcgggagtttgagaccagtctgaccaacacagagaaacctcatctctactaaaaattaaaaaaaattagccgggtgtggtggcgcatgcctgtaatcccagctactcgggaagctgaggcaggagaatcccttgaacccgggaggcggaggttgtggtgagccgagatcgtgccattgcactccagcctgagcaacaagagtgaaactccatctcgaaaaaaaaaaaaaaaaagagttcagtttgttcactaaagggctcaatttgttcactacataaaaggatatagcagtttgttcacgaaatcaaagccttttcaaatataataagcaatagaagaggtgacaaaatatataatgtaactattaaatcagtatgccttacaagtatccatcatggttatagtactaattgccttggtttgtccaagactgaggagggatgtgagcttttccgtgttcaaacagagaaagctccaggctagtcaggacaagttggtcaccctaataatggtataacctgctaagctggttatcagctattccgatgtatctatatgtaggatctataggtacatgtagaatatatgatagataactaggcattactaggttataagatgattaagaattaatcagtctgtactagtataccatatgaagtgcaaatcccttgtttcattttctcttcatttcccctcgatgttggacttcttatgtttttatatcgtatgcttatattgattttattatagtcaaatacattaatttggggtgttaggacaatttcattttcttcagaagaaaaggaaaagtgagtagcagcaatgcagatgggtctcaattgacgcatgagctcatctgttttttacaactccaagtgtggtaattccccgtagaattaaaatttcctaacacagaaattaaaattttcctagctgaaaatgccggctttttacatatcccaaaactgaacacataaagattaaactccaaaagtaaggcaagatctacagaactatcccagccctaattctgccgagatatttattataagacaaactgagacagtcccctgtggtctccttaaggtcctgatggccccctcaaagcatcatctggctttaagagaactccaaaatagtaattggtctttgggcacagaatagccattggaatctggattagagtctgaaaaacactgcattttccaaagagattacaatgccaggctttgaacattgaagggtaatatcttctttctaagtatctctggtcagtctcagtaactagacctacttttgaggctccatttcttttatgtcttttaaatttaatgataaaaaagaaatatctaaatttataatatacacgaaacagtgaaattaggagaaaaaattctatttgatgtgtccatttttttaagctcccatgactaaaaagatcaacagttacctacatttgtaatatttatgcctcccaggctcagtgtaatgagtttcatctctgatcgaatttttataactgactttcacttacctgtgaaataggtaataggaagccttggtaggtgctttccctaaagaatcagatgcaaaagttagacctactgcaaacaatacagaggaaaaaaatgtcactctaatatactactactatatccgtctgctttttgcaggaaaggaaagctatcatcctagacagaaatactgaaataagtgaagtacagacaagtgattaatcaaaatctgaaaatcatagtcttcagctttttcttccatgaaaccatggtgtgtcctcttaactttggccaagtgcccagctaagagaattcttccatgagatgaacatgcttcagggcaaaaccttattctaactgatggttttaaaagcccaactctacattctgctcaaggctttggttacgtaggtaagccaaaacacaggagacatgacttcctccattaaactggctgaagcccaggttacactaattgagcctaaatagaaaacctctgcttttcaatccctttgttctcttggatgtcacagcttcctgctctattcgcttccttttatagtcttctctcaccaagcatttcaggaaaaaaaaaaaaaagctaaataaagatcacagcctgttccattgtgtccccttcttcttcatcatcttcttttccatgtgtgcaatgttgtggcacctattaactaccaatgttttcagaatgacattatacaaggtgcaggctgtaccactgtgccctaaaaatatcaacaactgcattagtctcacaataattaatggcaggcattatgcaaatgacaactttttcgctgcaaaataatgacatttcttcattttgagcagagttatgcaaaacaatgaatttaggatgataaatcacacaggagaattaagaaagccataacgttcctgcccaggcaggcagaaagatagacagaccaacaatttagaagacattgttttgttctcacaccactataaaaaatcatagccagtcggccattaatgtgtgtaggtttttttccttctcccctttaggcaacaatgcataaggggatgctaaattctagcaattggatcattacaagtcacaagcaaatttttctttattaaccttaataagtcattcactcagagactatagtcatcaagcaaataaaaagtatcacatgccattctgctacacattaactaattccttatgcaaacatcacaacatatagcaattactgccgctcaaaaaaacaaagtcattttcaatttattttattgcttttatacttggccatttcctgtagcacattatcgtttctttccctaacaacccgaggtggaatgaagaagaatttcggtagcaatgagccccttcctctagccacctttgtcatacctttttcccctccgggaggcttttaaggaaggttagggataaggtatgtgcacgctccttcacaggaaatgtgcatcaagctcagagaaatggtacattcagctcctattcttgcagcaaagagagtgtggggtaggcagtaagacccaagtctgtctcccacatttgctacaataacactgacagctttcctttattcagtaaaacaaggtaaaagtgtaggcttagacctgtccccaacaggtgaacgttaaagtcaatatatgcaacgttgacctgagagatatagtaatggttaatgagaattatgaggttacttcgtcttgcttcactcagcacataacttgtcccttccagaatgctgaatgaagagcaataataaatactggacactaccccacaacatgcacagtattaaataagatctttgtgtgtgtgtgtttttaattctataacatcctttatccaagactcccaggatgtgaaacaaatgctaaacaaagcttacacattgctaacagattcttttagcccattttacagactgacaaatggattctgagcaactagaggctttacacaaagttggactggaacaggtcagactatctttccaatgttctaacctctgaggcccgtggcctcttataatcatgagcattctttcctgctgataaacaattatgctgtaaacagcctgtacatgtcccttttcacacaacaggatgataatctctctccgttctcctaaatccacaatccattcccccctttttaaggtagaacatttccgaaatacacacgggaaaagctctgttttcagtttctcctcctgaaggtaataacattttgcagttctccttaaataaaatccagcccatgctggatcaataagaatgatgcccatttccctaatggcagccgattgccatttgctattcaaatcagactagataaattacagtacatgccagggaacaggccagtgaattaagacaggcctccagaggaccagcgatattattaatcttttaagacactatcatatttcttcttgacagtgtgcgtagactcacagacacactgcacccagattgaaatatcagctgctgaaaaaaatcaatagtgttagaaacacaataatttttggtctgcagggtctacactaagcaacacttgtacccctcctgtgccatctcttctcccacttcccctttgccatatttgcctcctacctttttgctcttcccttttcattctctggttttaaaagcttgtaagtccaaatgacaagatattatgagaaggtttccactgctaacactggccattgtggttacagcgttgatttttcatgggttgtttgaaatgcaattttactagtctggcaaaatgttttggcgtgggattgtttttcctatgaacttaatatagattttcaacccttatgcacttggttctgtattatgaagaaatgaaaatatttataggggtggccatacctgaaagttctgaggaaagtggaatgcacagaagggaaaataatggaaacctggcccagaaatgaaaaaaagtggggggtattcattgaagatccaggagaataaacaaaacaaaacaaaacaaaacaaaaggctacaggggaggtgtatgtagagcagaacatggtaggaagaatattctacttagattctgaaaacttgaagttgacctctgcctctgctgcctgcacactgtgtggttttgccagttacttacccttgcagagccttggtttccttttccattaaaacaaaacaatctaaccacctacctcatagcattcttgtgagggctaactaacaagatgtgtgtgttttctaaataataaaattgtgaatgatataaactaatttctactagagagaggtttatgaaatgtgtctgcttttttcctttttcatagatacagaataccataaaggaactttagacgttatcaataaataagcaaactgatagccacagaaaggttattgaggttcacattaccagtagctagtagaactttaagtagaccaagatctgttgaatctgagccagtcccttttacattttaccagatggattttaccttttccatgtctctttctactagagatttgaggctttgattcttgtccatgttgcttttccactggggaggcagataaacaaaatgccacataagaaaacaaaaacagaaacaaaacctaccatgtttgtgtatatttatatgctattcttttgatcccaagactccctccagttcaccccccattttgattcttcctttcataacaaaatgtattagaaaaattgtccgtattagttattaccgtatcttcactttctattcttttcttaatctattccaatcaggcttttatccgttccactctaccatatctactgttgccaaatgcaatggtcacattttaattttcatctgactcaacttcttgcaacaatttaacacggataaccgcttcttttcctcctcgaaactgtaatatcttttgggatacccctcttttcaactttctctactatcttacagggcacttaagcctatttaagcctcatcaaatttgaaatctgttactagcaattcattcttatttctgaattgggataaacacagtatatttggaaaaacagtggactgtcagatgttttgatggtctgattttatgactttgatatacaaaaaagagtagaaaatcttattcttggtttggcttgaagcttttttattccacatacctcatggcaaaatttatgaactacttttgaaaattcataagtgatcatttacctagatccacttaattgctccacccagtttcttcaaacacttgttctttgaggtctacatggcaagaagtaaatacgaaaaccatttccaagtgaactaaagtaacctgaatatgttttctgtgttaggttgttccccctacccacagcaaaagcatgaagacttcctttaagaatacaagatatattctaagtctaccagtactccatcttctgatgtcagatggagttaaagttcactttcatctcaagagaaaaaacagtcattcctgacttacaaacatgagtggagggaagtacctgaacacagggattgctttcctcacatctggctctaagatacaaccacgcgctgtgacatataaaaaggtcactgacacgagaaaatatcgcaagatattacaaggataatcaaagccaaaatatatccaaacccacttttggagagaatcccaataacttcttttgaatgtgataataaaaataacatgaataaagatcattttcttaagaaaaaaaaggaacgtttctatcacttgcctgccacttgccacttaggagtagactctggctcccttttccgcttaaattcttccacagagtcagcttgccagactcttaaccaaggtttttcttttatctagactataacaaatactccattttgggtcatgagaacatagtagcaaaattcccagagttaatactttaattatacacatatgtatttattattttgtatgtgtgtgagctgttccactaagttaaactttaaccatattaatccaggaaaaaaatccctgattatcaactaacaattttgtaaacagttatctcacaggttaaatattaactcgaaaaatttaactcaaaactccacacaagcagaaggagccaaaaggccaggaagaagaagtaaagattagctgctttaggaggaacacagccaggaaagtgagcattttggtagctggataatgtgtaggaagtccagggggttgtgcaggggggggaaatagaagcaagaagggagcctggaggacacctgctgcttatcataatatcaaaacataaaacaatgaggtgagaccttaaggaaaagaaaattcatggagatatgaatccattgataatggccacaggaattcaggtgcaataaaggtttgaacctcaatgatatggacatagctaaaagatccaacacaaagctagctggagcggactgcctgcctgccactgaatatcatgaggaacattctggggtccctcttccactagaaataatgggatgaaggctgctctgcctgtcctgtttctgtttcctaacaataaaacaaaactgaagtgtctccctccagtattgggttattaggggcaccgattgcaagttctaagcctttatctaactgtccatcaattctctccctgattaacagaaccatatcacgtaagaaaaagttggaaccagcagtagactaagtcagaaggcttttctgtaccggaattgctgaactacaaatattgttctctggttaggattttgactaaaaaatgtcaagaaaatccacatggccagagaattcgcacaatcttgatatctgaggtacagggtaaagctgatgtattttaatgctgttttaggaaggttagaaactgttaagattcttcctgtcagtatgtcaaatatcagatcagtcctgcttgctgatttttaaggaagtcattaaaaaaatcctcccagtgagtagctttcaaggaagactcccatttgcccggcagatctaaagaaataatgaggccaaataatgcaagtttctcaagagaggtgtaggattgaatgaaaaaagggaagatatagaaatgtaggagaaataattcttacatatataatatatataatgtatatatgtatatattgtgtataatatgtatatattgtttatattcaagaaatatgatatagcttatcatatattacttttgatatttttcttatacatctagtacatgaatacatgcttattggaaaagtacaagtacaaggtgtagtctctattatctaaatatattatttaaatatatatctaaatatattatctaaatatagatgacacctcgtacttgtaaagctttttgcagtttataaaatatttttgcataaaatatcttttgctttcctgacaaccacaaaaagtaaaaagggtgggttctataatttctgttctatagacatgcaagtattactctaccattgacgtaactggtgcagaataaacctgaacagaggaaatagaatccattagtagcctggttatccatatccacatgccaagtaagaaagcagcatgatgactgtggaaatgtaaaggcattataagagtgatttttggagaggattaaggagggagacatcaaaataattcaaaaggaagtttagaaaatcagtagaaataaagggctaaatttggagtaacttttttggaaaaaaagtgtttagaacaaggaaagaaacttccaattcagaccatgtattcatttggcatatactaattgtatatctatgtttgattttctttgatagatgctattgggtaaataatgatgtgtatggagacactgacctgtgcctgacatatttaatatctatttgttgggataatgcccagaaggaattattatgcaataaaattcagatattcagaataggggtttagagagaaaatcatcactgatatgtaggctgacaaaggaaagcttcagtatgatgaacaaatctagttatactttgaaaaacatgtaagatttgggaggtgataagacatttcaagttgtgtgaagggcatgagagaaagcatggaagcagaaaattgagatatgtatttgggagcagcaaataaacaagttagttggaattgtaataggaaacaatgctggaaagatgggttgagtgtggaatgcgaaacggggtccttgaataatgggctgagtagtccactttattctgtgaacacaagaggtctattaaaggcttgtaaagtaggacactggcatggtcacagtgatattctagtataaataattgggaatggtggacagaaaaaactgaaacagggagagcataaaggtaatgagagagaaagagagagagtgcgagcttgtgagagcaagagaatgagaagtgatccactgcaacaacccaggtactatgtgataaatatctgacttcggtagtgtcagcagaaatgtacaggaaataacatgttctagagacattgtggaggaaaaaataacaatatttactaaagttctactctgtgccaggcaccgaactatgtgctttatgtagattaacccattaatctccatgctaaccctaagaggtaagtaactttattgtttccattttacagataaggattaagcaactttttcaaggttatgcagttagtaagtggtgaagcctggattcaaacccaggcaatctgactccagagcctgttctcctaacccccacacttactgtttttcctaggtacaagggatcttttggtggattatatatgacaagatttgatataatttgatgactgactacatatgagcaataaattcgtgggattcttgggattctcaattctgagatttttgggttatattatgaataaaaagaaggaaataaagaagatcttcttgacttcacattgtacatttgttcctaatggtccaattgctttttggacttaaagtatcaatttacaataaaagccacagaagcaactgaaccaccaaaccggaaagctctttgaaaatgattcttctttctagtttcactaatgtatatctggagtatagcacagttcttcgcatataggggatgcccaacaataacatgatgaatgagtcaactggagaagtattaattgtaataagtgagaataagggagtggagggtgtaaaagtcaaaagagtatgacccagagtcagacaaatattggttcatatcctggctcagggccctttctaactacatgacatacagaaagttactttaaacattttgtgtaatatggggtaataattcataggaaagctagctaccttactggattcagtggttttatataaaggcaatgggtgtatgcaaacctagtaaggaatgctcccaaaggctgttacctctgacagaagaaaatctgcaacccctttctctttgtttaacttacaaaaccacatgaagacctaagaaaaaaaatctgccaaataaattccagttacaaaaggaaaataaattattttgaaagtaaaaactataatttcaactgaagaagagattttaattgcagggagatagatcagttgaatggtttaacttggacttgagaaatcagtagcagccagtgggatacatattaaagaaaaaaacaagtttaattacccttaagattttatacagcttggctcttccctcccacacctagtctgcttccatcaggtcagactccttttcaatcacactctcttccatccttttctcagttgctgtcatgacaagccaatgagagaatgacataccgatgaaaacaaggtttgagtaattactgcactgtggctggttgttgtctgggcatcattttatttcttccaatcaaacaggtccttggacttcacagctctgtttcaggtgggggtgatgctgattatattatgacattatagcaaagacaggcagatcagatgaagtgaatttcactcagtaattaaactgcagtttctttcgtctaaagtccagggcaggattaatcgaaacgtagctctttatcattcctattaatgctgggatttgaagagtgagctctgatttgatagctagccctgaatctggctgactggtgtccccaaatctgtctaacttgcaaaaataatatcagatcaagatacatttgcaaggttatacccttcccttttattttacttttttttttgataaggaaatgcaaatagattcaaatatgctgccatttccactaccttgttttctattacaaaaatgtctgtgaaaaaaatcaggtccttccaaaccccacagcattttacaaatggttttccataattccacttaacaccatgctctaatggcttctaattttgtgacttttcattatctgagactcaatatgaatatttggatggcccaagcgacagcttttcagaggctcaaaggttctacttttattttaaaggactcattctgggacttatatagagattttgtttcattcaatcactcttgtaatgcatatgatatcaccaaattctttaacaagtatgagttggatcactgattctcaatcctgggtgtccatagaaggacctgtgaagctctgtaaaaaatcagcctccagcctccactccaggccacactcacagatcggaatctctaggttttagacacaagattttatatattcttgaactccataagtgatttgaatgtgcagctagagttgaggaccagagtcagccacacagtgtattagctgtatttgcaaaatatttattaaaacaagccattgttcagagaaattagcctcacattattgtgagagatctctcaataaaataataaaaagcttattccagtagcctttgcatagaaaaagatatacttgggtttctttccttcttttcttttttttttcttagacggagtctcactcttttgcccaggcaggactgcagtggcgctatcttggctcactacaagctccgcctcccgggttcacgccattctccttcctcagcctcccgagtagctgggactacaggcgcccaccaccgagcccggctaatttttttttttgtatttttagtagagacggggtttcaccgtgttagccaggatggtctcgatctcctgacctcatgatccgcccacctcggcctcccaaagtgctgggattacaggtgtgagccaccgctcggcctcccaaagatatacttgggtttcttaagggaagtagaggaaaaggaagactgtaaaaacagacaggtaactgttgatggggcttccattgttctctctgataacattgaaggtgatggtttactgattgagctcatcacatggtaacactatagctaccaaccatataatttaagatgacagttgactaacatcatagaatctcagagtttggacataaacttggaattagctgtcatctattttaaccccttctctattcagctgcctttttagaaagagaggcagaatttagaagactttatttcaaattctgttttcagttctgtttcagagtttaagaatacacgttctagggtcaaactgaattcaactactagttgggtggcctagatatttacttctctaagccttaattatcccttctttaaaatgcggcccagaatatgtatctcaaagagctatttaggttttatattaattaatttagataattaactagaatgcctggcacacaaaagtatcagaactcaataaattaagtctattgaaggaaattgcaatagtcacttttaaggttgtcactgagactctatgcttaacaactatcagtttggtgactcacagatcagttttctggaagatttgatttgccaaagaaaaagagagtgagtccaaataggaatggctttcacatttaattgagccataaaataaaatacattttattaaataaattttataaaatacaattttattttaatgatcacctggaaatgatcattaaaaatgcaaatttctgggctccaatcccagagattctgattcagtttgtaggagtggagtctaggaaccatccaggtgattctgactcagggtcaagggtcttcactttaataaagacagttataaaggaatataaattagccaagcatttatcccccaaataactacagtgtggcttgacctggaagagaccatgctttctattccttaagtcagaattcagttagatgagtttaaaccatgtgcaaatacaaaatgtttatagagtatatttatgcacacagagttaaaaaatctatttctcttcaattaaatatgccttctcaacaattatcatttagccactaacattatcttcatctcttttcatcactactgggtacatgtaagtatacagacaagggtcagatttgctatcgactcatccattttcttcttacaaaataataaacaggtttcataaaattggtaaattccttgaataaacaaaagcagctatttcctcctctaaatgcattgtagaataaagtattttcaaaacgcattaatcgaaattgataatgaaagtcaatatataattgtgagttgaatattttaaatgcaattgattacttcgctaaaatgaatatactcaacttacacatggagactgttctggatctaaggagaaatttaaacattttcattcccaatcagcgaaatcccagaaatgtgtttagagtttctaatacaatataccaacaaatgtgcattaactctctatattctaaaagttattgtgtaacaaataacaggagaattatggtctctaattgcagttgaacataaaattgagctggggagaaaataaggcatcaacatgagaaaagtttttcagcattatacaacaatataggctagtggccaagtgtaaggctgaaggagaatctttttagtacatactgtgtgaggcagggtaagctaccgaagatctgcaaaagtcaggcacagtaactcactgagggggttgtggtgaccacagtgggtactgaataaatgtaacctattatttattataatagttgacagtttattttagtaacacaagatatatcacagataagactatgtaaccggtaaaaggtgaatggtacaggcactgagagttacagggagccaaaactgagagaatgctggcatgactggtaagggttttgtgaggaagagacatttgaatggataatgcaggagagagaggatttggctagacagaggaacaaagatcattttagacagggtggggtgttttgatatgaatcgcaggtcaaagttaaaaagtgtttaacgactgttaaaaaaaacagtttaggatgaagccataaagataaatttgaagtagaacaacagagggttctggattccaaaaatcacttgtagtttctggtagaatttttaattgtcaaaatattttctcagtggaattcaatatctctttagatcagtggttctcaaattttagtatgcatcagaattacctgaagtgcttgttcaaatacaaattgctgtgttccacctcaaagtttcttattcagtaggggaaagtgaggcctaagaatctgcatttctaacatattcctaggtaatgctaatgctgctggtcacttggagaaccactgctttagaagacagtgagataggccgggcgcggtggctcatgcctgtaatcccagcactttgggaggccaaggtgggcggatcacgaggtcaggaaatcatgatcatcctggctaacatggtgaaaccccgtctctactaaaaatacaaaaatttagccaggcatggtggcaggcacctgtagtccccgctgctcaggaggctgaggcaggataattgcttgaacctgggaggcagaggttatagtgagccgagattgtgccactgcactccagcctgggcaagagagagagactccatcacaaaaaaaaaaaaaaaaaaaaaaaaaaaagtcagtgagataagagaagagttggatgaagagtttcatggataagaaagagttggacgactatttcctaaagtcaccatataatggaatagccctctttatttcctataaaatttcaccctccctttcataccaacacatagagaaacctacatgaagattacctagggatcaaaattcttctttggctttctaatccctctattgggttcaggtccttaactgtgggaatgaagaggcccatgatcaaaaggagcccaggcccaccaacctggaaacttgaagacaacttaatcactattaaggatattcaagaattcaaaataacagacccaagagactaaagaaagaaggtggaatttttattccaaaaagcctctgtcagtttcatgttgaacattttgtacttgggctgcacttaactgcctgccccttaatccacaaactaatatcatctcaccttggttcacctttttcttttcttcaaaaggcagtcagaagcaagcaggggcaatgagaactttctacctaggcatgggccactgtttaagcatctccaccttctgcttcaaaatctttctccaaaacaaacttccactatgtggtaactatactgtaagaaatcatttaaaaggcagaaagaggaaatgaaatgctctgagagactattttctcatgcataacttcgagggcagtatctcacaagtcagtactttatttttgatggcagacaaaaaacatgttgtgtttgaagattcatgtagaaatctttgtgaaaaaaggtcaaaattggatttaaaatgttcaaaactccaaaaatctctaaagaacaggagcttgtttattttctagcaatttatctttccttaaaataagaagctatataattacaaagtataattaataataataacaataattaccacaaatacaacagaaataatgatagtaagcaccatgggcccagatccccatagttacaaaggataagaatttgtctcagtatatttgagaacagacagcagcccaataatacaggaaaaaaaaattggaaaggaaataatctttcttgtgctccctggaaaataccacagaaaaatagacaatcaaatttaatacctgttgttaaatatcttcattgtacagattaggtcaggcaatttaaatagacaacaacatgaggcctctaatgtctcttaggaaacagtttcaatgtaaattcctaggaggtcccaattcaatttctagttaagcatccccatccactcgtaacactcataagaaggagaaatgcatttgtatggtgttttacagtttataaattattctcacaaacgtgttatttgattgtctcaaaaatcctgtggggtaggtaagtagagaaagtattaatagtatacccattagaaggtgaaagaattaaggatcagagaaaaaggacataaattaatctttattaaatatccacattgggtcaaactgtgcagacctggaaagaagtccaaataaagttttacataacatggataggcttggagaatttgttaactgcccaaagtaaaaaaatggaagagctagaacttgaatgcagataatgcagctcaagatgtaatggtctttccatcagaccatagactaaactctcagttgtaaccatcgtctagttacagtaactgcccctctcaagaggaggctatttcattgccaagaaataaaaccgtgaatagtggtcaggttttctgtttttagttagactgaaagaaagcacatactccttgagaagacgtgcatctttttaacatgacttagtctgtcaagagaataagagagagaatgtgttatttcattcatgtagaatactgacttttaaaagtcactcaatttctctaatgatcagtgatgttgagctttttctcttaggtttgttggctgcatgtatgtcttcttttgagaagtgtcttttcatgtcctcaggggagggcagtgtgggggcagagagaatcaagaaaaatagataatgcatgcggagcttaatacctaggtgacaggttgataggtgcagcaaaccaccatggcacatgtttacctctgtaacaaacctgcacatcctgcacatgtgcccaagaacttaaaattaaaaaaataaaaaataaaaaaactgactccagctacccatggacacaagagacaacacggtcccatttgtcaccaaaatagacaacacagtcccatttttcactaacatactctttgcaagaaagataaactaaaagactatccaacattaatagctagattctggcatagtctcagcttaaactattagtttctaaataagaggcaatacatatgcatagtaaaatagagaataacagcaatggatgtattaacaaaatgcattttccattaattgttatgaattaaaaagtctcgaagctatagatcgagactttgaaacttctggaacaaattaacctatctctttttatttttactttatgcatgcatttacttgtgtagttggtgttgctatgttttcttaaatttgtttttaagataattatattctccctctacttttatacatatatcttctgaggcatttaaaggtttgacaaagcagtgtcttctcacaagagacagaggtttcacttagaagccatcttgggaatttgggctgcagaaatcaagggaggtctagtacgtaagtaaatattagtgcaataatattaaatttttgaatactaaaggaaaacatttattgaaagaaaattgctttatatccttaacaactaccttgctatcgaggatttttagagaattgcagaatttcagagttgatgctatatgtaggattttcttttcttttaattttttttttagagacagggtttcactctgtcacccaagctggagtgcggtggcatgaccatagctcactacagcctcaaactcctgggctcaaacaatcctcccatcttagcctcatgagtagctgggatcacacatccggctaattttttttttttttttttttttgtatagacagggttttgcttgggggcccaagcttgtctcaaactcctgtcttcaagtgatcctccctccttggcctcccaaggtgctgggattacaggtgtgagctactgtgtctggccccaaagattttatttttataatgacagaatatcagtgttagcagagtccattaaaattatatatgacaatcatctgtttaacccatttatgccaaatgttgcaattttgtgtgtgtgtgtgtgtgtatgtgtgaaaaatcagaacttggtgatgaccttgagcaacaggatatacataactgccacaagcttagcattccaatagtggaacactaggcataaatgggttatggcttcagtatcctgcaaaatatccctgtaaggtagctgtctatgcttaaacaccttggtcttaggaaactaggatttgtggatattaggcaatgttatgggctgattgtgtcccctaaaatacatagggtgaagccctaagctcctaccaactgtatttggagataaggcctttgaagaagtaattaaggtttaatgaggtcataaggttggcactctaatccactaggactggcgtccttataaggacaggaagagacatcagaggttctcttgagctcacaaagaaaaggctgtgtaaggacacagcagcagaaggctatctgcagccaaagacagaggcctcaggaaaaaccaaacctgatgacacctcagtattggacttctagcctccagagttgtgagaaaccaatttctgtttgctagtccacccaccttgtggtattttgttatggtaggcctacagactgatatggtgcctgtatcagtgcctatatggtgcctatctcatcacaacctgtaaggaaggaattacttaaagccaatttataggtatagaaacagactatggaacattcaagaaatgtcccaagagacaaggattcaataagtggcataactgagatttaatctaggtctatcttccatattattttttaccctcctattttttacctttgaacacagaaggctgctacaaagttagtgtttcatattgacttgagtattttattcttgtaggtttcatcactggctgatggtctatttgttggagtaacagaaagcaacataatttatcttttagatgactgtcattcatatacttgaagatagttattacattccttcctcctgaatttcctgttaatcccggttcccttaaccattgctcatatcacatgtttcagttccctaccattctggccacttatacctgaagatgttcctatctatttaaatttcttgtactgggttggaaagtcatatctctgctacgtcattcatgactagtctttttaaaatataaaggcaatatcttgcatttatccatttagaaaatttcatctgttagatgtagcccataattccagtctttcaatgtctttggaattcgattacttcattcaacaacttttctatgtatctggactcatgtcatctgcaaatctaatgaatatgttttcattccagttattgaaaaaaacttgtgaccaagataaggccgaaaatatccttgcaatatgccacaggaatcccctatattatgatattgagccatttgtttgtacctaatagtgtggtcaatcaaccagttactaatccagctgtacctacattagttactaatccagctgtacctagattagtaactaacccggctgtacctagattagtaactaacccggctgtacctagattagtaactaacccggctgtacctagattagtaactaatccggctgtgcctagattagtaactaatccggctgtgcctagattagtaactaatccggctgtgcctagtttagtaactaatccggctgtgcctagattagtaactaatccggctgtgcctagattagttactaatccggctgtgcctagattagttactaatctggctgtgcctagattagttactaatctgtctatatatctaacccaggagatatcagatcacatattgtagacatcattttactgaagccattctattgtctagcaagcaccacttctttcagtggatcatgatacattgttttatactttattgctttaataatccattctagactgttgctcaggactaacagcaagtagttgcatcatcataaattgcctttctatactttctgtaaatcagaagatttccacatctctagttatctaacattgtttctcttctcctcaaacatggatggtagtaattgactatctcattgacaaatcctctcatgagtatatggttctctatccctatttttaggctcttctccttttcctttttttcctgttatcttccaaggaaagagtcactcatgtttaatcatgaacggtatgttggtcagagatagacctgcaaactggaacaactgagaagatttatacaaagtgttgtcctagagtccctgactgtgcccgtagaggaaaatgtactatgattaggtgaggctttgctctcatctccacacagggctctgcatggcttttctatttcacttctggcagtactcctggggaaggctacatccttttcctattcattctgggtgacttcctttgccaaagattcaagacagctttgtatttttcagtctttaactgagaaaggttgtgatatataatgcctttattttcccatgaagactttctctgaggcatgcacatagccacgacctttacctaatcaagaaaagttgcttgggcagtgggggatggggatgcaggttggactttaaatgcacaaatcagttctaataaaaacactgagattcaggtgcctgaggttagaaatactggagggaattcaattacactaattaatatttaagaagggctagagatcacacactgaatgtgggaaactaggccagtcagacatgagcatatggggagggcaagatcaacagataaaagtaacaaacaaatcatacataaatgctccaacaggaatgaaatagagaatataaaataaatgttccaacagacactgaagaggaggtaaatggtctaccagacataaaagcaaaatgttccaacatacacaagacattttattggtttaatgtaaacacatatattataaaaatgatttttccacataagttagtaggaaatgttacccatttatagaaacagacttacgggttctatgaattcacagcatactatatttgctctcatttcctcactggctcatcatgcaggagtctcaataaggcttgactttcataacaggtagttctccaatgcctaagcctacctggatacccaacgcctgacagaaggctgaaaagctgcagagtgtgcctgcttctgcacaagtttttctagttccggttgctctaatgtgatttggttggtgtcacagctaataccacattctctatttgatctgatttttcatctgtggcccagacagttgattctgatttttggtcattcttttatagacttgaaagttttctagagaaggcactagtggtgccaggactatcttgcttccttctgtcctgtctacactagcatttaattacacttttctacctcttttctacctctatgccctctcaccctccttcatcttgggagcttccaaaactagaagccaagagaattaactaggttgctttataaaaattgtatatatgtagggtaaacatgacattttgatatacattggattgcttttgctatcaacggcatcatgtagaggtagtagtagaagcatggaagggtagaagaaaggactgagactgatatttggactcctctttcaagttttctgatgtacacatagagtaactagatggcctggactgtctatgtacaatacggaattttaggctcctggaggaaacaaaccaaaacaaaaataaaaacaaagtccttttccttcagtagctttagctttagaagaataaatgattcacatataccaaaacccacaagatacggtatccccaaaaagttaaattgtctcttacctaatagaggatcagaaaaagaaaagatagttatttcctaaaaattgtttgaaccaaatttgtggttttcaaactatgcttcatggtccccagacttacaaagagatgattacaaaaagattatcaaatagatataaataaataaaaaaataaatacatatataatatgtagtaaatacatatatatcaatttgcaattgtgataaaaatgacatgcaaatttaaatgtattatataaatttaaaaaacactggagaccaatgtgttattacaagttaattatgtacaataagaataagcagctttcatgcaggcctctaattaaggctctcagattggaatacaagctgttgaaaaaaactgttacaatatgcaactacttatcagtctcatgatttttttgataccatatagtatagtacagaaagtcttcacttattgccatccataggttcttggaaactgtgattttaagtgaaacaacatataatgaaagcaattttaccatagactaattgatataaataagagttaagttcttatggcaaattttgggtcacagaaacatcatcaagtttctaaataaagatcaaaacacttttgatattaaacattgaaataaatgtgagctgtacatgcatttaagaaagattaataaaagcaagaaataaatgtgagctgtacatacatttaagaaagattaataaaagtaagataattatttaatcaataattccagttcagggtcatgagtggatggagcctatctcagcagctcagggactggtaaggtgggaaccaagcctagacaggatgccattctatcttagggggcactcacacacagccacattcactcagacacacccatgagcctaacacgcacatctttgggatgtgggagaaaacccactacccagagaaaacttatgcagatatggggagaaagtgccaactctacacacacagtggctcactgggaatagttcttttttttttttcccatcagcgttatgacaccatgttatttgagtatctgctatattccccatacaaaaatacattgatttttgagccaatacaataatccaatgctgagtttttattcctttgtatatttgccattatattcttattgaatgactttataatattcaatatgataaataatctgaatttgaaaatgagtttatctcaataaaatattactcattattccatatgttaagtttctaataagatttagtttgaaaagaggattctgcttgtttaaaagaaatatgaaaaatgtctggatcaaataatatatatgtatcctgcaactcaaggcagtatgaatctcatatggctccaggctgctcagtttctgaatttatcaacttgctggcttagaccactgtatacagcagatgcattgggcccaaactagattttatatatgggccactattccttcaggcttaagaacagtatttttatactgaggaatagcttatttatcatgaaaccatcatacatcaaaagaagtcacgttgccttaaacttatccagtacatgaaatttatcaccctcaaagttctagattatcagaatttaatatattagtttaaaatataaccagttgataaccaagaaataagtcaatggaaacctctttaattatctaagcagctcatcttgtttataataattgtataacttacagatacatactcatttatttttcaatcaaaatatattatattgaaagacttcagaagatttttttcttaatattaaccaacattacttatagttaggaacagagtgagccaaaaaggattctcaccactacagagaataaaactagcaaacctggggaaagatccattttccaaaacctgaactacactctatgatggtaacgtttcaagtatttataacacttaagtataagtcaagagttgattgaatgaggcctttcatgatgtttatgtagagtagtcaaaccagaattatttatgtatttgtttatttttaaaggctgtcatttgaaagttatcacagtataaaggtaaaggatacaccggagtttccattctagctccacattcctggctgtgtgaccttggataatttagttaaactaaacttcagttttcacttctgtaaaatgaaggaaatagtagaggttctattgtcatgaatttctagcaagaaatcaatgaataaatgaaatgatgaatgaatgttgcttagcatgttgcctggcacataaaaagctctcagtaaatattaactgtaattaaaaaatatctaaaagccggttgctttcttttggttatttttttaatatgacttgattttattcataacttactgactatattttcttcccttctggaatgatgttctattgaggtttctttttcttttattccagaatgttctctgagcaatctcttcatttctgcctcattcatcagataggattgtaggcgttcattttggtagttctgcatttggttttctgtcactgcttatgctgttttcttgttctaactcagtggtttaaaaagtaaaattcaagtaaggactaaacataagagaatttactgggactaatggttatcaaaattgggcataaagggatgttattaaaaataaatcacacagagggagaacagctgatgacagcagctgtgaaatggatgtacatggtgggaatcagtgagccccaaagaaacaaacaaaaaacactggagggccatgaaacttacatgatttacaagggaaacccaagctttatgaacagcctctgaagactacagaggccaagcaagtcacttctggatgaaaatttggataagacagcaatactgaaaggagttatgttccctgatcaaatgggagctacagataagaaaagaatgagaaataaaatgaaaatctttaccgagtttgatttctttattgtataacctgcactgaggggacaccatctctgggtataccactatagatacacttaccaaatgcttagtgattattgcaatagttagaagagaatatattttaagagccaaagttacaaatctatggacaagatgaattaatattagaacccatgttgagatatatagggcccaagtagtctatgacacaaaagtttgtgtttttatttaaatagaactctaaagacttagttgtttgaaatatatttaatgtagagaaacatttttttgaaaatttggtttactgtaaagatgaatggagatgtctaactttttgccttttttttctagatatggacccacctctctattttcaagagcattaaattcagttaaaaactaaaaacaaaaatactgccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaatttttgtttccaaatggaatttaatacatttcatgaaacaaatgaaattttatcagaaataaaacatttaaattaccaaaagcctagcctccttaggaaggctgttttaggaagacatgggtagaaatattttcatcaaagccctgatcatcttccctttttgaggtgaaatcactctactctgctggaaacctacatttagttatttataaaccagtattaaatgtatattgtttcaaatctctatgtaggaaaaatatcccacattcattcccattttactatgaactgtataaacttccaaaatcatcatgaaaagaaaaacatcaccctttctgctaattaagtgttcttgctttttttctagtaatgggtatttgaaaaataacaatatgcaagagtatgatcttacagtgaatatagccactaggtcaatatgataatttaatgtgagactttaaaattgagctttccttttatgctactattctctaaataacttctttatttgctatgattaaaatatcttttcatcaaatttgatataaatatactagatatggtaaatatatttatcatttaaaataacaattgaattgtacaataagcactatatcattgcccaatttttattttgataaaatctttttaagtgatatcatttcatgttaggctttttgtgctgcttaatattataattaataattcatatttttgtctttctcctctctgacaacttttatttttaatcggtgggcatgtgccaaattggtttgttatttatttataatgtaaaatgacaagggaattgaatatgtgaaataagatagattttctttcatatgacaaaaatttcttagtaatggggatgcttcttgcttacccttatagattcaagggttttagagaggttaggtcaaatgtcacacttctcatataacaacatgtggtaagtgcattaaatagactgttcattttttaaaaattcattttagttttgtgaagacatctgggcacatgcataaaaaacaggacaaaacaatatcaaaatttgtaaaagactccctattccgataaatcctatagtgtcaattaagtaaaaattctgaccaaacagatgtatttgtattctttcctaaaaactaaaacaggcaaacgtaataggaataaacagagaacgtttcaaagatacagaatttccattgaaaaaatcaaatgttctgtctgtaggactttatagaacattaaataatcttttcagtactgtccataaccagaaaccacataagctggatgctagactattgactagttatgacaaaaaattcacagtttgatctcaagggcatcagcgatcctgggctcaggtgatcctcccgccttggcctcccaaagtgttgggattacaggtgtgagccatcatgcctggccatcgtgccaacgtattgaagtggaaagaactaatgctgagcagagaatgggccatacctgggtggttttaagaggtgctgctataatgaaaaatcacaggctcacccaagaactaccgtggaatcagaacctctagggatatggccctagaatctgaattttaagccagttcctgaggtgcaattcagtttgagaactacagtcttaaggcaaaacctttctatcataccagagcttccaattgtcaggccctttgaatccaccctttgtgtcaaaccttagataattcaagagacataacaaacgtgatcatgttacatgcttcctcacagatttcagtgtctcccatttcttctattagtttaaaaaacatagtccaccatcacagggccctgtttaagccagctcctcctctgtggctctgcctttgtggtcaacctgtgcaaaactttgaggctgtgacatcacttagtcagtctccaacatttggaacaagagaactttttctaacaatttgatcccaattcctattttaagcttgagcattatgaaggctgtatctgtatataatattgaacacttcaaaacaattttagatcttaattattttgttattaaaatgttgggggtgtttaagttgacattgagtcagatgtaggaactgatatacagtgaagttaaatcctttagggtaaactcattcagtggtagaggctgaactacagagcctaggcattctgacattccaccactgtgcttatcagcttgctccttgagcaaaccttttcctgcctttatgagaatatgcccattttatgggctctgtatctatgagatattttacctatgcttatgtacacatggtgtttatctttcaaagctggactatggaaaagcctaattttacaaacatgttagtaaaagattatgtaatctgaggtgattacgtttaaaatggcaatgataatgatgttaattccagtcctgtgaggtactgtttctgatctggaaagagcagttttcttttttaacagcttattttgtattttcataatccattttaaggtttggtattaatatagacatgagaaataaaatataactgttgccatgccaaatgtatatcaaaaagttgctaatagccatgactgctatttggttaactgtatttcactatttaaataaaatgatggaaaatggtgtgtctaggatctcattcataataatgaaagacaatagaaactattagcataggtatgatgctaatgaatggtaaattttcaatagagatccatcgaccagattgtttgaaaaatgtttcctgtgggtacgaaaaatgcacacaaacaaacacatgcatcaaaatgtccataattaagtttttagggaaaaataacaatatatgttggttaaggactttcacttaaatggcattatagatctttcagaaatgagagttgatttatacttcagtattttggttcccaaaggttgggacagtgggtggtagaggagaagtagagtaaatggaaggtatacatgtatgtgtgtgcatatgggcaactttaagcaccttgaatttaatgaacaaaaaatgtcattattctgtgtttatatatttttgtgtgaaacaagtacctttctctatcactggagtttacatggattttctcatgatatcttttgagaatctctttaaacactaaaatacatttttccaaatgaaaactcccataattctgctttattaatatctgaatgaatatttccattgatttgtccagaagaaggaactgagtactgtttagagagcaatctttttcatgataattggcagcaatgtttccctgctatcagaaagaaaactatagaaatacgaaactttagataaacatggagataaaaataatattatggagtccaactggtatctttgaggtgaggacaggctgagatggactccttggcttccttctgtccaaaaatttcctgtttccctatttcctacggttaccaccatggaacatgttaaaatctcagtagggactctgtttcaacttttcctgtcaaaacacagtgaaaaagcttaatggaaaaaaatgtccttcctatctccatgccaggcacagtgtaagatccacaaacttaaaagccaggaaaatattcttttatgtgccccaaagctgggcaagtgacctagtactacaaaaattcccaaataggcatgtgacctgactaatgtgtgctgtgagatgagtcaagaaaaatggaaccatctgtacttttattggacagtcaaataatttctttctgtccacccaaaaacataatttctatgttaagagtgatacaaggagacttttagaaagtctaatttttaaaatcagagatattaaaatatatgaaaagtataacctattaaacactggtggagataagcaaataggcttatgaaatcattattgctttaaaaatttgttacctactcattgtgtactaaggcttctctacgacatacagaagaggccggtgcggtggctcacgcctgtaatcccagcatttcgagaggctgaggcaggtggatcatgaggtcaggagttcaagaccagcctggccaagatggggaaaccccgtctctactgaaaatacaaaaaaaaaaaaaattagctgggcatggtggtgggcacctgtaatcccagctactctggaggctgaggcagagaactgcttgaaccttggaggcggaggttgcagcaagccaagattgccccactgcactccagcctgggtgacagagcaagactgtaaaaaaaaaaaaaaagaaaagaaaaaaagacatacagaaggaaatcagggaaaatgggaaaatgaagggaattaacaaattgcaataatctttaagaagtagagtatgaacaattttccttttctaggatgaaagctaccaacaactgaactcttagagtgagtgatggcagaaaaaaatagcaatcaagaataggggcatgttagtttttagacatgtttacaaaactctgccttttatttcttaaacccataggtcaaccacccatcatacctacattaccccatatgacaagtggatttgttgtatgtttcaagtttttaatcttggtgggaagggggagggcagagaagtatttattggtaaaatatcataataaaggttgagcctgtcaatgattgtacctaacaataataaatatgtgtaggaagtaagaacggcaaaaatgaagccgggtaggatactgtggatatggtgacagacaagtatctatacgaaatcctgagatatttgtcctccatttcataaattaaagtgccccctcttttgctttacagataaggaaactgaggtgcattataatagcaacagcagctgatgtgtagtagatccataccacaagccaggtacgatgtcaaacatttaaatgtatcatttaatttaattttcatagatctcctacaagacaagtgctattattttcattttacatacgagaaaactaaagctgacagagattaaataacttgtccaaggttgcatagtaactaagtgaaagagccaagatatgaactcagatctgtctgatttcaaaacccaggcccttaaacactaggccagtggttttttaaccctgattgcacattagaagcacctggcaagcttttaaaacctactgatactcagaccctaccccagaacaattaaatcagaatttcttgtacctgggccctgatgtgggtgtttgtttcaaagcctttctgggtgactgtaacatatagcttgggtaaagaagaattgttgggtgtctcccatggaggtcagtatatctgtgccaatatgtgaggtagtacaagactcaagtgtcctcagtctgtctgcagtggtttttcccttgccccatcatgttcactttgacatcttttttttattatgatttttggagaagtaatatacaagtgacaatttttttacaaagcattgtcacagcagaacatggtcataagtccatcaaagagaaacctgttcatatctatgtacaggctatgatgaatgaatacaaagaagactatgtttattactctcatccccaaagggaagtataaagctggccttaaaagctgttcataccaaagctaatcactaaaatttggaatggcttcctcctctcctttcacaaatgcaatagggtagccactggatctaaggggaaaagatccaattaccactctttacaatgctttttcacttaggatctcaagacgactgacagtcattcaaaacataaaagtaaagtgaaaatatctctagtagaagtgaaaagaaaatgtctgtagtaggaagaaggcctaaatttgtgtctatactctgccactttactgcaatgacttgaggccaaaagtaaagtgacagagtatagacacaaatttactgccatgacttgagccttgatttccttttctatatgtacttaagccatatcatccttagggcagtgatccaaaaaatgtggtccccatcagcatcatgtggaaacatatcagaagtgaaattatcagtccctaccctagactctgaatcagaaacttggtgaaggggcagtaatctgtgtcttaccaaacattgcaaataattctgaccacctccagctgactctgatgtatccacctccatggggttgttgtctaagaataaaaggagatggtccataaaattgttattttttttactatctactgaaatcagaaatttcaaaattctctcacagagatattttagagaaataatgttacagcctacattagttagataataacctcatttctgaatttcactttgaatgtgtagacgaggcacaagtcaaccagaggttatgcaattagcttggagtcaaagagaaagcaaggagtagagctgagaaggaaaccccagtgtgaacttgatttttattcaatcaaactgttaaggtaccaaccacgcactttcatctataatcacaatgaaccttttaataaacatgtttctatcctcttagcttaaaaaatataacagtagctttttggattttaaaacagattgacttctatacttctgggctaaaggcagctcaagagtcaataagaatcacaagctttccacagtgagaagaaagtgcaattgcccagtcctctctatctatgaagtgcagacagtattcctcttcctcacctcacactttcgattattgcaatggtggaaaccatgataaataaaagcgcttatctagtggtttggttttcactaaaattacagacttctgtaacattatttggataccataaaacacaaaccaaattttaggagatgctttagggtgttttttcccctgccctcctgtcggaagccctctatctttttactgtaatttatctgatatagctaccaagatgcttgatacttttacatgcaagggtgctgaaaaacaaagagcgagggaatgggttgttaatgaaattctctgattgtaaaaagcactctggaatgatcaggtggtaaataataataagaggaaataacataaagtgcttaggtgctacagcgatagtcaccatataaatgcagaagagatcagacatgaatagaatttgcattttatgcagctgctgtgtgtgtatatagaatatacagtagctaatttttcaataatgctggtaaaatattgttcaaaatctattcttgctgtcttctcactttaaaaggcattatatagaaaaacacccatctgtcctagtgcaatggtgaatgtgtgcaaagagcctagaaaaagagcctctttgcatacgtgaaaaaaaagaactcaaataaaaggagataatgaagaagagacaatagtaacactattagaacagctatgcagacaagcacaaaggtgatctttgaaaaacatcagggataaataactctgttaatgtgtggcagagaaactacagttaagacatacagtaatataccaaaaatatagacatgcttttattttgtctactgggctattgtgatagtgatggttgtttttgaatagaaaggaagaagagagtgggaagtaggatttcgttgtttgttgttactgttgctgctcagtttagaacaacaacatcaactacacaccagacccgtccaacagttccacaaacaatgcttaccatgaatctgccctcaattttcttgttgttattttcccttaatacttattgataacccaatgcccattcattagatatgctaaatcctcgtccatggttactctcctttggaagagactgagaagatgctaagagggagttcctcttacacataagggaagagtctgtttaggaatctgagaaagcagaggccaggataaagagaccactagtcaatcaatactaagcaccgaagactgaatcacccaaagatacaattatctcccttcctttgttctgtctcttagtcaaataaaggattgtttgtagaaccttttctgttcctgatctctaaaaagcaggactggacttgcacatccaactataattcaaaatatctcacacttccaacttgaaagaagacataaactgtttcaaagaaactcagagagagcaaatgcatattcacaaaacttacacttattcctagaataggaaaatggagagagaactaaccacataagaaagggctaatcataataataatagtaataatgatgatatcaatcaatactttggattctagagaatgatttatcacaaaaattcacctgtattaagggagactccaggacaaggaggtcattaagctacatttccatcttcaggattcagccaaactcagactctccggaaagctgtaaatgctctcagaacagactttagtaatgagattggaatgaacactgggcctatggcgtaaaagcatctccctgccccttgttctaaaagttaactattaaaccatgtgcggttcatcctgatttggtttactcaattctagaaacaaggacatgctgatcagattgccctgggcaattgaatacctactgaagcctttgggaagacagtgttcttcccaccacccctacttaaaaggcttctgttaccagactatcaattctgtgttactggtgaaggatagaaagtatcttcttttgaaggacaagtttttcactcactgagttttctgctttgggtatatactcaacatgttaagtgcttaatcttttttcccccattcccctttttctactgtagtgtgttttgtttgtttgttttttgtttttgtttttttttaattatttgaagagtcacttgtctggatgcttcgttctagtagaatttggctgatttttttcccaacaccttttagtggaatgcagtaacagatgcatggagggagaattggtcttaacagtatttttaggtttcatctgtgtcagagagagatctcttccctttattgatttcttgcatacactatccacactacagcttgaaacagctacaacagtgtttgaaaaattggttgttcctcactgttcaaaccatttttcaaaacagtcgttacaagcttcattttactttctgttataaggagggttttgtttgggttggtttcattttccttgtggcgtcatgctagcagagaaacacagtcaggaatatagcttttaaatgtggtatgattgggattataaccatatcagaatctatattgaaaatttattagattgagccatgtgcagttaaaaagaaagaagtcagaagtcttcgatatttttcacaaacatgaacaccatctcatgcaaacgttaaaattcaccaaacaaatgataccccactgttggaaagatattttctcatgtcaacaactcaggaaggagtggggagggaatgggacatatacatgtaaaatttttctctatatttttgataataactctctgtgaatatgttttactacctaggtaatgcttatatttgtaaaaacatatagttatatcagaaagtcaattttgaataaacctgagaatggcaaactataatttttaaaatactaaccttttagaactgttcattttcacttttatttccaggactcactatcttaaagagaagaataaaagttgaagatccttgggattaacagaaagggtggaaatagccaaatgtattcatatttttggccaggcgcagtggcttatgcctgtagtcccagcactttgagaggctgaggcaggcagatcacctaaggtcaggagctcgagaccagcctggccaacatggtgaaaccctctctctactaaaaatataaaaaattagccaggcatggtggtacacacctgtaatcccagttcgggaggctgaggcaggagaattgcttgaacccaggagatggaggttgcagtgagcaaagactgagccactacactccagcctgggtgacagagcaagattctgtctcaataaaataaaataaaatgacgttcatatttttaaaatacagcaatattcatttgtttaaaaaacaagattgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaaaaaaaccaagattgagagcacagttatatagtgacttttgatacatacacaataaaacttattgaattttcaaaaagtgagaaaaaaactactctgctttaaatttaaagtaataaataataatgaagacatatcaacattggtaactgtcagagtgagaaaaggaaattgaacattcaatgtgaccagaggaagggtgaacatgggagatactgcccaggaaaagtgctcatgatgagtaattcaaagacccagaatcttaacataaattttttatagttttcttttcaagggactatttgaaaaaagatggttctggggtttttgttgtagcttctttctttctttctttctttctttctttctttctttctttctttctttctttcttctttctttctttcttttctctctctctctctctctctctctctttctttcttttggctttgttgtagcttcctctttctctctctctctttctctttctttctagctaaaatttcactctaaattccaggaaattttcacgagatccttttagaggttctgacacaaataaagtaaaagtaaacctgttgtggcaaagttactaactagtctacactaactctcagtccttgctcaaagcaaaataatggagtttggggtgcaatctggtgaactcaatggtccaactgcataaaggcaaagaggaaagccaggcttgggcacttctgtagaaaatgaagattactggtttgaaggccagtcttctcactgcttcactgtatgtggtgactattgttaaattagatatccctattctgatgaaaaggcaatgtgctatttttggggtatacatgtttcaagctgtaaactgcaaagtgctgtataaaagtaaagtggtgttaatgcctcataagataaacatatagattgatgatggaggcatttaaaatgctttaattgcccactttaataaagcactaaataattataataaaaacaattcttcagaaaacttggtgggaaaaaggcctacaggatatgtttgttaagaataattagattttagttttggaggaaaaggtaggacaagtcacaggaggcactcgatgagaagtcaggaatgcctagtacataagccacacatattaagttgtagtttcttcaaaactgacaataacatgtcctccaaaaccaaagggaaaatcaaaggatgttgcctatacttatgtaccttttgctactggagatctagtcaatctatagccttggattcatagttctataacatgacaacatagcaaaatctcaccaacactttgttttaaagaaattggcagctgggtgcggtggctcaagcctgtaatccatgaactttgggaggccaaggtgggcggatcacaaggtcaggaatttgagaccagcctggccaacatagtgaaaccccgtcgctactaaaaatacaaaaaagtagctgggtgtggcggtggatacctgtaatcctggctacttgggaggcagaggcaagagaatcacttgaacccaggaggcggagcttgcagtgagccgagatcgcaccattgcactccaacccaggcaacagtccgtgactccatcaaagaaagaaagaaagaaaaggaaggaaggaaggaaggaaggaaggaaggaaggaaggaaggaaggaaggaataaattggctatgcctccaagtgaattatactataaacttctttcccattaccaataatgtaaatatataaccaggcacaagcatgtggaaatggagaaaggatgaacgttagtcttagaaactttggtttgtatcccatttccaccttttaacaagtcatttagcctctctaggtcaagattttcttacctattaaatgaagataatggtacccatctcacaaaattgttttaagaattaaatgtaaaatgcttggcacagagaggtcactcaatacatggcagccaaatcaccacatgcagtaaaacccagataaaatatattcagccaggactgttgctctgtgagtaggtctggtatccatgctacaaaatctattaagcctaaataatttggtcattttagcaatactctttagagattttttaatgacatttcccaaaggtcaagctagcttatggttatgtggaactgctgcatttataagagagtttagtgggttcataaaataagtcttgctccccaaatccggatcataaagaccttctatcataaaggataagagtgacatttaaaaaaccagtttttaaaaaatgatggtagcaaataaatgcagatgatcaggatgacagcaagtaccaagtcaaagcaacacggagaagaaataggccctagcctgcaggttacactttaaacactgaggagaaatgggagagtaaagagcaacactgagcctcatcggactgtaggtgaaaaaagattcaaaatctgactctaaagcaataggtaaagaaatattttaaaatgcttatctgtaggaagaaaagcagtaaagcagaattcctaggaattgagaaacacttaggaagaaaatgcttaagtagtacgatccaaggtgaggctagctgcagaaaatacaaatatttatgggttaaatcaggactgaggaaaatataaagccaaatatgggcagctctgagggggaaaaaataggcagcttggtactcaactgtcatcacaattcatttgtgtttcacgtcccactgtttgtgacattaacagaattttgaatttagcaatggactatttttgtattgtgaatctctgcagccattttccatatgtagctaccactgtaactagcaataacagccttttgagctttaaaatgcttccaattaataagattcaaaataggggtcacctaagagttttccaagttaattccctttgtctactctttgaagcagagtggtattcctgctattcatttgcattgaggccaaattatttgaccatttcagtaagatatccttaggtagcttttgcttttattgtcattttccaaaggattaagttagttttagatttttgaactgcattttcatttaactaaaataactaaagcaatctttttatgagggtatttaaatagatcaaatttataccaagttcctactgtgtgtcaaacattagcaaagcaatttaaaatgttattatttatatatcaatacatacaaatcatatgtgttatatattaatgagcttatagccattatacacaggacttttatgtgttattattgttgtggttatttctgttgttcgcaggtatcagttatcaagtacctattatgttccaagaactctaccaaggactatacacactcaccatgtaatgaagatattattggtttattttccatttgaagatttagtcacaaaaagtaacttgtccatgagcatataatttgtgcattctcttaaaatcacttaaacttccacgtaacacctggattgacgtatgctttttcttacaaaatatacttcaattcaataaagattctttagtcacctactatgtggcacctgctaggatagttatctttgtttgctattatgctaaatcacagatctgaccattagaatctcttccttcctgaaaataccctctttaggtaaaactgtatttcttatcattttccatcactgattgaataaagaaaggtggcactatctggaaaacataagagcgttggatttacaagtttcttttaataaaacaaaccaagttaatcacaaattgttgcaacaaaatatgtgacatgaagggcatttaaggcacatttagacattatttctatctagaaacagaaatttagtccacataatgtcatttatctactgagctaaatcgtattacaattttcatctataaaatccagattcttaatgtgtgttggaaagataatatctctgacccgctctcagtaagaaatgtgttttgaattgttttgttagtaataataatggagttgtactggacaaaatatattttcagcaagtttctctggtaataaaaataactataatagtagtaataatactagtaatcaccaataaataatagatagcatttattgaactctactatgtgccaggtactgtgattagcactttacatgtattatcttattaatttctcaaaatattacatgaggtaagtaccgtaaatccaatttaacagaaaagcacattgagatatagaaatccaataatttggtaaagatcacacagatagaaaagaggtacaagtcaggattggaacccaaggaatctgactctcgtatctatctactctaggtgggggatatagcaggtgctatggtgtttgttcaagagaatactccatttgtgttgttttatctaccttattagggttggggcccatttggtctgtaagccaaatctgaagacagctgaaatgagttaaggtttgaattagtgctattcacactatctgccaattaaaatgctcccttctgagaagctgtagccagttggcataaccttaggacataatacatgctcaaaaaagtatctgatgaatgttaacaatggtttctctaagtggtgattttactttctttaaaaaatactttttcctattgtctgaaatattttcaacatgggcacattacttaggtgatcaaggggaaattcaggactttacttaaaaaatgtttttgttttgttttacaattaggttgttagtctcagttaaaacataactcctgctgggaagcctttcctgttgctgtactctctgaccttttgaaggacagtactccttactctgtctgcctcagaaccttatgaaggccacatactattgttaattatcagtcttctctgctttatgtgaagtcccttgaagattgaccccattacttatctacctcttagagctctaagcatcttgagtgcctaccactcagttcaatgaaaaaacccagaacacacatacaccagaacaagcacaaaagatgaaaaagaattattttagggttgacaatgcacactcttggtatttgcagatgacttgtttctccccttacattatgtgcaggtccccatggaaagaagtttcccacaagaagtgtcttgaatttactggtctcttctctggaggattttacaaatgcatcaaggaatacacacacacacacatacatacacattatgaaataatatgaggataattagaagtaatggggaacacaggaggcaatttctaaaaaatgaagcatattttttatatatataatgtatatatgtatacctgtatataatgtatatatgtatacctgtatatataatgtatatatgtatacctgtatatataatgtatatatgtatacctgtatatataatgtatatatgtatacattatatataatgtatatataatgtatatacacatacatgtatgtatatatatacacacacgtatatatatatatatatatacacacacacttttttttttgagacagagtttcgctttgttccccaggctggagtgcaatggagcgatctcagctcactgcaacctccgcctcccgagttcaagcgattctcctgcttcagccacccaagtagctttgattacaggcatgtgctaccacgcccagctaattttgcatttttaatagagacggggttttgccatgatggccaggctggtctcaaactcctgacctcaggtgatctgcccgccttggccttccaaagtgctgagattacaggcgtgagctaccacacccagccacatttatattttatattaagtaattttgttcctttcctaccccattataatataaacttcatgaaagtagaaactttattttattcactacagtatccctagtccataaaagaaggcatggcattacatcctcaataaatatatgtcgaaaagaaggaaaaaggtatagatgtttccactgtatttcttatatttttctggaaacaaaggggaaaggtgttcccaaaaggtttccaggaaaacttcaatcaccaatgaaactgcaagctcttgtcatgttcctcagaccactacctaattaattcctttatgtgcaatacatcctttctagcctgttgatactcaatttctggcgctgctgtaacttgtggagcaaagagtgccacgtgagaggtgcttgggccccttcatactgtgcctcacctgcgaactggggaggccactgccatttaggctccagcatcttttacaggccagctgagccaccagaagggaaggggagaaagagacatgcaagttctcagaatgtctggtatattcactcacacacatttctcttctcttctcaaaaaggatcctggcaacaaatcactgattaatgatgagagaaatggaatcaggaggaccccatgataccctctcatcctagttttgggagataaaatctcccactgtggggaggaggaagaccctacagggttttcttatgttttgcagcttccaaattgtagtagggtcctattctataaaattgctaccaacaactgtatacttagtgatataataccatatggaaccttgagttttacttaaagagtagattatgtggcaattcatagttatcctagtatggataagaaaatatcctagtaataacataattattctagttatgagtttttttcagacaagaaactcttttattcatctttttatctctagtgcccagactcaacatatgactttgtatatagtagttcttaataaatgatagcttaaaaattaaataatatttttaaaatggtgagatatggcttaaaggggttcaaacaaattcagagttttgtctaatctaggtgtttctagatttatgagcaggcaatcacatattattgagtatgtattagtgttttagttagtgttaatacagtataataaaccctcattgattgttgtagagaaatcctactattttacactcatatactagaaatgtttaaagtcacaattttaaaatagtggacttcaaactttattatgcacaactaacctgggcagtttcctaaactgcagatccaggctacattctcagagcttctgatttagaaattctggaatggggttcaggaatctccattttaacaggtgctctagataatcctgatataggtaatccctaggtaatcctgatacagttggtccttggactacttaccatggactaggctacaaggtaatataataataaatctatacagttcaccttttcaatacgaagagaagagactagcctattaaatgtgacttaactatcaaaattacccgtgaaaagaataggcaatttgctaagacttctcaaaatgaaccaagggaggacataagggcgagaaatattaaatttcaagccagaaatgactctttttaaaacttcaaagagactgacaatctgcttaaagtaaaagtggaagaagaatggcagcagtacagaagtgttttatgaacaatttaggaaagcaacattgattcaagaggtttatttgataacatgttttaatggttattataaaagtgaatgccttctaatctttgatttgctgctaaaatatatatgtatttatttacatgaaattttttttttaaattccccccttaactccctactttccacacatttttagcttgccaacattactgcgttaatggtgtcctttttttctctctctagaaacacatgccctgggattaaaaggggattactttggtctacttccacatccatgtcccagggaaggtactgcttctgcttccgacctgacctttaggtatctgcagccttcaattctttacagtgggagttgctttagcattgatttcttggaaaactaagagctgttttcaaaagccattttcaagacaaataatgaaaattattttcttatgcttatggatgttacaaactgtgtaacaagcttttctctttaactttgctgcaagaaagtttaaaggcaactgtatagcacttcactgaatatagttttatgctgacctcacttctaactccatttttatatcctttcctttattgttttatttttcttacctatttctaattcatgtattttgctgcaatcatgtatttatgtttattttttcattgtcagccattttaattcccttattggtgcaataaatagtaaataagacaaataaacaaaacaaaaacatatgtatgtatgtgtatttggtatttacatcgcatgtactcaaaataaaaaataaaaactaaccacctaaaataattgacatatttcattattctttgggctatagattcacttgactgcagcacttccatttagggagatataaaattaaaataccaccatgaaaaaatccatatgaaatttgacataggtattttcagccccaggtcattaattcagttctgactgacatctttcagttctgttttaaaatttttgtgttcagtctttcgattacacacacaaaaaagttttggcttaatcagcctaataaagtgtatatttctgaaaacatttttatgtaaacaaatatagaagtatacatgatacatacacatacattttttacttagagtcttcaaaccaaatatttcagtcctttgcttccagtattattttcttttaagtaaatacttttcattaagcaacaaagagtgatagtcatctcaacaccaaaaacttgtattcaggctaagtttagtctactttgcatattttcctctgagaatgatccagccagtctcagtctgattctagtaaaactcaggtaatgtggaagaactctaattgagtattagacattttaacaattatattcatattgatatgtccttatacgaccactctaggtgaaatattactatgcttgggacttaaatatgatttttgttcttttattaatttctgaatctcatatccttccagataccaaaggaatacagtaccacctgggaataatgtcaattttcactttaaaaaaatattttgttgcttttcccctcagcatgggcaaccaatagctgattcatactttcattacatcacagttggattacagaagggctctttagtctggcctccgcatgtctcttgcaactcatttgtagacagcccagaaactagcagctggacttcatttttgttccagcagtcaccattttatagtgtttctctaagtcactgtgagtttcactgatgacaagtctaaaactccacaggtattcatatttagtgggttaaatcagagagaaaggattatgcttaactttctataggttcatgtcactcaactatactttgccattcacttaccatacgtcaaaaaggtggaataatactattcttacatagaggactaataagatatacttagcaaaagtaggtggttgcaaaacatttttttaaaaatcagagtgctgtatttttaaaatcttgcatagaactctggttcaatttttgagtccttccaatttctcataactctgtggtattcataataaagcaggcagatggttaagtctctgaacatatgctttaaatgccccctttgctatttctaaataatggaccaaattttgccctcaaatagtcacaggaaactttaaggaggctgcctcttgaaatctgaggacagaatgtgatccagtgggaattaaacctttaaaaaatatattttctaaactttcttatgagctctattccctataccaagacaaattacattttttaataaaataggatatagtaagagaaaaatcctaaccaatacaatattacttggctcaaggaatagattagaaggcaacatatgttttatttatttatattttaaaattctgattttctaaaacatgagagtcatctgattaatttctgtgtgattaccagattttccatttttattattattcctattactagtatcatgtagatgttatattgttaaaacatcttgcaattattaattagttaatttagtttaaattatgattatgcctttgttttaaatcaatgtttttcatagttattaaaagccaaaagcactatttttccagtcacttactttcatttcaaaaacagtttgttgtcgatgaaagcgcattttccaggttatcacagaatatgcaattcatctgcaatggatatatatattctggtaatgttgctcacataacctagctgtacttgtaagagtatctctgtttcttaatgtctatattttatacatggaattaaccttcatttgcacactcatatttctatgtatttaaatttattcctgaaagacctctgaactagtctctcctgtcttacgatgtccacaaaacttagcagtctgattaacattacagataaaaagaccacacaattgacaataaggacactttagttattatagacgtctgaagtttaagtattccaaaactataatgtccctttagaaattctcaataaggattagcttggtcctaatgaaaacagtgtttacttttaaaaataaatgcaatagttgtacccaaatatgttcgaaacactgtatgacgtgtcataatcaacaatgttgaaaataactaaagatctttaaatcaagtgataattttacacatatatccacaaatatctgaacaaaatttataattactattgggacaaaacattaacatattcttctgctaataaagacaaacaactttgagaaaatcctctctcattctcacgtctctaactttcacaataaatgcagcactgaaactaaatttccaactcagaaatacgctgagctccaataaacaagttgattttaaaaactcaccagactaacagttatgctttttcccttatctttcctttgctttcccttgttctttcactttccatgcacacacaatcacacttacctgcacaagtctgaaacatcagtctatgtattttttttgaaatgtactctgtaccgatgcatttttctgtgtttctttctaaccctcgagaatgttaagaatttaggaagagagccacagcttaagagtgcaattatttgccagtaaatactcaatttgcttgtcctgtgatttttcttctaacttgcatattcaataatccgtccctgactgcgtcacgagcacaaaaagtcttttctccaaaggagaagactttcgccaatcaaccttcagccatgccagggcacagcttgtcagggtgatttgttagctttaattaataattcctcacactggccattttcacaaataatgcagtgaggctgggaggctagattgctatgattcagacagataaaactacagtggaaaggggatggggaggggtgtgggggaattcagatgccgtttataaacacctctaatcatactctttcagtttacaatatagaggacatctcagttgaattaccacgttatgtccaccaatttgtattcagatggaaaccatatgttcctccactttatctgctagggactccctggtgccaacacagtcattgggcagacaacattcacaaaagaggtctctagcctctggattgcaaaagtttactgcagggtgaagttgagaaatcagacatatactgcacttctcagtgagcttgggtaacagtctggaaacacagaagtatgagttatgagtgtcagattttctcttatcctgctatgtgatactgggcatttcatttagccttaaaaaaaaaatctcatacctcatcctcaaatcagtttgcaacaatgactgatttgttcatgcattctatgaacatttattgactcccaaatatatgctacacactgtattaaatgctgagaattttgcttgaaagtaagacttttccatttaactgacaatccatgggcttgaacaaagccaccaaacagatagtgtgcaaataaaaataaggatttctaacagtttctgtgtggctcaaccaaataatcagtaattgacaacacacttgagtccattatgcaaaagtaatgctcggggtaaaaaagaatatacagagattaaaaaatatgtttttcaaagattaaaaaatttccctcaaagtgactagagcactaagaaacatattaatatgttcataaacaatttccaaagattcacaatcactttaggaacatacaaataaaaaaattttattaatgtccttaatcttatataagaatatatgcctgtgtttgagactgcaaatttattaatttattggatacatatttattgagcatctactctatttcaggaactgaataatattggagataagtaaagcacagcctcgttattcaagaagctcacaatttagtcaccagactctaaaagagaaaacacacatctcaactgaaaactgtaatacaatatagccagagcaatgacacaaatatacataaacatgtaggatgggcctcctagaagtgatgcatcaactatttgtaaaggttgggtagaagtaccagtggtgagaagaacattctagggagaggcaaacctttgaaccctttctcaaactgttactagaagcagagcaccagttctagaaaagatgggatttaatacatgacaatttcagataaatgtttcagatggtaaatattgcaggatttaaaaataaacttattaagaaacaaatgttccccaaaactataatgtcttgatatcatcaaaaaagcatgcagcatctctagcactggcacatagtaacatacatgtctttctcactttgtgtgtttcagttctctgaggcaaacatgaaacatgcttgacacacactgcctttctgtgttttcttgcctatttatcttcttttactatgggcaggcttctactgcttctgttttcactgtaccataagataaatcatatttgcatgactgttaaaggaaggggaaaaatctgtgtccattttgtggtcacacatctacttctagtcagatagcacatgctatatgggactaagagtgcaaatgttaaatgagaaaggaaataatactcctaaacccccaaaaagctctttcatagatagtaaatactcctagaaactatacagaattcttggtgttatttaacattttgctttatattatatttaacagtgtaaggcaacagccagaatactatttaccatagttcagtaacatctagccatttaaagaatttacaaagtttattaattcattaaatatgtatgtattgagctcctactatatactgagcacttatcagtaaatgtttgatttttattcccacaatgcttacacataataatagttaacattcattgagtgctgactatatgctagggactaatctaaggactttacatatagtatctcatttaattcccacagtaacattatatgttaggtactattaccacctccatttagtatattatgaaactcacaagtagagaagctagatatacactatgtgaattcattctacacaatgagaccagggcaactaatgtccaccaaaaatcagatttattactttatagttacacagtcacaagtaatgtttatgttgtgaaaattaaagaaaataagtccgggcacggtggctcaagactgtattcccagcactttgggaggctgagctgggtggatcacctgaagtcaggagttcgagaccagcctggccaacatggtgaaatcctgtctctaataaaaatacaaaaactagatggggtggtggcagaaagctgtaatcccatctacttggggggctgaggtaggagaatcgcctgaacctgggagatggaggttccagtgagccgagatcatgccactgcactctggcctgggtgacagagccagactccatctcaaaaaaaaagaaaaaaaaaaaagaaagaaaatgatatgcttaatgtgcatagcacaaaatctagcccagaataggtgtaaaatatatggcatttgaagtattcagagttaaagattaccacatacaactaagacttactgtttctggaccaaatgaccatatattattgaagcctatcttagacaataaatgtaaataaatcttagctaaagcaaattagccttggtagtctgggagggttttcctttgaagatgttaataatatagttgaactggttgtgtttaagaaagcagagctgacagacaaaatagagatagatgacacaggaactcaccagttaataatagaaaaaattcttgtttttccaagtgattaatacaatattacattgtatttaatgtagatgaaaaagcttatttggtactcactggggaagccaccactcagtataatcatatgctcttttcaaataatcccatgctgctaactttacagctaactgccagcatttgccaactccgggcactctgatgccctctccacattctttcttctctcttgacattgactaagtccagccacccataattcttgacctaaactatggcacaaatatccatgaaacagaacatttatttttggtgataaagctggttctagatgaaatggtggtatttctttatggaggagctgcaaggaggctctcttcatttgcttgtgtgtgtaagtaaagtttctgatttgggataaaggactgcctggaccctcaattattggtgtttattctatggatattggctgagatattttgtatgggaaaaccagcagatgagttaatgagcatccgtctgagccatactaacctagtggcacctcctgggaagccagggcgttctagaatctgtttatttctcaaatgaaaatcctaattcatagaagttaaaagtatagaagacaacttcacgtactctttcttcatgatacctggattggttacaacttagtaaaattttagcctgtttggtccctccttccttactggctgtctgagtctctagccttatataggaaaaccttgtcttctaattgaaaatgatgacaaacagaagttatgacagacacatttcaaagtagatgctatttttcccaaataaatttcacatacattctaattcctaaacttatatattttcacatactttatataaatacctgacaccttaaaatgttttacttagtgagacctagataatgaaggaataaaaaggtgacttaatcccagtttttctaaacaagaagtttagaactcacgtattttaaacttgttaagtgatgatcaatataatgggctgtatatttggttgagagttaaaaatctaaagttttctcagagtactttaaggcattgctttctcagtggaaatcttcgaccttcacattctcaaaaggagaaaaatgtttcttgtcagaaaactagtcatggctagtccataagaagaagtccaagattgtatcagcttccctgtgaccttgctatgagatttgctacaagtaatttaatgcttttctatgtctcagtttactttttatctatgatacctcaatgatattattaagataatgtggatcaagtgttttgatcattgcatagaacatatgcatagaacatagaatatagaaatccccaaatataagaatgaaaacttaaattgttagaatgacactaactctgctacaaccttaaatagcatatatagtacctcagtgtctccatttttttcagctataaaatgagaatagtcatctttatgtttttcattaaacagtatattggaataaatagagattattacaaaatctgttgaaagatttcaacaaaatgtcatacatgcaagtgaggtgatgaatatattaattggcttgattaaatatttctaaaatgcatacacagatcaaaatatcacattgtaccccataaaaatacataattatttttcaattaaaaataaataaataaaattaaaatgtaatcaaacctctgaagctgattttcaaatatattagaggaattgattttaaaatatcaaagcgtaagaagtaaatgttttcaagcatattcagacacttatgaaggaagactattaaaagacagggagcaggactgccttttctttgtgtggctggctgcattttatgatggattcaaaaccccagtaatgagaaaatataatcagaaaaagtgatttttagcaggctgttgaatgacacataaaataaaatgtattcattaatgagtcagcaaaaatgttatgcatgagctttcagagccagaatttttaagcagctttttcatacttggtacagccatgttcctgaagtatcctctcacaacccccttctacctctctctctctctctttttttttttttttgtcctgtactgccaggttggaataatgaccaaagggaggggcaaaacaaacagatatgctcactgtggcagaagtcactccaaagatcaaagactcgattcagccgtggctgccaaaatcagaaccacagtgggtgctcatcagcacggtgccctcagaaccacatgggctacccttgataggttagcagcttggggtgcaggccccgcatcctgcttagaaccacctgctgagaactggatgtgcacattaccttacccactcacaacatttgatttcaactcaattctgctctagtattatgtttattgaatgacggaagtctaacagacactgtaaaaatccaatttcacatcttatagtacccaaaagggaactgtgattttcctatatcagtgagcaaaatcttgagcaattagtaaacaagatcaccaatttctagtatttctatgagatatatttctttagttttctgtaaggagaaaataatatattggtaccttagtatccagcaatcttatattcatttatagggttatctcaagttaacatagtcaaaaacccagaagagggaaaatagagcccttgggaaatgaaaagaaatgccataaggtacacgctgttgcccaaatacatcattacttaccaaggagactttaatttggaaccaatttattcttctttaatacacagtaacaccagtaatctggaccctccattcatattacatgggaagaaaacactttcggaagaaagtacaatgatatctgtaagaaatgatggctctatctcagaatgaagaggagacagaggaggtgagggagaaataaaagtatgcaaagctaagaactatgtacagcttgcaaacatctctattattgagtcctgcagaaatcattgtggtaaagctctgcacaaaaaatagtgttcataattattatgggtttaattgtgccctcccaaaattcatatgttaaatttctaaccccaagtatctcagaaaatgaccatatttggaaatagggtccctaattaagatgcagtcgtaatggagtaaggtggttctctactcaagtatgacttatgcctgtagagaaaggggaaatttggacatgggcacacatacactgggagaatgctatattaaagatgaaggcagaaatcagggagatgccttacaggtcaaggaattccaacgattgccataaactccagaaactaagcaagaggcatgaaacagattccctcccacaaccctcataaggaaccatcccttctaatagcttgatctcagacttcttgcttccagaactgtgatccaataaatctctgttgtttaaacaacccaatttatgatattctattatggcagccctaggaaactaatacaataatgattatcaggaaatcatcatgtaaagactaaatcaagttcagaatatattgtttaagaaggttgaaaaatataagattcattgcagaaaacgaatcaatatgcttttgcagaaataaagcattcagtgtttgagtggcacaaatatcgaaacaataaatgatttctttacatggaacatatggttttcaatttttcctaatccaatgagatgttgccatctttactaaaaagacaaactgaaatatactctacagaacacgtcaaagaaagagtccccaacctccaagaagcattttgactaagaaggaagataaatatcaacttatttttatttgtttgtttaaaatacacagcctaatatggatgaaacggttacaaagagaagttctgggtaaagaagaggttgtctacttagaagaaaactactaataaatggggtttgaatctacataaaaattaaaaggcattcatccagatgagaagttaaagagaattctaagtatgaagaatggagaaacatgagaggactgaacaaagcaagagtaagagaaggtaggggcagaaacaacagcagagggaatatgagaaggctagctggtattgagagtgttatcaatctgaaatgggcacagaaacggataaaaaagcctgtagacaggtaagaaagacaagaaacagtaacattcccatatttaaacaagaagttgaaaacatctagtgcaagaattaagctctaatctttaaaacaggtgctcttaaatgcttttgcatgaataagagactgtaccttgatttttcttcaaaaggattcaatagtgggatggaaatgtgtgtgtgtgtgtgtgtgtgtgtgtgtgtgtgtgtgtgtataagctaagctgttactgcaggtaggtcaatgaagaaatacttcatggaacaggaagttatagcgttatacaatgtgttccctggagaagtttaaaaaaacacacacaaaatagccctatgaagtttgtttgctctgttaaatagctttaaaattctacccctactaattgttcttaacattttatttcagccaattatcaatttaatctgggagaagaaagatctacttgactttctgacagccaagtcaatccaactagaaaattcaaaccctacaagaaaactgctttgcaacatttttaactgacaacagaaatccatgataacataatcacctttttctttctttcccaaactcattctctctaaagaaaataaacaatggtacaaagatacttggatgaaatgaaaaagtgaagagagctattccctctttatggtaataggatgttcttgttcaagatggttaaaaatgtaacctgagttctttttcaattctctatagaagttggagatggtcttgtctacatatctaaagtaactgaattatatcagcaaatataagaattacagcttaatttcacccattttctatcttaaataattcataaattaattagtctctttattttattcattggaaaaatgttggcttagatgatgatattcaagtagggacccaaaatgttaaaaacgaagataaggaataggttttgcatagatactaccttttttcccactgatttctatggattttctattacagaaataacttctgcagagcactagtacttctgcagaacagagtaggatattctcaaaactgggatggtgataaaatgaataaaatcagcatcaagtgatgagaagcagatgagtaaaggaatatgccacagcactaaaataaaatgggcccttaattaaaagtccttgattaaattttaccttatgaagagaaatattgaaaagaaaaaggaagaaggagagatgaagggaggaaagatggaaggacagaagaaaggaagtgagggagaaaggaaggaagggaggaaggaaacagaaagggaggagggagggagaaaggagaaaaaagtgagttaaaaagcaagaaagaaggaaagaaaaaaaaggtaaagccattatagaggtattttctcatcctttccccactggctggccctctaatcttccttctctgcttcccaccccaatccaaatgtctgggacacaagtaggatagttgggaaaaaggggaaaaaaggaaaatttctttctccagctgatgctcactttggtaccaatagctctaactcaacagttccaagtgtttttaatctcatgtggtcctttgagaataaatgaaacttatcaaccttctctccaaggaaggggtggggagaaagaaaaagcatatttacaaatacatataaagtatacatttagataaaatataaagtatatttgcatacattttcaaagggcttatataaactctgaaattcatccctgcaccatctaattatccattagcttaatatgaaaaaccattggctctagaatctggaccaagccataataaatggttggggatagggatttggagaaatggaaatgagatacaaaacaaaccgagcaaaaacacacacacattaaaaataaaaaggtgttccttctctccaagtcaacccttaaggatctggctcttcattgttcctggaatttagatcaataaaaaatatgacttgaccaataactatttaattaataaaaatagataaaattatatagcaatatatataatattgtagcaattcttcatgttttaatcattaattctacattactccctgttaactgtctttgatagtgcactaatatataatactgccctgattttgaacattagtctaatacttacaataacattgaaaaccaacaccatttaatattgtgattagcaactcatcagacatataggaaattacaaggagactctgcaacagatacaacaaagcaaataaacaataataaactaatttcaatgttttaatggctatatgtaagaggaaacagaccttgccttaactgtactaatgggaattgtttatatttgtttaaaacataataatgtttcgcatagtaattcataatcttcaaatgccttaaagtatatttagctcatctgatgtgactatcaactctggaaagtaaataggagagatatcattatccttttttcataagcgagggaagagaggctacaaacgattaaatgacttcattaatatcacaaatctaacatgtggtagagcaaaggctagaactcacaggttctgatacccagtaattttgctaccatgctacacagtactcaaaaagtattcattacacatagcttgcttaggcacatgtgttgtcttactttggaaatgaggacaatagaatacaccctcaaatgagttgatacccatagcacttattctttcacgataaaattttattttggcacacagtaaaacagaaagtatattagctatttaacaggtgcaaatagatatttttgaacgtgtactgcatatcttatggatgatgtttgcatgtagtacgtgtccatgtgtggggactagtgtacgtttaatcattttgttagaaaaataataccgttgagttaagcctgtgttttattgttaatcatgcatttagtaacagcacaagttgacaaatcacttataattgctacatattatagcagcacaattcacaattgcaaaatcatggagccaacccaaatgcccatcaatcaatgagtggataaagaaactgtggtgtgcatatatatattatatacacacactatcatacatatatactatatacatactattccatcatatatatatgcatatatctgatgcatatgtatctatttgcacctggtaaatagataatatactttcaaatatatctatttgcacctgttaaatagctaatatactttgttttactgtgtgccaaaatgcatatatatatatatatatatatatatatatatatatatatatataatggaatactatgcagccataaaaaggaatgaattaacagcatttgcagtgacctggatgagattggagactattattctaagtgaagtaactccagaatggaaaaccaaaaattgtatgttctcctgatatgtgggagctaagctatgagggtgcaaaggcataggaatgatgcaatgggctaggcatggtggctcagacctgtaatcccagaactttgggaggacgaggtgggtggatcacttgaggtcaggagtttgagaccagcctggcccacatggtgaaaccctgtctctaataaaaatacaaaaattagctgggcatggtggtgtgcacccgtaatcctaggtgctccagaggctgaggcaggagaatcactttaacctggaaggcagaggctgcagtgagctgagatcatgacactgcactccagcctgggcaacagagcaagactccatctcaaaaaaacaagaatgatgcaatggactttggggtcttggaggaaagagtgggaaaggggcgagggatagaagactgcaaatatggtgcagtgtatgctgcttgggtgatgggtacaccaaaactcacaaatcgccactaaagaacttactcgtatagatcacctgaggtcaggagttcaagaccagcctggccaacatggtgaaaccctgtctgtagtaaaaatacaaaaaattagctgggtttggtggtgggtgcctgtaatcccacctactcaggaggctgaggcaggaaaatcacttgaacccaggaggcagtagctgcagtgagctcagtgagctgagattatgccattgcactccagcctgggcaacaagagcaaaactccatcttaaaaaaaaaaaaaggaacttattcatgtaaccaaataccacctgtaccccaataacttatggaaaaaaaaaagaatccacttcatgtagtaatatatgataagcacttagtaaatgccaattgttatgttcttgcctgggcaacttttggttgtcaactgagtagaaaaaagcgccatcttttagaaatctgtaattccttcttatctgtatgttaccttcattttcataaaaggtaagcagtaaagtgtattgtatcatacagtgatgaattttggaaattatgcataacattttaattatagcttgaatatcctttatctacaatatctgggagcagaagtatttaggagtttaggcttttttcggattttggaatatttgcattatatacttaccagttgagtacccctaatccaagagtctgaaatctgaaatactacaatgagcatttcctttgctcatcatgtccatgttcaaaacatttcagattttggagcatttcagatttcagattttcggattagggatgctcagcctgtattttaaatatgaaagacatgcacttgttaaggacttttgcagagattttactttgcaattatgagtcagcccatatatgacttctgttacgcaattgcatatttctcagaactctattttttttcatttgtattacttaaatgtttacttaactgggaaatagaagatttgttttttgttaaagtgcaaataaatgacaaaacaaacctaaataaaaaattagttgatttaaatactcaaaaaacccaaaatgcttcatgaataacatagtagaacatactttgagaaaaaaatataaacatacatatatctgacttcaactatcttgttagttgatttgtgattacttaattagatttattaaataactaaaaactgacttacaaatttataagcatatattcaggtttctgttgtaattaaagtaaaaaaaatagttaaaaatttacaatcttattgtccttatctttcctgtttttacttgggaaattatccttcttacttaaaaattttacttcctgtttttatctctgaaatatatagtctaatatgaaaatacacaagatggcagattgcaggggtgagctcatttcttccttaaggaaatgatataatagaaattataatctagtggatttacctgtactatatttctctcttaatattcaaagcaacccttccatcccaaataccagagccaaccttgaacagaattccaaagtgtggatgaaatttacctccagttcctcttccttatcccctctttgtccacgtttccttttgaccttttggcccttcctttgaccttatctaaagatgtatttctggtgttagaaagtgttagaactttcctcttcattttcagcttaaactgaagtctttatttaacttggattcctaactattgcatccttagcccatattaccaacctatgaattgaaatgttgccatctatctgaccaacctaataatgtcttgcatcctgctctcaataggtcacactctcttagataccagtgaaagacttgagatttttctgtttcctgcatttatctcagccttccatgtgaatcacctgtattaaaattttagtaatccccactttcggaggctgaggcaggcagattgcctgaggtcaggagttcgtgaccagcctggccaacatggtgaaaccccgtctctactaaaaatacaaaaaagtaaccgggcatggtggcacacacctgtagtcccagctacctgggaggctgaggcaggagaatcgcttgaacctgggagatggaggtgcagtgagccgagattaggccactgcaccccagcctgggtaacagagtgagactccgtctcaaaaaaataaaataaaataaaaaataaattagtaatctcatttctgattcacttgatctgggcttacttccttttcccagctgggctctctctatggttctagtatgctttgtagtgattaaaaggattaggataaataaaaccactgccataaaccaaaaaatttctggtctacctcaagccctaatggtcaacttggttttccctcgcccctagttattctgtttatcaaacagaaaataaatactctttaccaagtttcataacatatatattaaaaaaatctactaatagcatttagaaggtgagaattcatactgaatcttctacttctagatcaaaagcactagaatactcagagtactctagaaatgtatgatggaggtaggtgactcattcttttagaattcatctgtgggaggcaaaataattgcaccccaaaatgcccactgcctaaagcccagaacctgtggtacatggcaaaatgttatgttacatgaaaaagcgactctgtaaatgtaatgaaggttgttaacactaaaacagggagagtatcctagattatccaagctggcccagtctaatcatcttaaaagcagagaacttttttggctggaatttggaaaagaggtgtggtagaaggggaaatttgaaagatgtcaagtgtaataatgattcaaggtgctgctgctggctctgacatatagggacagcacacatgcaaggatctaaagatggttcccagctgatagcaaggaaatggagatcttagtcccacaaccatgaggaactgaataagcatgaaagtggattttttttcagagtttcctccagttaagaatccagccgacaccttgattttggccttgtaaagcctacagcagagaaactggtagagccaatctaaacttctgatctgcagaactgtcaaataataaatttgtattgtcataagctgctaagtttgtggttggtacaacagcaacagaaaacaaatatattatccaacatactatcccagtccaaaggccaacagacacattagtttaaaatcatagagtaaagaattgggacaggaaccactactatgaaaaaagaaagttcttaacactataaatacattttccccgatattccttcttttagtcatatcctcagagaaagtaaaatacctcgagactaaaggaaaaagaacacagggagtgtatatctactcaagtgcaaattgtcctcaccaaggaacttcacaaatgtgctcttcctcacaggcaagaatactatactaacagtgcaacattactcaaaccaactaaatccactctcttcaacaggaaaaatctgaaaagagcttgaaagtttataaaggcatgaagataatgaacatttaagaaacaatgaaaaaaagagaaagaaagtccaggcaaatgtacccaaaattcacagatcacatgcctactggggtatgttttgcctactatacaagttgtcttataatcatacctttaaaggaaattatcttcaaaaactatgattatttatttttatatgtcatcaccaaagctagtttttaaaatttatcttccaaaatgaattttctttcttactcatattttttacacagctagcttctggtcttaactgaacaaaggaatattggaagaaaggcagttatttccaatgattttcggcattgaagatttagaaaagttaacctttgaaaatttactcaacttcagaacctaaaactttttgaggtataactaccaacaacatgctgaaaacaaatacttttgcaatcgactagaaataattttcacagtaaaaggtaaattctcagcacgctgcacatattctactttataattatatcacagtatgaaataatatgaaagaaaataaggggaacaaaccaatataatgatttaaaattcttatagaaacaggataaatgaagttaattttatttttctgttgagatagaaaatatactgagctaaaaattactaataccacactttgaatcttcccttttgtcttccatggaggccacacatggaaggatagctccaatgacctgggtaagggcaatgcaggatagaaatggccacgtgagaaaatgtacacacattcctttcttttgaataccacattctgcttcctagaggtccctgtaaacttattaaaaacttcagtcattttgtaaggagataccataatttcaaggggctttgaggctcatttatagcaaattaatccccattttatgtctgtccccatttaatatttctaaagggggtggataacaaatctcgccaactctctttttaagggctattcagatactaaataaaccaggaacatttaaaaatacaatctcacaaaaatctgctttgcttaaccttctctccttctttaaaaaataagaaaggcatgatgttctttttttgttaattaattcattttagacaattccttaaattttcattttaataaatttttgtgtgggtgcattaattactctcaaagatgctttacaactgttacctattaaaagcctttgttagtgaataaaaaaaaagaaaagaaaagaaaaaacttccagcatgctcccttccttctctattctgagcaggtccttgctatcaactgctggagtatgcttgctttgcacctagagctataattattttgctttaattttacaaaaccttttgttccattcccacgagcccacctgatccttatattacactcgctctattaaaacactcatgcagaacaaagcatggctgtactgattcataagtaactttttttttttcctcagtaaaatgccactggctaggcttcgggacacagtcctgggcttcaccatcctatgccaattttcatatgttagaacaaaaaaaatatgttgtatcagagtgttgtactcttccccaagatccttcctttgccccacttgttttttgtgtttttaaacatattttatcttatacttaactttactctggggcaatatacatgacagaatgttgaggatggtggatatattaaaagattgtaatcatgttgatatttcttttattcatgtggttaaaattcttaaaaatgacttctgttgccttatttaattttttttttctttctccttactccacctcttttccttgagatcttgcaatacatgtgggcttttggcaaaaaaaaaaaaaaattgcagtgactcatcaagaaaactgtttgtttgctctgaggagcaccctgaggaccctctgggctgcacacggagccctttgatcctaggaaatttatttcttccagatgttttcccgacagccacctttctgcaatgtccctcttcattatgtagcataagaatactcaagacccactgctatggtacagttttcctgaatggagtgtgacagggagttgacatttgattgagctgttggattcttcttgccttaggcacaatgatggaggaaggttaacactgaggaaaggcagaactgggtctgttcaggtacagtgtctttaggattaggatggaaattatgtgaaccaggccaaagaaattatgtaaaatctacaaatctgcagaccattgatcatggacctagttttcttcaaccctgtaaaatcttgatgcctggatctgccatgttgttactcctccaattttttttctttttttttttttttttactaacatacaaagtgcggacaggaaagttaagcctttggacaactcttgttttttcttggcctggctgacagtgctagcggaaaggagaagggagaacaagggaagaatgcagagcaggtacaaaggtaaacatggtgtggtgggctgaataatgacatctcaaaatgtgtccacgttctaactcttggagtctgaatattaatttaaatgaaaaaaaaaaaagactttgcaggtataattaaattaagaattttgacatatggagcttatcctggattatctagatgggccctaactacaattctatgtatccttgtaacaggaagattccacatggacagaagaggccaacttaatgtgaccagagaagctgagattgcagtgatgtggccacaagccaaaaaacggtagtggtcagcagaagctgaggaaggcaaagaaaaggattctcccctagagcatccagaaggaatgcagccctgctgacatcttgcttctcgcccaatgataccgattttggacttttggcttccagaactgtgagagaatagatttctgatggtttaagtcaccaggcttgtggtagtttgttatagcagccacaggaaactaatacaaatggtaaccatttcaaaactccattgttcagagcatttgtgaaatcactgaagtctcaggttgaaggcacagtggaaaacaggatgccaaggcttgaagacaaaattctctgtggagatactggagatattaagggcacttataatctacagcaagtagggaactaaaacagggcaaagagagtgcacaagggcattcaacagaagattaaacagattatgaatgtaaatgttctaattttctaatgctggtttgcattttttatgaagtaggacaaatctatagtattttccatttaagttaatgcttacacacataatgtattaccagccattttccccctaaatcaattatcagtatcattaactttagtgacatttgatttggcaaatataaactatatttggcacatatatactgtattataaaaataaagatcctctatctgcacttgaggtaactttcctttagctattcaaagaaaaatctatttttaaggtttaacccaaagataatatggaacctaaacccaagaattcttaaatagatatattaaaacaataacttggctgggcatggtggctcacacctgtaatcccagcactttgggaggccgagggaggtcaggacttcaagaccagcctgactaacatggagaaatgctgtctctactaaaaatacaaaattagccgggcatggtggtgcatgcctgtaatcccagctactcgggaggctgaggcaggagaatctcttgaacccaagaggcagaggttgcagtgagccaagatcacaccattgcatgcagccaaaaaacacatgaaaaaatgctcatcatcatgggccatcagagaaatgcaaatcaaaaccacagtgagataccatctcacaccagttagaatggcgatcattaaaaagtcaggaaacaacagatgctggagaggatgtggataaataggaacacttttacactgttggtgggactgtaaactagttcaaccattgtggaagtcggtgtggcgattccgcaggggtctagaactagaaataccatttgactcaaccatcccattactgggtatatacccaaaggattataaatcatgctgctataaagacacatgcacatgtatgtttattgcggcactattcacaatagcaaagacttggaaccaacccaaacgtccaacaatgatagattggattaagaaaatgtggcacatatacaccatggaatactatgcagccataaaaaatgatgagttcatgtcctttgtagggacatggatgaagctggaaaccatcattctcagcaaactatcgcaaagacaaaaaaccaaacactgcatgttctcactcataggtgggaattgaacaatgagaacacatggacacaggaaggggaacatcacacactggggactgttgtggggtggggggaagggggagggatagcattaggagatatacctaatgctaaatgacgagttaatgggtgcagcacaccaacatggcacatgtgtacatatgtaacaaacctgcacgttgtgcacatgtaccctaaaacttaaagtatgttaataataataataataataataataataataataatacacattcaaaaaaaaaagatcacaccgttgcactccagcctcggcaacaagagcaaaactccatctcaaaacaaaacagcaacaacaacaaaaaacccaataacttaaaattggaaaagtccaatagcaaaattattgtgaccaaaccacccagtttatccctttctctagttcatcgttaaaaacacttggtagcagcattattaataaagaactaaaaatacacctgaactctatgattcttcttagctatatggcttttcaacaaccaaaccattaatcttcgtaatcaccatgaagctaatagatgtagactacagatacagataaagaaataagattatggaaagcttaaagagattctagatcaatcagcaaatgagaagaactgagaaaatcaagtagaaatgctggctgcgttctctagtacctttgaaaagctactagagatagaatccttcttttggagaaaatagtccaatgacagaacatgtaaaagatggacagagtcatttattttttgctactttcatattaacacagagtattcatttggcagtagttttcaaaacaagaagaacagtctatttttaaataaaattaaaaaaagtaactgatgattaacataactactgtaccaaaagaaagataacataagtcattcaaagtaccaggaggctaaagaaattctaatagttatccctatacaccttcatttcaataaacatgaaaaatgggaatctcaatgtgttgtcttttcaatttcctaataataccagggggactcaaggcagttcaaatctcaggacttcagaggccactgagttccactatctggggtgctgagcagtcgatatgaattccaacttcatactctccttgtctccttgttctatttgctttaacactatgtacacctaacttatctttagaaggacaggatgcatatcctttctataaaaaaactatgcagattttcatagtgccatataattacaggtactctttatttgtttatgaacccttccaacaacccaataggcaattgttaacattcccatttatcactatctcacctatttctgagttcctagagggttgagaacattcttttcctgttactatcttctcttagttctatcacccctggtaagaagttaagtagtaactagttgacatagaactcacggcaccgaagaatgggtggccaggatcagtgcagattggttcatttgggtttgtaacctttgtgataaattattgagtgctatagagataaaatataaaataatttttaaaaatcctactacaaaactaccttaacccttttagcacagattatgatcctgaaagctaataatctgtactgtgctataacaaatataagaggatgcctttagtatgataaagtttgctgtgatggagaaatggttgagataaatgggactttaaaatcaagagtcaagaacatttggaaagatatgagatacacttaggaatcttacaaatgaacaaggacttgtctctagtttcttagtcataatgtttctaagacacaaattaatcaaaatcccaggttatcagttacttaatataaattttccaataaacaccccttgattacacacttaggtcttcaaagtgggtagatttatacaattcccctctacacaggcaaattacatacacaaaaattatgaagttatttttttctttgaagtagtttagtgaatttttaaaaatctgtaatgaataaaaccagactttaaatcctgaataaaaccagactttaaatcctgaataaaaatgttctgtatcaatgattgtcatgatatgtgtcttggtaatagattattgcataatttttttcttaataaaatggtatctccatcaaacatgtagatcatggagtcttcccatagggacttttaagatcatgtaatccaatccttcattttacagatgaagaaacaatatgtgagtgttttaataaagcctactttaagtttttcattaagacaaaaatggttgttatatgaagagaaaaggagaaaaagaattaatagtagaaagttggaagtgaagagtgaggaaaaacagaaaggctttttcattggtgcagagcactaagcagagatgcattctctaatatatatccatgtcattgctagagactagcttaaatagtacaaagttggtaacatccttctcttttcttttttttgagacggagtctcgttctgttgccaggctggagtgcagtggtgcgatctcggctcactgcaacctccacctcccgggttcaagcgattctcctgcctcagcctcctgagtagctggaacaacagacatgcaccaccatgcccagctaatttttgtatttttagtatagatggggtttcaccatgttggccaggatggtctcgatctcttgatctcatgatcagcccaccttggcctcccaaagtgctgggattacaagcgtgagccaccacgcctggcccgtagtatccatttttaaaataatcacttagattataaacacgtaaacaatttagacaggtttacctctagggaatcatatgacttaccataaataagcaaacatattctgtattaccaacatgctaactgttcattcatttacactgtatattacctctcacttccccagaatatgcaagttgaaggaaacataacaaccattgtaaaactctatcttaaaataaatattattctataaagaaaaaacaaacatttttaagagtcatataaaggcaaattttaatttgaagacttgatactaaggaataaatatatatacctaatatgtattcacaaaagttaaaaactaatttttttaatgtaggctgtggaatcagactccctgggactgaattttgattttgccccatccttgaccttgggcaaattttttctctctgtgcctcagtttcctcaccagtaaaattaggataacaacagtgactatttacaagagttgttgtgaggatggaatgccataaatttacatataaatcttttagaacagggactggcacatagtaattaataaatgttagctgttacttctaatatgtacaagcctgttaaacattttgcaggggggagataaggtgtttctcattaatgggacttgttaaggcattttgtctttcaaatggctgcctaacttaattcataccaatattttatttcagtaggattaatgaaatagtatgaggaaaagccttagtgtggtttctttagacatgtttgagacagatattctcatccttttaaggggagtaatctaaaatgctacacccatttgtggcttaaagtaactgagaagtgactctcacaagatgacatgatttagctgtgtccccatccagatctcatcttgaattgtagctcccataattcccacatattgtgggaggaacccagtgggagataactgaatcatgggggcggtttcccccatactgttctcgtggtagtgaataagtctcatgagatctggtgattttataaggggtttcccctttcgcttggctctttccttctctcttccctgctgccatgtaagatgtgactttcaccttccgccatgattgtgaggtctacccagccacgtgaaactgtgagtccattaaacctttttttctttataaattacccagtcttgcatgtctttattgtgagaacagactaatacacaaggcaaaggagaaaatgggggagcagaagaggcttagcaggatgcatacatcttctgatatggagaacatgaaagcactcactgaggaaagtggaggtgctggctcttcagcaagcaaatgctccacctatatgctcccacagtatcttatacatgtctcaaagcctttaacctgctgctttgtaatgatttgtttacatatacttttttttgttattatatggtcttctacttgaagacaaaaactgtcccattcacttttgctcagtagttgctcagtggcatatttctggattgaatgacttagttaattaataacagttactacaatgggggaggctattgattttaaagcgagagctaagactcacaggttctatccaatggaggggcgtgttgaagtagaagtagctagctattatggtactgacaatggatctctgatctctgtgctggggataaatgctctaagtgagcatgaaatatttttgaagtttatacatgtgtaagttttttttccccttaaccataataactttcttttttaaaaatgcatgaatatttgagtaactaagtgcaatgttaatgttgggtgcaaatataatctgcctaataaaccatggaaaaagcctgaaaataaattcaataaatagagtcctagataatgtgttgtgggagatgagagaataagcaattaattatagatggtggaattaaggtaattttagtagagaaggtaatatttgagcaggatcttgatgcaaatactaaatctaaatctgtgaaaatagagcttatatccttaatgtagaaactggctgatatgcagagataagttgaaagtcctgtgaataggtgacataaacatcaaaggtattcctaattcccaatatacttgaaaaattggctattatttgatgcatatatccctgtatggcaatcagtccagtaaataaaataataataatgtcctttaaaaaattcatttattcatgaatattcattcatccattcactctttcaacctaatgtgataatctactgaatatcaaattccgaactgtgctgagtacattggaaaccacggtggtcaagacagaataaagtctctgcataagaagtaggttcagacaattaaattaataattataatgcaatacatattatgttaggtaaagtactacatgttatggaaatatgtaattataagcaatttatacttaaactcattacataaatatggcagaactatatttggataaagtgctggtggtttttattgaccttgaatttcttctgatttggtcttgtttacctacagagtagactgccacatctgggtcttacttatactgtttgctattcaaaatcttgcctcttgaactacctatttaattatggattcatgaagcacaaatcaatttattttcttaaattccttaagactaaacatggcagcatttttcctactccagtgtttctcttctgttaagatacatcttttggccaggcacggtggctcatgcctgtaatcccagcactttgggaggctgaggcgggtggatcacgaggtcacgagatcgagaccagcttgaccaacatggtgaaaccccgtatctactaaaaatagaaaaattagctgggctggtgacacgtgcctgtaatcccagctactcaggaggctgaggcagaagaattgcttgaatctgggaagcagaggttgcagtgagctgagatcgcgccactgcactccagcctggtgacggagcaagactctgcctcaaaaaaaaaaaaaaaaatacatcctcaggaagatgatggtgatgatgtatgaaactgaaaaaaatatgcttagttttgtgagattagatctacagggctgagaagagtaaaatcttgtttggactagtatattgaacaaaaaccacataggagtcacagtggaaacaattataggcaataccaattcttatcattttaatgaggagaagttaaagttggtcttttcgttgtggttcttaaatgcaaggtataacctatagtccataacaaatttttctttagaaattatcaagtacacagtgggttttctttagaaaccacaattctagattttttaaagcagaaaatatgctgtcctccttcattttaattcttttggaggaatagaactttttttttctttctatagttaactagagttgccacaggcaagaggactaacagagtaaaatactaactgatccaatatatactgcatttatctaactggatttcatctagctcaacatcatggctttgtagtctaagcagtagatgaacagaaacaataaactgggcaagtaatgttttgtgtgaataacagaaaagagtgaacagaaatataacacttcaccattgcacaaaatacaattaaatatgatttttaaaaacccagccactgatccactgcccaatcataaaagaattgtaatcagttcaagtagtcttaaatatagtgaaaatgtcctcaagatacacagcatgagagaacaaagagttttcactatcatctgctggactcagggaaggtgtgctatgtggttatcatttgagtgctctgtgtttaagttaatcaatattataaattatgcatgtattttagaagttcataatttctattaacttgtaaagttattgaaaagaaggatgaataaaccatactacaaaaataagaatgtgaataaatgccagtttttcctcagattacagatgatataacatcgctgctattttaagaaaatgagactggatcagatgtgaacatttatcccttctctttaggatagcctatgaattcaacacattgacactaattataacaatagctaacagttaactggagtactaaccatgtgcaaagcacactgtaattatttcacatatattatctcatttaatgctaacaacaatactatattataaacaaggaaactgaggcaaagggaagtcatttgctctagatcaccagggtagtaacgggtggatgtaggattcaaaccagacatactccagaatccatacaatatcagaatagtctgaccccaaaagacacacacacacaaaatggatctaaccaataccttgggaacatcatctaacttttctgggctttagatccttcagctgaaataggagttgacaaaccttttccaaaaaggataaaatcttaaatattttaggctttgtgggtcaagaggcaaaatcagagatgtcatgctatttaggtaattatataattggagagaaaacttgctgtatctcagccagttagatgaaaaacacataatacaacaggaaaggataatcttcaaactattaaattatattctctttgtacgtctaatgtggagacaaattatattaagaacacggtagctgaaataaaattatttcagattagcacatcaggtgttgaatgttatcagtggttatcttagggggtgacagaagaagattttagggacagagggaagttttttcacttccagttaaaatttattttttaagtggtggaattgattgttatttattattattatattttactttgtgttttggagtagttttcagtattttttcctggttttattgaggtaaaactgacaataattttacacatttaatatgtacaatgtgatggttatcaaatacacattaccacggtcaagattattaacatatccatcacctcatatagttaccattgtgcatgtgtgtgagtatgtgtgtgtgctgagaatacttcagatcttactctctgcgtaaatttaatggatgcaagtcagtattattaactatagtcactatgctgtatatttgatcaccataagttattcatcttataattgaaagtgtgtaccctttgacgaacttctcctgatatccctgtccccagctcctggcaatcaccattttattctttacacttttgaaatctactttttttttcttaatttaattttaagttctgggatacatgtacaggacgtgcaggtttgttacataggcaaacgtgtgccatggtagtgaacagccatgttttcaatacatcacaagccatagtagtgagaaacaccatttctttttttttcttttttaattattattatactttaagttctgggatacatgtgcagaactttcaggtttgttacataggtatacacgtgccatggtggtttgctgcacccatcaacctgtcatctacatcaggtatttctcctaatgctatcccttccccagacccccactccccaacaggccccagtgtgtgatgttccccttcctgtgtccatgtgttctcattgttcagcttccacttatgagtgagaacatgcggtgtttggtcttctgttcttgtgttagtttgctgagaatgatggttttcagcttctttttaaaaagattccacataaaagtgaaatcacacaaaaaaaggaatttcagaaaaactaaaaaattgaattaatatactgtcataggaaaaaacagaatttccaagaggagtgggggaaaataatagtatcagaaatataataataatagatctttttcctgtggaaaatagtacatagaaatagaaagtactgaaaaggagaatcagaaaagattatggctccagaatcacattatcttctacagtttgaagaaaaaaaaatgtggctaaaagaaaaaaagtatttccattacacaccttttataatgactagaataaaaaaatactaatatcaagtattgacaaggatattgacaaggatatggagctactgaaactcttatacattgccagtgggaatgcaaaactggaaattacccaaatgtctttcagtgaattaatggtaaatgatcttctgtatatccatacaaaggaacactacttagcaataaaaaagaaacaaatcgtgaaacatgcaatgatatgaaagaatattttattttatttttttaaagacagggtctcactctattgcccagactaaagtgcatgatcatggttcactgcagtctcaacctccctggctgaagtgatcctcctgcctcagcctcccaagtagctggaaccacaggtgcacatcaccatgcctagtcaattaaaaattttttttccttagagacagggtctccctgtgttgtccaggctggtttcgaattcctgggctcaagcattcctcctcccttggcctcccaaactgctggaactccaggcatgagctaaccatacccagccatgaatgagtcttaatgcatcaagctgagtgaaagaagccagtcttaaaaggttatatatatatatatatatatatatatatatatatatacacacacacacacacacacacacatatatatacatatatatacgtgtgtacacatatatacacgtatatacacatatatatacacatatatacatatatatccatttatatgacacgtatacatatatatccatttatatgacaactcttggaaagacaaaactataatgataaaaagatctgtggttgccatgagttagtggtgagaggatggataaaggaagaagttcttcagtgtgatggaactctttcatattctgatagtggtggtggtgcttgttacataaatctatatatatgttaaaattcatagaactgtataccaagaagtttattaatgtcagtaaaaatattcaacattttcagaggaaaaaagggagtaactgattacatattgaattattggaaaatacaggctcaaataaagccatggtttctcctactaataagataatttggtaagagataacactgttgatgaaaaagaaacctgcagttctacctccctgccattagttgaccaaaatgagaatgtctaacatagctacaaatttaaataattctctgcttgtttaaaacatagtctctaatagttcattacagtcattactgcctgttaatcaaggataacactagtatttgaattttgtaagtatgacagcaaggtaaagactgttacttaagccaataaattaccatatttcataaaaatctaatgattctgtgaacagactatgtagttcaatttttcttctaaaccctgtaactgcaatgtattttcactgatatttttaaagagttttcaaaggtacatttttttattgtggtaaaatatatattaaaaattgaccattttaaccatttttaagtgtacagttcagtggcattatgtatactcacactgttatgcaagtatcaaaaccacctccatctctagaacattttaacttttccatattcaaactgtgtaaccattacataataatcccatttccccttcctcctagcccctggtaacctctattctactttctgtctctaggaatttgactatactaggtacttactcggcacaatgcattaaagttttatccatgctatagcatatgtcagaattttatttctttttaaggaggaataatattccattctatgtatggaccacattttgttaatccatttgtccattcatggacatttggattgttttcaccttttggctatcaactgtgcattccttttgacattattgtcagccaccagttttttcctcactagtcagactcaagtcatattctgacactctttaggaatataggacatttcatttacaatagttaggtttaaacaggatgtattcatttgctctcacactactaataaagatgtacccaagactgggtaattatttaaaaaagaggtttaatggactcacagttccacatggctggtgaggcctcacaatcatggcagaaagtgaaggaggagcaaagacatgtcttatatggaggcaggcgagagagtgtgtgtgtaggggaactactctttataaaaccatcagatctcatgagacttattcactatcatgagaacagcacaggaaaaaccgcccctgtgattcaagtacctcccactgggtgcctcacacaacacacgaagattatgggagctacacttcaagatgagatttgggtagggacagagccaaaccatatcaggggacctttcaagtttggtcacaaggtctaattaattattttcatgcataggatctaaagagcaattgtatatttatcaacttatgtgttcaaatttggtcattagcttaacatatgtgtttgtatgcatgtcacatgcatatctgtgtgatgatacatagagctgtattatgcataatgttaaagctttattattgtctggttagagaagcagtcactatccagaaaaatggtttccaatgtgaagaagcatgttaaatttgacttcactgaattgaaaattttaagatgaaacaggagttgggttcctataagcggttagcgtgcaactagactccatcttttaacaaccaaagcagaacatctgggtgggtccaatgcattaacattttaaaaaaactttataggttttaatatgcagctagaattaggaacctctgagacaaaatgatcctgagttgggggagctaagagtaaacaagtgaaggtaattttaaaagccggttagggcctggagcatactgagatgaagggaagagaaatttagaattataaatagcaaaagatccactcaagctagaaaagattaagtatccttttagagttaagagtagaagaggcatcagttacaaggataattaatatctagattataaggatctgctattataaaacttatactagaacaaaagtcatgaaaatggtctgcggaagtcatgaggtgagaagaagataaacaggtaaatatttaagcagattatagagttctggaaatgtcatcaagtctcttgattgtgtatatttttgttccatttaaacacttgtcctgaggtttataagtgaaacatgatgtaatttatcatctaagtaaacatttatcttatacaccaaagcacggtgaatacacacacacaaacacacacacactcatacacacagacattttcattaacaagaactagtaccaactacagctcaggaaatatttgttgattaaatgaatcagtctgcttacagtatgcattttcttttgtgctgcagaagttgcaatacaaatgaaactaaaacttctgtgtgctgattacttttctcagtctgcttatctgagaattaaagaatttttaaaacaattttatgtattaatttgcaaacttctttaataatagatgttcattgtaactggtgaaacaataaaagctatttaaagaaaaaattaataatctttcctgattcctttttttgttcccaactctgtgaaataaccaatgtgaagaatatggtatgaattattttctatagctttcttcatgttcatataaacatacgcaacatatttattcataaatactcattaccctgaaaattatggtcattcttccaggttaacagctatagatataattcattcttttcctaatggctgcattatcttcaataacatggatgaatcatctgtccatatcatatgatatgcatgtagtccaattcaagaaatcagtatactttttttttttttttttacaaattttactaaaagtattactaaatttttacacaggatgctcaacaaacactgaagacctatctggtaccagctttggtgaccaagaaagaaaatcagtgaggtactcctggttttttgccctccagaaagtcactgactatcataggggagacataacagtaagttttttttttttttaatttgagagaaacttctcagagaatttatagtaacaaatgcttttaaagcaactatttaaaagaagtaatatatcactagcaattcattcttcattgtttccaatgcatgatcagtatttagtagcaacagaagacttccctatatgatgactcaaaaacaaatttccaaccactaagaactcagataaaggaccttactcttgagacctcaaagtgatttacatttccactagtacttctattgtaatatatgatatttataaactagccttattccatggaactctaaatatttaatgcttcacatatatcatttgacttttctgcatgtgtcattaagataggagaaagtgtcccctacagataaggaaaatgatgttaagacaaaactgacaacacctgaatcaagtctccagatagccccatactctttccttccaattatacttgctgccttgctagtggtaagcaatgataacgtagacagtattatgtcatcaattagagagtctcacttagcttgatataatcagtttttatttaaaaatgagagctttccatgcaaactgtttttctatcttctaaaaggcttgtgactaaaacttcactgacaagtttttcaggtgagatgagtgtaggttaactactgagcagccagagtctagtcaggcccctcacactttccagtgctacaagaagatgagcagatgtggggttagatgtggaacccaggttcatagctgtacctgccaaccctaacctagagaagggaagagaacactgatggtaaccatggcaacagtaacaatgctacacatctatcacttattgattatctaacaaagtcttaaaatatcaagtaatgtaagcaaagaacaattcagtgaaattttagcaaaggttaggcaaattttatatggtcaagatagtacatttgcaaacaagtagaagaccttgtcaaaaatctaaatcttctaatatccagtaactctcttgtctgagccaatttattttcctacatctttgaagacattttattaaaaaaggttataactgagaattcgacagtaatcagaagagtgatcttcattctgtattcagtgtctcttgaccccctgaaagaatctcagctcagcatggcttcctcccttttccagttgactcagagaacggtgctttcaaattgccttttgggatacatgaaggggtgcatttagagccaacctgaagtgtaacactctttattgttcctgagaaacgtgtgcccaattccctagaaatttactgtttcaaagagtcacaagctcctgattgcttctcatcagtcttgaagagattagataagcttcctccctcttacaaaagctttttcttcattcaaaattcctttgagaacaaaacattgaaccagaattggatttttaacaaaatattataagattgttgaaaacatttttttttctcctgaggagaccaaacaattcaaaagatatattaatgcacattctgatttagggctactagcaacatattgcaaagagtaaggtggtgccaaagaacaaagtcccttctgctaagcaggaaagatattttttaactgccttactttagaagatttcaatggactgctaagggctttcacacagataatctcagaagtcaaagctcaagaagtagggggaagaaacaactactggaggaccctaacaggtagcattgcttctaattaccgtaaaattgttatgtatactgatgccccacatcccattcccagactcagataattattctacagtaagagttggctttagaatacttgttcaagtgtgtcagtaatagaaaatgacctcttcagaaatgggggtgtttacatgcagtgctcctaaagttggcacacatggaaggtaattcagggttatgtttgcagtggcacccatcatcagcaatgtttcaacccccgtccatctctctgtcctggttttaccaagggattcacttcaaatgtattcctcactggtctttagaaaacagtgctagcaattcataagtatgtttgaattttcaaagtttttctttttctttttctttttttttttttttttgagatggagtcttgctttgttgcccaggctggagtgcaatggtgcgatctcagctcactgcaacctccgcctcctgggtttaagtgattctcctgcctcagcctcccaagtagctgggatttcaggaacctgccaccatccccagctaattttttttatattttttagtagagacagagtttcaccatgttggtcaggctggtctcgaattcctaacttcaagtgatccatacgcctcagcctcccaaagtgacgggattacaggcatgagccaccgtgcctggccccaaagttttgcattttgatagcagcaataaggctgagtaccttcataggcctttacctctgatcacactataaggctttaattaagttagtcttaagaagaaaaatgtacaccaaaccccaattattaaacattggaattattccttcttattggtctaataattacaattttttacttctcattcatttttcaaaggtttttttcagtagatctaggttattggaacgattatatgtgatatgatggggtattgggcacagacacagtaaatcaagatgatgcagaaatgaaagtctaatgctaaagatcttaccaatcttcccagatccccatttttcaaaggaggaaatgtatagaggacattacatttatttccagccattatgatataattataaagccaacctctcaacgcactctctctttttgggaagtctatgacagcaggtattacaattctactttgccagatgaggtgcgtaaaccatagaaaactaactagcatccaagagaagaacagacttggatgtgggtagaataataggaagaacacttacagtcagatatatcagagtatgaatgcaggctcaagcttttttccactaaaatgtatacagcaatgtaatctcactgagcctcagtttctgatactgtgaactaaagattatgacatcaatctacagtcaatgctgtgagaattaaatgtgaagagttttatggagagggcatctgctaaatgtaactatttttcttaccctcctaaattttttcagtcttttagacatttgggctattagagaactaatgacctctgtgaccacactagcttaggctataactaaatgcaacagatttaaaaacaccaagcaggagatagcacagagtttgaatcagtgaggtctaatagtaatacaaacctcacttactggctttgcaattttagatgctacttaatcgttctggggctcagttttttcattataaaatgggaatggttcctactttgctgggtagttgctgagtgtggtagcaaggattacagacaactctttatacagtatctggtatattaggtaaatggattgtaatatatattgttcagattttttattaattaaggtttgtacatagactcatctcctgcacttaatatttctttttctacacaagaccttgaaagggttatgataggggctttgatcacatattagctggtttggctgtggtaatttagctcctgagtattgggattacagtaccagcccctgccattgactatttaactatgacttggataggaattctaggcctgaattttgttcgtctccaaaatgaagaggttagaataaataattcctaagattccctgtcgctataacattttctggttccagggtctttttactgagctatagcagataaatcctcatatctttagagcttaagctacttctctatggtttaatttccacattccctctactctatttcttctttaattgcaaaaggggataatttccatcactttgcaaacaaaccaatatctctattctggcttagtggcataccatgttattaatgcatcatacttaaaaaaagcctggattgttcttcaatccagaaatccagtcatgttgtaggtagtaataatgagaataatgatgatttattttcaaggttttctatgcctccaggtgcccggtcattgcacatgataaaatacaccaaaattaaaaatgagattaaggtttaacagataaaaaatacattctaggaacaaaacacatttttggtatgcatctctacattacacaacagccacttaaaaataaacaaaaacaagaaatccgttaaccaacaacagaattttaataattattaactagaaagaaaataaaattaacttgaccttatcttagaaggttgtcagagatctactctgtttatgcaagtgagaaatatgttttgaattataagacctctatttcagaagtccaagctctcctcaaactcagaggtaaaccttcaggaaggatttaaaataaatgtatggattttgttagcatgtgtatattatttacctttgaattaattttgatcttgtcctattcttgagctatccttcaattggtatttttgtgtgtatctactatgtgctttcccactgcattcagaataaaattaaaattcctcactctggcatttctctgaccacacctccagccattctgctttgctcactttgctctggccactctgaagtccttttagttctttgaatacagaaagtctgattcaaagctttgcatttgaatacaggattttgtatatgcagtttctgtctggagctttctcccctcccatactccgttctctaccccaaattcttcacctggctgatattattttctgtccttcaatgttcaaatcaaaggacactctctctgagaattctgtcctgaacacccaaaggacagtataagagatttcccccactcaatgttgtcttgcatacataacactttatgtggaccacagcttgtaatgttgtaattatgtttgcacttattacatgtctaatttccttaggagactatcaatttcatgatgaaggtctaagggatcatttctatatttctactattaaatatagttgaataatgaatcaatgattctattgtggtagactcagtagggctaagaaatgttaattaaatatggactattcccttaaaattttgttttctagtaaaggaataaggcatacacataaagtgctataaaatatagaaagtaattcctgtctcaataaaagtgtagatgagtattgcattagtttcttagagctgttgtgacaagctaccacaagcttgttggcttataaataatacccaatatttattatctcacagttttggaggctacaagtccaaaatcaagttgtcagcagggtcactacaggtggtaagtaaatttgatagttaggggagagtggattgtttctgtccaggtcaaggaaagaaggattcatgaaattcataacattggaaatgaacttggtaggatgggttggatttgcatatgaaaaaattgaatgatggacattccagatgctggaacaatatgaataaaggtgagtaagagaactcggcctgagtttatagtacatacaacccggtaggtgacaattaactaagaaatgggatcagagttagattttaggatgtcatgtatattgattagggattgttatacacagaattattgaaagttttatctgaacaaaggcgacataatcttagtactcctatattaggaaagttaatggggcagcagtgtttaggataaactgatctccctgctccatctctttcaattaggagatttttgtaagcaagagaagataaaatcctgactggaacaggtatcaaagaaagagaataaatgagacttggccacttactggacatctaggatgtattaagaggaggaaagaatgatatattttgagtaaagatgtcctagagaattggagttagagaagctaggatagtcaaaagcaggatggtttttaagtagaagaataaattaagttttgatatgctgactcagagaaactagtgtgatttctagttgaagatttaaataaggatgttggaaatataggactaaagttctgaagacatatcaggactggagatataaatttctgagttatccatagtgaaataattgaagtcatgtaactctgagaagctgtgtcaagtcatgagaagagtatgaatgtggagtatgacagatgtgatcacatcctgtgtctactatttacctgttgtatatcctggggcaaattgcttaactccaccattttctcatatataaggaagaaaataattttatcccttaattaggattacatgagttaaatatttaaaagctctgtcatgtttaagctgcttttatattttggtgcataattctcataagaaatacacttattttgccatctagtatcttaaaaatatgtgatgtgctttaaaaaatatttattttcctgtgattctagtatatgtgatcttttaaactttcatgacctactaatgcgttgcaacccacactttggaaaactgatcctcccatacattatggttctcatccaattcctcctctagtcactgtccccaacaagcattctatgttgaaatcacaccaatactatcaatgttctcctgactttcatttattactccctcttcataggcttcttgctagtatcacattattccttcatggcctagaaaaaaatgataaccatttacttcctctgctattccatataatgttttgtctataagaaagatgcgattttcccagataaattatgaattccttaataacagaaaatatgtgttatttatctgtgtatcttggtaaaatattttgttataggaggcacagaacattaattcattattataaaggaaagggagaagaggtttgaagagagaactttgttgaacatctacatctaggaccctgctctggtatcaccatgtctcgattcctccttctctatatgccaaagcttccatggaatttttaaagggcagaactattgtctctttgtctttgaggcacaaagacttaaggccactaactttcagtacatggtggagagagggaagacctggatgggttaaaataaaggaagaaactagaaaatgtccagaatttagctttgggtaaaataacaggtttttaccgtagcctctttggattggtaaatgacagaatccaatgaaagcaatgtgaaacaaatgaccagagcaagtaattcattttaaaatattaaagcttatttctttttttttctgactctggaaaacttttctctgatggaaatgacccctggcaacagtgacattctgacaccatgcgtcgtacacacccttgggaagtttgaattccacaccactatggttctgttcagattactggtttcatcatgtctgtaagcccaattaaactactgaagttctaatggtcttatgtccactttgtaaatcatcataaagaatattaagtcaaccaaataaatttgcctctacaggactcgttgctcaaccaaaggcatgatactaggaacaaaattaaaaaacaaaaaaacaaaaaaaaacacacaaaaaaacctcttttgataacaaccaatgttttcaggatactcctttatatatgaatttgagattctgatgaaggggactacaattcaacaagtctcaaaaaatgagcccaaggcaatttgctcctcaggaaacattgcttagaccctgattgtagtggaaagattgaagcctcagattgtaaattcagatagactatcacgtctaggtctctaaggatgatctgcgatggtggtcaatatggtttgtgtaacctttgtgccctaccctgtgcctcaatttgcttatttaaaaatgaagtcactagactttgtttcttacatcctttcccactataatgtttggtgatgctctgcccttacatttgcctaaacttttcaatcttaaaatatataaaatgtttttataaaattcttttatgtccttaaatgttattgaacatgataacagtagaattcactaagcctaaatttcatcattttaatattgcctcagaggtcaagttttatgagagccttaatttgcatcaccagaagctcatttaataaaaatgaaagaatcccttttggaaataaattttaaaaactgatggtggggaagaggggcagataaatgtatgtaaaaaagaaaaaaaaacaacttagaaggtgtcaaatggttctgagttctaaagaatattgtggtcatattagtgttgaaaagttggtcctagctttttatgcactaaaagtacattctgctaatggttccttcccaaatccctggcctcttgacccaatacttattgtaccacttgtcccatttccctgaaacaaaatctataatatggcaagacgaactgaggtatcagagcatcatctaccctggaattgggcatatttatttgtggagttgattctagtgtgtgggatataaaacacacaacttaagtggaaaaatgctgaagaccatttcataggtgaaaaggatgtggtatgaatggtcaattctcactttggtcaggaaaaagaagtgtaaagtcaatgaggtaaggggctgggagatggatacctcgtatgatatgataagcagaaaggttgtgtttggcaaattcctttatcatcttcttcctgactgtcaaaaactgtattcaacctgtgtttacaataaatattctctgacagaatgaaccctggatttctgacttttaaaaagttttgaaattaaactaatagcagctatttcatgattacctattattgtgccaagggttagaaattacaaaaatgagtaagaaagagagagcccctgctcttagagaccttactgtctgtgggtttgaactgttgtagttatgacaacaataacaataactatcatttattcactcataccagccaggcaccatgctcagtgggcaacatacacaaagtgccaaagtctccttcatttcaccagatgcaatcacagtaaggtaaccttgctctgtccgtgcatcatcgcttaacaaaaatgaacttagcaggaattcagaccataggcagagacatataagcaactccagaactgtctactgtcaacacacaagaactacagtcaataaagagtgcaatgaactacagtgaaaatggaagcaattgtctgaatcacctttagtgtactctgttgactgggggctgtgacactctaaaaaccacgatacagtagactccacatctggcattccaacaatagaagggtaagtgttttaagactcttagcgaaagaacttgcaatacattaaactgtaaaactgaggaagacatcataagcttctggattttattaccaaaatgtacattttgatctaaaattaaaaataaaaacagattgactttccttgtagtatttcacaacctttgagtgcagcattaaaaatgcttttcttttttttcttcaccaactataagcttctgttttcttaccctgggcgtctgaatcttttatatgcttgggttctattcactgcctgttattcagacgttgaaatcccaaatgttaattgttcttccaagtacattgacaaaacagcagctaaataagggtagaccagactgtggtagactctgacatgcatttatggaacaatggggctctgagagacagccttgtagctcacgggaagacataagatgtgctattttgactgcttcgtagcagaatggggaacacacgcacacaagggaattatgcattttacttagttttgcccaaagtcctcaaggcaacagaatcttgtgatgtcatcatgaactttctttctctccatttccattgacacaaaggctaaaaatttctaatgacatcacaaaggaaaatgaaatctactttgattccaaaagaaatcttttaccttcagtgagactagtaaaaataaaataaaataaaataaaataaaataaaataaaataaaataaaaaagcaagaatctttccagacagggtgtgtgtcactgtgctcatgcacagtgggtgacaccctccctaatgaaattcaaaccagccaaaagaaaggattcacaatttaggttggataaaaaagacatactgaatattgagaccaacaactttttttttttaagaagaaaatcatttaaacatatatttcttcagggacattcaaatttttactcatgtctggttactatgttaccaatgtttttgtccttttttgggttggtcacagaaacacagaagaaggtacagaaagctttgacttacaggaatacagtgcagctcaatcttttgtttttaaggtgcagtgatttcagtctctaaatgtaacttcaggcagtctgaaaagaaacaggttaaaatctctttcagttataattggtatttcagatttaattaaaaattaaactttcataatgtttcaccatccaaagcaatgcattatcagtcaagcgtggcttttctttttttcttttttttttttttttctgttaaggaaaaaaaaaaaaaagaaaaaaccctcttcccagagtagttttttaatgaaaagaaaaggatctaaagaggagaaaaaaagcaattctgaaaaacaaaatacgcctccatgttaaggacttcataatgatatgactagaaactcaatgtttctgaattttagctatattctgattaaaaaaaaactcctaaacaatttctacagcctaaagattacagaaaatattaagttcagggaataaagaagaaaatctatgggtctgaatacacatattaaagggaaattatgacttcaaatggaattgtaagaaatgctagatctcctactttccagtgactgaattgctggtgaggtagatggtgaagaagggctaaataaacatatttaacaacacaaaatggccattgaaatgtactgtattatgggtttagcgtgccccatttcacatcatattgtacatcttgtcacatgcagccactgctgtttgaagcagcacaggaagaccaagagagtctgaacaacactccctggtttaagtaactgtaagcatgttgcttattttttaaatatgtacttataattccaaattaagtaacagtccaggcattaagagctccaagtatataataaatattaggcttaaaatattatactattttttgaatcatttctttcttcaaacaacaccatctataaataatagtattttttaaattaaaaaaatcacatcacacactagaattaaatcatccttacttttagctttgaaaaactgatacaatgggatttagaaaaatttagtttttaaaatataaaatgaggtaatataattcgctttcattcactttacagcgtggcagaatactttctatatatttataacactaaatgtcatatgtttacatccaatttcacattagtgcaaggtaatattttaatatttccccatatgagagcataatcacaaatcaccccttaaattgtactattattagaaagcatatgtagttcttacttgggattcctgttttctttttctcttgaaatgtatagaggaatattttgggtaattggtctatttgatgtacatagattttaagcgtaaacatgctcaggttcacagtaaattcactcatgaatgagattagatttaaaaaaaatcactgacattgactaactaaacttttccccctcctctcacatgcctgaattaggctaaaaatgaaccagcgtaaaggcagaaattatggaggcgtcaccagggacaactgaatgagaggaggggagtgcacattatttccttataaggcagcaaaatattcataaaagaaactgacaaaaataacttgtgctcagaaattatgagatataatataaatatattgaataacaataatctctgaaaaatgattcagaaatttaaaactgcccacctctggataaatctaattcaccaactggcattgttctactcaccaacaaaatatggttagcgaaacaaattcattctctagtttagacgtgaaaaggtgatagaaactaggctgaatatttacatataaacatataactaacaactagtaattcaattcattcagtcaggtttccttctcctcaatttgccagatgttgaatgaattgaactatcagctcaaaataattaaatcaattatatgaatagatggtcagtgtaccaattttcattccccccccatgccatttctccttctcctctttgatctttttcttctatttctgcttgtttcttctccactttcactttctttcttattcctttttccttcttttttttttttctcttggtgagggtaatgaggctcaaaaataacatcttgtatcctgttgagggaaacttggtcacaactatccttccagatgacaaactcattcttaaatgtctgtttcccaatccaaagaaaacagagcaattgaaaaaatagagactcaacatcacttacaactaccaacaccagccctcttaattcccatgctgtactactcatcacgaggagaactgaaatttatttacattatacctaacctcaaataggaccacaaataagactaataacaggaccattttgtggcactcaggcaaacggctgggcaaaacagatggatcttactttgcgccaggactcaaaaaatatagtcgccaactcactgttggcgactacatatcttggcccaaagatggacctggaagtaggaccagttgtctttgatatgaatagtgctcctcttcttatctcctcatggaacaaatcagtaactctgtcactatatagtggggttatcaggtagaattgcttaaaagactggtcatcaaggatgtaaaatattctgagggaatgtcaggtgagatgaaggaacagaaagtcaggacaaataccttatttttggcacttttgtctattttcaactttctgtttttttttttttttttaattcaaattcactactgtacactgaacccacctttaaaatagatttcagagtatgtgtcatcaataagaaaacttgtttctcacatttcaggttccaaaatctgttaaaattttaagtcacatagatcaatctcagtcattattaaaattgaccaccagtgtcagacttctttaattggaagaaaactatgtaaggctttatagattacagtcaacatccaatgatgcactgagcaacagctccgtaatcaatgcaatatacaaaatccggaagaatgcttctctggcagagaccctttagcaaaagagttgtacattctgcactccttaaagattctgaatggctttccagagaagtagcaaatgcattatattgcagtaacctatcttgtaagtcacaaggccacaaacaaagcctctagtcaataaaaaaacaaaacaaaacaaaacctgaaggggggtgagaactacagatcttaccattgactacgaacaaagggctgcttctgaccacattctactttctaaaatcctcacacagaaggagttttagatatcaccaggtcacagaacttcaaggaaagaacaacaaagcattccagcttaggaggtctatgttaattcaggcacttctcttattgctcttccaactattcagtactgactgtatcttgctcagattgcttttgagagttcactcatctctctataatttatttattcagacattgtgcagatttgatttttaagagacagccctgtttgtggtcagcatagaaggctaattataatactttaattatttattttagtatttttttctttccactatttaaaaactttttattataaaatatttcaaatatatgagagagggcagaatacagaaaaatgaactctccagtacccatcacccatagtcaattgtttttccaattatactttcacctactttttcttccaccagagcatctgaaagacaatcccagatagcttattattttatgcatgaatactttactatgtgttactgaaagatgacaatcataactaatatcattccacatcaaaaataatagtaattctttaatgtcattaaatatcctgtccatgttaaatgattgacttttaaatggtcttttctttttataactggttagtttgaatcaggatctaaataagatgtacacattatattcaaacgataattatcctttaatctataaattctccatttgctttttaaaattttaactttgtattttggaacaattttagaattatggaaaagttgcaatgatagtacagagagtacccatatttccttcactagtttttcctaatgttactatcttacataaccatggtaaatttgacaaaattaagaaattaatattgacacaatactattaactaaactacagactttattcagatgtcaccaatttttccattaatatgttttttctgttccaaaaatccaatccaggataccatactgcattttaattgccatgtctcctcagtctcttctgatctgtgataacttcttggtcattccatgtttttcatgactgataattgtgaagactagtggtcagatattttgtgaaaccttttacaactttgatttgtccaatcccgtaactagattcggattataggttttagagaagaatacaaaagaggtgatgtgcccttcttataacatcaaaggtatatgatatctcggggtatgttaaccttggtcgcttgcttaggagaatgtctgccaggtttctctatacttagttttaataaacataacagtttattgagatataacttatataacatacaatccactcttgttatgtgtataactcaatgacattaagtaaatttagagttgtataaccatcacctcaattcatttttagaatatttttgtcaccctacaaagatccttcatacccttagggagtcaatccctagacccagacaacaaatattttctctctctataaatttgccctttttggatatttttattaatgcaatcaaataatatgtgatctctttcatgtagctttttcacttatcataattcatttttaagattcttttatgttgtggcatgtagcagtagtctattcccttttactgatgaatactattccactgcatggatataacaccacattttatttatccatgcatcagccaatggacatctgaattgtttccagttttttactgttacgaataatgctgccatgaacattcacataaaatacgtctctgtgtggacatattttttttcctcttagatacctcaaagtggtattgctggatcataagggtaagtttattttaacttttaagaaacttccaaaccactttccaaagtgactatactcttacatctcccctggtaatataggaggcttctaatttgtctttatcttccaacacttgttactatctgtctttattacagccattctagcgggtgtgaagtagtcttttacggttttaatttacttttccctggaaataataatgttgaccatgttttcaagtgcttattaggcatgacttcatcttctttggtgaataacttcggtgaattgtcaaatattttgcccagtttttagctgggttgcttgtctttttattattgaagaattctttatatattatgcgtaaaaattcttatcagattatgatttgcaaatcgcaatcttgcaaatattttcgcctgtctttggtttgtcatttcatttctttaatgggtcttttgaagtgcaaaagttttaaattttgttgacatcctaattaccaaggattttattgaatcaagcttttggtgtgatagctaagaactttttctaacccaaagtcatgaagattttctcctgttttcttctagaaattttataattttagctctcacatttaggcccatgattaaatttttgtgcaggatatgaaataagaactaaaatatgttttttacagtcctaggttcgtgaatattcatttatatcgcatataatcctagcatcaattacagagcactgcttattgaaaagactatcccttcccatgacaaattgccttggcacctttgtcaaatttaattgatcaaaaatatgatgaattttctgaactttcaattccattccattgatctgtatgccaatatcatactctataaagtaagttttaaaaccagaaattgtacgttatctaattttgttttcctttttcaaaagtattttcactattttggatcttttgcatattcgtgtaaattttaggattagcttgtcaatttctgtaaaaacgcctttattctttttgacaggattgtgaattgaactgttttcttaatttcattgtttgttgctagtatacagaaatataattgatttctgtacaatatctcttcttatattcagttaacttgttgaattcctttattagttcgtgtgtgtggtgggggaggtgtatgtacattgcttagaattttctatgtacaagattatattgccggcaaataaatagttttactttttaatttccaatctgtatgccactgattgtttctttctgctggtctgtctaacccttctctttcccttcccctccccctcccctgcagctgctgctgcttcttttttttttcctctaatttgcttctctctctctttcttacatgtatttatcattctgcactggattgaatctcctgtacaatgttgaacagaagacataagaactgacaaccttgcctcttttccgatcctaggagtgtatcggtcaggttttcatcattacatacattataagttcttcatagatgccctttgtcaggttacagaagttctcttctattccttttgttgaaagattatatcacaaatggatactggattttctcaaatgtttctgtacatctattgaaatggtcatgtgttttctcttttattctattaatatgctatattgcattaattaattattggatgttaagtgaaactcacattcctgggataaatcctctgtggtcagcactgtataatgcttttctactttgccacatttggtttgtgaatattttgttgagttttggtgtctatattcatgagggaatctggtctgcagttttctttcattgtgatgtctttgtctggctttgctctcagtgtaatattgtacaaataattgaaagatgacctttcttgctctatttctagaaaagtttgtgaaatactggtattggatagaattcaccagtggagtcatctacatctaggattttctcctaactataaattgtataaattgtatgtctttttattacgagtctgttcatattttctatttcctcttgagtcagttttggtaatttgcgcatttctaagatagtccattttatccagctaattgctaacaattgtccagttgctaacaattgtctaattgttaagcaatgacaattgaggtcaaccaatgatcagtcacaggttgtatttctaactatcaagcaatgaaaaggattatgaggttataatatttgttcatagtatagtatgagatcaggaatgagagagaaggtatcaccaccaaccccatagaaatgagaatgattatgaggttatactatttgtttataatatagtattaactataactatacctcataatccttttcatttctgtggggttggtggtgataccttctctctgattcctcattttggtaatctgtcatcttctctcctttttccttgatcagtctagcaaaagaaaaactaagttttggttgatcttttcaaaaaactaagttttggtttcattaattttctctattattttcattatctatttcattgatttctgttcttatctttgttatatccttccttctgttcaaacagaatttagttttatgtttatatcatgtctatacttacctaaataatgacgtgatgaggtccttttgtttaggtgaattttagatacatttttatcatttcatttccacttaaaggatttccttcagtatttctggtaaggcaggtctactagcaacaaattgtctcagtctttgtttatttgggatatctttattttatatttatttttgaagaacaattttgctaaatataaaattcctaaatgacattttccctttttttccttcagcacactgaatacgtcatccctctacctcctggctttgtttctaatgagaagtaagctgttaatcgtagtgttgttttcctgtatgtaacagtcttttttttcttgttactgtcaaaattttctctttttcattcaaaagtttgactataatgtgtctatgtacagattttttttgtgtttatccaacatggagtttttgtgcttctcaaatgtgtagattaatgttattcatcacatttgggaagtttttggctattatttcttcaaatatttttgagccctttctttctttcctcctcttctctaccattacacatatgttagtatgcttgatggtctctcacaggtctccgaagctctgctcattttttcattgttcttttctcttcaaattagaccatttctattaattgatcttcaatctcattgtgtctttattctgccatcttaaatattctgttgagattctcttgcaattttttaatttccattataatattttttaactccagaatttttgttccttttaaaataacacttatgtttatattgatactctctatttaaagggtaattatagtaatactttaattatttaacatgatttcctattattttgaacatatttataatagtgctttcaactctttgtttgctaagtttaacatctgctatctccacttcaacccaaatataatttctttttttttcttcagacactttcttttaaccacttcttaaattgggtatgagtcacactcctgtttattacatgtctcatttttttcttgaaaattgacattttatatagcatattacagcaactctggcttctgacttttccctgttgagggttgttgctgttattgctgtgtttgtttatttaggacttgcctaacataactctgtgcagcctctcttccccatgctgtgccgctgctgatgtttctgctcagtttgtgtaatttccattttcgtttttgagctgggactttcccctgtgttaacacagtttagtggtcagccaacgatcagtcacaggttgtacttaaacacctagggccactatgctaacgcctctaattgatatatacgtgtgtgtgggttgtagaatgcactcaaagttcaggcagtttacaagtgtttttttgatttttactttccatttgttctctcttatcttctctctgtgtgtccaaagccttaggtcttccccagagtatgtgtgcagcctttcagacctctaggaatatgtggtagcttaccaaagttcactatgatagtatccttttccaattctccctgctaaatttctggccaatctgccagttcttttctactctgaattgtaacttcaggctacatatgatgtttattctccctgcttgtttgcccctgagattgtcactgttttgaccacacctaagggcatggggtttttctatgttctgctccatcaaattatcgaatcaccccctttcagcagtgaagttgtgggttttcatgacttgtcctgccctggcagaactactgatacaatggaactgtggggacggataataggaggaagcactcccggctaaaacactgtgggctcctaactgtgctagttgtcccaacataacttttaatttggccactttcactcccaaaagtatccagcttctgtgatatgatttatgaccttttaatctatagtgggcataaacgacttatgccatatgccatttcttcagcgaatgaccactgcctaattcttttcttagtaatgcaggaatcaggggcctagctgcaggtatccatgcatgtggggtggcgggggggaagtctaactgccattgaatgaacgttttcataatggttacatgtgtatagaaaatcttcaactgcccctcctactacatctctagaaagtttaaaggtttgggggggattaagaatttctagggaagtgtatgggatatagggataaggttaccaaaattctcccatgggagataaatagttttgcctcactctatagagtttggagaaaccactcagcgagaaggactagaattactttggttaataatgagttgctatgaactttggagctggactaacctattctaagcaattgtaaagaatatgtcatttagacttaatcttatacaaaacaataatagctcagagatctaagcaggtccaaatacttacttggatcaggttagtatttgccagcttattttctcacagattcctgggctcactcaggttatacttccttgggaacacacaaagggaataagctccttttggaactcaaataacttgtaaatcagaaagttcccatatggatatagagaataatatttactatataataatttttcctttacatgatgatccacaataaagttcccttgagaatacacttccctagagcatttaaattatgaacggatttacaaaataactcctatcacatgaaaagagataaacatatagtatctgcttctaggaattatctaaactcattttccttcagagacttaaatagatgaaaaaaatcagcaaactttgtttaggaaaaattcagaatgtataaagcattaattgtgaatatcttactgatatctttggatcaacataatacttcacttttacaacatgttgaggaaatcaaagtattcaccaaacttcatctcattaaagtgtcataacctttaatctaggaacccgtaatagtaaagattactgtttctgtctggaaaacaagaaatctaatccatgaaacaaaatcctgaaacatcacatacattgcttaaagatgtaagtctgaggatggagaatgtgatggaactccgtcaccttgttgtataagtgtgtccggaattggtgggttcttggtctcactgacttcaagaatgaagccgcggaccctcccggtgagtgttacagttcttaaaggcggcgtctccgcagtttgttccttctgatgttcggatgtgttcggagtttctgccttctggtgggtttgtggtctcgctggctcaggagtgaagctgcagacctttgcggtgagtgttacagctcataaaggcagtgtggacccaaagagtgagcagtagcaagatttattgcaaagagtgaaagaacaaagcttccacagtgtggaagtggaccccagccggttgccactgctggctccggcagcctgctttcattctcttatctggcgccacccacatcctgctgattggtagagctgagtggtctgttttgacagggtgctgattggtgcgtttacaatccctgagctagacacaaaggttctccacatccccaccagattagctggatacagagtgtccacacaaaggttctccaagtccccaccagagtagctagatacagagtgtcgactggtgcattcacaaaccctgagctagacacagggtgctgattggtgtgtttacaaaccttgagctagatacagagtgccgattggtgtatttacaatccctgagctagacatagtttctccaagtccccaccagagtagccagatatagagtgtcgattggtgtacttacaatcccttagctagacataaaggctctccacgtccccaccagacttaggagcccagctggcttcacccagtggatcccgcacccgggctgcaggtggagctgcctgccagtccgtcgccgtgggcccgcactcctcagcccttgggtggtcgatgggactgggcgccgtggagcagagggcggtgctcctaggggaggctcgggccgcacaggagcccacgtaggtcgggggaggctcaggcatggcgggctgcaggtcccgagccctgccccgcgggaaggcagctaaggcccggcgagaaattgagcacagcagctgctggcccaggtgctaagcccctcactgcccggggccggtggggcaggccggccgctccgagtgcggggtccgtctagcccacgcccacccgggactcgcgcttgcccgcaagcaccgcgcgcagccccggttcccgcccgcacctctccctccacacctcctcgcaagctgagggagccggctccggccttggccagcccagaaaggggctctcacagtgcagcggcgggccgaagggctcctaaagtgccgccaaagtgggagcccaggcagaggaggcgcccagagcagccaggactgtgaggactgccagcacgctgtcacctcttataaggttatcaatagggcaatatccaggctacaatgaaaaagaaacttgaagtctcgaacacctattgtgtatacattagagtggattcaaaataaatatttaaacagatttctgttcctgtggaatggtatttttccagcaaacctctccagcgattgtttttattaggctttgcaatttctataaaaggatatcaaccctgtcccaacttcattactatttctgctattaattaacaataaaaaaaataggctaggcatggtggctcacatctgtaatcctagcattttgcaaggctgagatgggtagatcacttgagtccaggagtttgagaccagcctgggcaacacagaaaaatcctgtctgtacagaaaatgcaaaaattagctgcgcatggtggcgcatacctgtagtcccagctacttgggaggctgaggcaggaggatagcttgagcctgggaggcggaggttgcagtgagtcaagatggcaccactgcactccagcctgggtgacagagtgaaaccccatctcaaataataacaataacaaaaaatagttgtatttcaagtaatataatctagataatctaatataatataatctagataatctagaattcactgtcattcaatgaattatatctgtgtgaagtgttctctatttggtccaaatcttttaaaaatgggaatactaaagttcacagtaataagatgttgtcagtctacattgaggactacaaagaagcatttctataaaatatcctttgttgctaatgaaagttaatatttatcttgatatttacattataatacagtgatccctatacatactgaagagcatcctagaaaattgatttttcttagtataagcattgtatttctttaaaatatataatcagagcccaatctgtaaatgtaggtaagatcctttataggatgctttttaaatgtaggtcaaattcttgcctccttctcatgtttttccactgtttacccattttattttttatttacttaatttatattatatatttcacttactgtcatttatatttatataaatatatttatacataaatatatttatattgtacatgtatgtatcatttaagctatctcaatttctttttgtaacaaagagatatctatctgtctctactgtatatttgtctatctacccttccatgtaacaattcatctaaatttactatatgataccccaacatttcagatgcaatctgaaaatagcaaccttagatcctctataaactcatctatgtttttgtggtgactttagttttcttctaccttcgaagctattcaaatcagaatagcctcaaatctgccttaaacttgtctgagacaaagtaacatatttgtatcatcagagctcagtattaacttaaagcttaactaaccacctctttgctaagtcacctgaagatgattcttgcctttctgtgcacgaataaaataatttgggacctatggaacaacaccaaccattttcaaataactaataaggcatataacatagagcagacacaactgattatatagtttgtaccctgtccaaggcacctagtccaggagtgtgtttcactcaataacccacgttccctagcccaagctgcatctgcttgagcaaagggtttcttttaataatttgcacaaaggtgtccgaacaggcagcttttttctaagttgtattgaaactccatatgagataagaaaggccctctataacatgtttctatagtacttctaacagaatataattaattgtattaatattagctggctctctagctgttacatgtaacataaatattcaggtaacttcctagtaatgactaacctcatgagcttaggtctccatgacttgcactaaagaatgctttaaaaatagaatgttaacaagttcggagacatggattatttgtacaataaaatacttttcttttaaatttagcttctggctcccattccttcaggcagattttatatattagtagttaagtcttaatgaattatctacaggtaggctatacataacacatttttacattaacttttcgtgactatgacatgaatacatgcccattgcaaaaacaaaataaaacagtacactgaaaatatagaaaatatgaggaaagattacgagcatcaatagtctgatgacacagagacaataaaccactactggaccttcaggatttcattccaacgtgacacattttaatcccaatttggcttacccattttcccctgcacacaacgagtagcctcctatttttactatttggtattgtgcttaagcaacggaaatatttcaagtatttctatagcaattgttttctataaaattaatttagtaattgatcaagtactatcatatttaatagccctgcaattgatcattattcatgatactactcattgttattgcttattacttcatgaatttggttttattcaatcatgtcatatggagattttatacacacacacaaaacacgcacacgcacacacgaccggctactacataaatattaaaccatttctccgaaataatatggaggttagaagtagcttctagatgaacaaaatgaaatggcaaatttgatgcttaaaagtcaaaaatttcatatcaatgccaaagatacattattttagataacactctttttctttatttttatttttactatctttgctacaacactacaacattaatatgaagaactgagagtcagctacgcctataaaggtaaagtgccataaaagccccaatgcatctctctcaagagtctaatcttattctatctgaggagctatcctctttctgtgaactctgtcatgtagaattacatcatctcccatggctcagattatctccaatttataaaatgctttaacaaaaactgttacaaagtgggctctgttatatattcatataacttcctcttcactttggttaatacggaaatacacaatacatcaatatgtttcattaaaacgattgttttgatatagtaataagctgggcaaatagaggaagtatgctgggtgcaatttatttacattttaataagacctcaaacaaatgataccacacaggaagctcagaattaggttaaggagaaatggtggctaaaaaatgccttgaagtttggaagctgtaagtattatctaatcaatagtattacttttgaattaagatagaataaccattccacagggacaggtattgtggtctgtgacaaacattattcaatgcagacattaaaaatttaggggagatagaaattttcaaaatttgataaaattttaagactaaaccttagaatatatgccaaatgctaaagtttaaaatgaatgggcctatgaaataaaaatctcatgaaagcccaaagtatgggagttttcttccttaatataccaaagcttactgctaaaatccccatttaatagagatgataacttcgccattcacattttgggtttctcctactatgcatgttaactctttgtgaatagttctaaaaatcaagacaagtatgtactttaatcaaataggagattcagaaagcaatgatttcagtctacaattatagtagcctgcactattcctatttccaaactctgagcaggttcacctttgtttgagacaaattatcactgataatatcttacagattaatgtgcatgacatttgtctatccagtgtagtttccaagacaataaaaaaaattgcagaagtaaatatattatttaagctgcaagtgaagaaacaattataaaagtacaataatgataggaaaagcatgaagaggacagggtgaggtaaatatacaaaaggaatcttgtaagaactgacacatttgctaaaagaacaagaatatgactccgtgtgtgtgtgtataaatctctctctatattaagtctatatgaaatatatttatacaacttatacacacacacacacacacacacacacacacacacacacataataaattgggcgtggtggcttacgcctgtaatcccagcactttgggaggctgaggtgggtggatcacctgaggtcaggagtttaagaccagcctgaccaacatggagaaaccccgtctctactaaaaatacaaaattagccaggcatggtggcacatgcctgtaatccgagctactcaggaagctgaggcaggagaatcacttgaacctgggaggcggaggttgcggtgagctgagatcacactattgcactatagcctgggcaaaaagagagaaactctgtctcaaaaataaataaataaataaataaataaataaataaataaataaatatctctctatatatacacacatgcagaggcatacatatatgcctctataaaaataaatatttcattaggagttttgcaatttccttatttgtatctatccatgaactagaaagtaagttccttgaaagtatgacttatgttttctgtgttgtaattcataataactagcatgatactgagcagaaaattggttctcaataaatatttgtgtgaaatacaaaaaatctaatttcattcatgcacactatgtaaaagaacaaaattaaagaattcccaaaaataagacaaatgataccattacatggggaaagcaagttagattatgctacactacactaagccaataaaattaataccaaaaaaacccttcaagtgaaaataaatctatgtaaatacatgctgaaatcctcagatgattcagactccagagaaatgaaaccccaatgacagcatcatgaaaatgagttgccccaatatcacatatcgtttttgtcatactctacaagaagtggtcaggtgtgattagaaattccaatttcctaatcttacagaatataaacaatctatattacataagtctatgaattttctgaggcattataaacttttatggacattttttattagaatctgaacacaatggtgtttcaatataaaaactcataatttcaattgtgaatcaccattttacatttaaacaattttaaaaattcacattgtgacatgttataccattaggttattaaaaaaactctgaaagttttcttaataagatcataaagttttttctagttatgcaagagcaatttgatagtggaaaatcaattatgctaagtcctttgctgaactgtcacatttcaaattatcctataatgttttaaagggaaagggctatgcatcttaatcccaatgtctagtgaacaatttctggcatatagtaagtgctaaataaaatgtatgatgaattaatttgagttgaaaaatacatctcaagaaaagtctatgtccatgagttacaattggacaatatttaccagaaaaaaaagattaataaaagtcaacgtccattcctaataatcaaataaggattcagaaaatagtatgttaatccactttaccaatatatcaaataatatctgtcttaaatcaacaaccaatatctgccttaaatatgaaaaaaaactagagataataccacataataaaaaacaagaaatatgccctctaccacaacgattacttaactgttttggaaattatagtcaatgaaataggatattaaacaggaataagaaaggaaatagacagtcatctttgttaggagataatttaataactttgaaaccccaaaagaacttaaaagaaattattaaaactattaagagagttgaataaaataactagataataaatacagatagtccccaacttacagtggttcagcttaagattttccagttttacagtgggtttatcagaatggaaccccacataagttgaggatcatgtggattataaataggaagtggcttttctaccaaagaattataaatgaaatataggcaattaaggacactaacaagaacatagcatgcctatacctaaatatatgaaggaatttggggatctatatgaataaaaagatacaatctatttatgtatgaaaacatactatgcttctgaatgggaagactgaatattgcaaagatactaatactgatttataggtttaatacaattccaacaaatattccaatgaaacatttttatgaactcaacaaactaaacaaatcctgactagtaagtaggtgacaaaagccaaagcatttttgaaaaaagaaagataaggaaggattttacctaaaagatacacaaacttattttgaagctctaatggaagcaatatagaaccggtgaaagaactgaaaaagcagatagtccagaaatagatcctaatgttgataaaaattagtaggcaatcaagatgatgtcaaaatcagtggggaaatgattctggaacaattgattaaccattaagaacaaaagtaagtaagatgtttacatcataacatgctaaaataaattctgggagaaacacaattaaaaatataaaacagaaccatgatcatactagaaaaaatggtgaatatttactaaatttcaagctatttaaaaaagaagataaaagtaatgaacatagtcacagagaaaaaaatacacaagaaattgaccatacaaatatttaacattttctcacataaaatcttacaaatcagtaaaactacatgagtaaagaccacaagcaaacaatttataaaaataagaaaacaatgacaaacatgtaaaaaacattctagttccttattaaatcactgcaaattaaaactatgtaaactagttattttgcctgcaatttgtcatatatttatataatgctgctattcaaaacagttaagaatgtagttagaaaagcacttttacatacaattggagaagaattctcaaaggaaccttgagaattttacatcctctagcccagaaatcaactttctaaggatgtatgctaaaaacataatccaagatgcagataaaaatttatatataaaaatgatcctcagagtaggagaaataatagtggaaaatgacctaaatgtcaaacatgaaggagttaattaaaattttttggtacataattaagatataatattacacagctaatgaaaatgagtattttatgactcagaattaataaaattaatgctaagtgaagagatcactatacagactatacaatccaaaatgttgtttagaaatatgcaaacaaacacatatatataaacacctgtacactttagaaacacccatacacttggaaagaggcagagcaaatacttagaattgtttatccatgattggtggtgtcaagtgatttaaatttattcgttatatatattttctattttgacacatcctttcaacaagtgtacattaccttttaatctggaaaaaaaagttattttaagcctaaaatgaatttatgtgggttagaaattcacttaagggaaaaaaatcagataccgataaaaatcactttcatatacatgtagaattactgtgctctttaatctgtgaatctccatacttttgtgcataaagaacatctattgagatattgagatacttgacttttttttagtgctgaagaacacaataattttcctgaattaaaacccaaagaaaataaagtcactcataaataccatatttgactacagcattcacccaatgctctgatggcctttcccgttgttgacttattgataaaatttacctacattgctaatattaataattgttttggtaccaatttcaggaataatcaatctgagaatgtttacttggcccatttagacaataccaaggaaaacacccccaagtaactgtaaccagcatagtgaacagtgtatttgcgttttcacatttcttttccatggaataccaaccttgcctagtattttgcgaataacaatggatggaacttggattttcaacagtgcttaaaaaatagctgccaaagtcaagacatgtaataaccttctaagtaagtttgctggctccatattgtgtttgaaggcacaccccctccaaacgtctgcagtcaccatctgctactcaactgcagaataatgcactgaagtctggtgttgtttggcatgggcaaagacagccaatgtccaactccattcagacatgtgcaccatatcaggaaccttatgacacagtcctcaacatcaatgcagcactttcaagccctgctgcacatcaatcaagtatgtatgacagtcaagctgatagataaaatctaagccaactctaaatacctactgtgcatggatctctctagtttgcctgcagctcaccttctattaagatgatagctttggcctagtcttccatgccaaaataagtgcatggagtcactctggcaagaagaagcgtctacatcaatgtcaacaaacaagttccttgcgcccgaccctaccatctgtcctcctgcttcccacctaccgtactttatgtggaccttgatgaatgagattctaatagtccaagactctagtttagccagcctttgcagatggggtcaacatgactgccctctggccaaatacccagggtgacatagctgatgggttacctggaaagtgcctttttgcaaatttaatgtcagaaataaagcaaatgaaggcgttcctacaggttctgagtttcgggtttatggaaaaaagtgatgcattcaatgcttaaagtgaagataatttttcttttaaattatttgaaaatcttataatgctaaagcattgataaattccatttcaacactacgggtaagggaaataaaatgaatgaataaaagtaaaactggggctattctaatgtatttacaaagtaggtttgagagaaagacttgaaaaaaatctcagaaatatgtagaaataagacttgatagtgtaacattaatatagaagcagattatttcattctgcgttagatgcaacaatattagagcatattgcacatgctaaatggggaataatagatttcatacctattctacagaagttgtatggcacttgcagatttcaaggtagagcagtaaaatttaatataatcttaagtatgagatataaatagtttctggaaaaatctaattgtttttgccttaaaaagatattacatgaaatatgataaatcagtattgtcataaaagtagtaaataaaattattttgttttttgaacatgttgacaaaccatttcaattaggtcattaaaaaaacacttaaaatggagcctgagggcatatgaaacaaacagaaatttcaggaaatgccgctagttccaatccaactcaatttaataggatgatacaatgataagaccttatttttccttcaaggaaagctaaatgtatttctagaatggtctctggacacatcaaaaatagaacaagcaaaaacaaaacaaacattctacctaggaaacaacatcatctgaaactctagacaatttaagtaataataagaaagtgaatcttcaccaaatgagaaaatgaatgtgaaaatatgttacatactataaagcaccatacacagaattattcagagcatctattaaagtgctttgtacatagtaagcatttactaaatgtttgtagaattgactagaatttaattgaaaagagaagtataatgagacttctacaagtagaatcagatccttttaataccatgggaaaaagtttcagtcaaattatatgactaggtacatccgttgtctttgatgttatgaatcaagatgagatcctattatatcaaaagaaaaaatattgttgaatttctctttggagaaatcacagtaaaatgaaaaggatgattatttttaatttctaaatatctccaaattttatagcattcttcggtcaactaagataatgctatagaaatcctacataaaacttgaacttacaatgtcctggcctaatcatctggctaatctctttgagttttcctgaaatatgttcacatcccattttctatgggaattctcccactgattaacacagagaatgagaatttggcctgtgctctataggcaccattgaaatgtggccacctgaggcatgtagggagggcatccagctggcacaccacatgttgccctggagtagtgtacaatgagagggatattttggctaagaatacctggatgatctctataaaggtcctgattatgaaaaggacttcagcattatcattgtctcatgggcataatatgagccagggaaacttctgtttctaagttcatatattttccaaagaaaggacttataagaatataagaaaaaatcaaagaactctatgaaagagaaacactgggccattgatactagattttatgtactatccatatcactagaagaaacttttttgagagctccatgcattttaaaacttatgctaaagcacactatagacttgaccatcaaataaaacataatgaaatctgtaaaataaaggatgcaaaaacatagcgtgaaaatttatgcctgcagtgcagttgttgtactatattttataaaaatcaattaagttcacatactactcacttaagaaatatctgctgattttatttttattttacgcaacttgtgaggaagaaaatccatgcatttgaactgtagtgccaataaaacaattttgtcaattttgagtctatttttttcaaaacaccatacgtgattaaaacacataatgcactagtatttttgccaaattttgtttttaaaccaaagctgtttttgaattacataagcacaaaatcagaatttcaaaaccagcaaacatatttaggggtgaattttaaaataagcccacttgattcattgttagacaaactttgagtgccagggacatttttgtgaaattccactggggtaaatagggtagctaggaaacgctcctcaaagtgaaaaataagtatatgcattattttcaataagttttgtttagcattttcaccctcatactaagtggttctggtgatatttacaatacaacatgagcataaatcttaaggaatttatgatgtcatcaaatgctaagagacaattacagctgggttttacatttgtgtttatatgttattttgcatatagatcccaaaaaccaatgaagagaaactttgatacaaaacatatcctgaaactaaaagacagcttctatctatcaatataaccagttgatagtatttctaagacagagtttgacagtaagtgaaacaaacaaacataatgttttaaatatgccacttcagccactccagctgtcactcaagaggctttttttaatatcattaattcaatgccacacaaacaggaattcggtctttccaataaattttggtgacaacttgttggcagaaaggaaactaatatatatgtggaaacttttattttgtcatcatgtatgtttgtttgaacttgcttaaaatattgtaattgtgggcctaatttacaccttttttcctaaaagctcaaacaaatcacaatgatcacagtgtccctaagactaatgagtcccaatttataccacagaaaatagaagctcagagagctaaagagtactggcagaatattatactgcaagaatagcaatatagcaagtatactcacttgaaatcctaataaaaccataaaaactaccactttgtatttttcattagcttatatttttacttaatgcaaaatattttgcagaaaagttttctagctagctttattgctagtaagagaataacttttattaattgaattaatttttgtaatttgtgaccaatgaggtttgactcacatcgcacattttctttaggaactcagatacttcatagatcttaataccctgatgaaaatttaagtcctaaaaggccaggaaatactgagattcaagttggctcctctaccatctttactgacagaaattcagagtgccaaaagtcagcactgctggttgctgatcatcatatctaaacattgattcttctaattgtgtattttgagacttgcttgattttagaattacaggtggaaagtcacttctctttgatataaattgcatgcaataaagaaggaggcagtcctacacaataaatatgtaaggaatggttttccacctctgcatgctgcagaaaatcccactgagttaagtagggttctaccaaggccacttaaacatattagcctattatgctccacatttctttattgttctcaaaaagctaatgaaatgttccagtgtaatgttaatgctggagtacttttaaaggcattttagaagtgatgtttctctcataactccagaagggggttccacttcctaaaaacatttaggaggccatggggagaccatgcagcctctttactcagactgtttagactcatagctggagaagaaaatccttaaagataatcacttaagagtttcggtgtgagctatagcatcatcgcaaagcgacaggaattaaaaggcagtgtaccgtactactgaatagataggtttaaaatactgtgtactgtctattcacagataacattgatttacgttggtaaatctattggttcagcacatcagtgcagtattaaggaatcaattgtttctccagagtcaattatttttagaaaaataaggaaatgtgacctatcactgaaagtcagtatgtagaattaaacttggccagttttcttcctcgctggggtcttaattttttcaactgtaagataaatgaatcagacttgtcagtatctatgatcacttctagcattaaagttttctagttttaagattctaaataccaacactgtatgttgaggaatagcaaagtaggaaaagaactgggaataaaactatcactgaattattaactttccaacaatcaaaattctgtaattttgcctttagttgccataaacaaccacctcaccttctgaatatcaacaataatatgaatgaaggaaaggttgtatactaaggtcacaggtggtatggttgagattaaagccaagactgagagtatagtaatgaattgagaaatgaatcatacacttttgacctaatatgtaatatgtcttcccaaatcgtcatttttatacattcattttcaatggaaaacaacaacttgaatatcttagaggttttttcccccaagaaagacatcaggctgtaatctccccccacaaaatttaatacagttcatagctcatacccctaccggataatccccaaaatgtcttgttcctttttcaaattagacatcagcattcagtataacaattaatcaatgccaacaatgttccatatgctttattagcattcattcaccgaatccttccatgaacactaggaagtaggtactaataaaaacagaaacaattttgaagtacagaatctcagaggtggttatcagtaattctagaatatcagtctgacatatgggtccctccactttttttcagtgcacaacgtgaacactgtgtggcacagtgtttcaagaattaatgtttgatttatatcaaagcattatgttttttacttcatcttaatagtaatcacaagagtgacttaagcctcctacatgaaagcagagatagaaaaaagatgaccttggaagttacatattttcttttcctgtaagtatgaagacatgtctataagttattagaaccataaaaaaccaaaaaactaataagaataaaattgtgaaagaatattgaaacctccttaataagcaggttcttgtaggatattgaacaaggtatgtatgttgtagccctgatgctatatttgtgtcatgctgagcaagctacttaacatttaggtgcgtaagggtttttttccctaaagtgggaggatttagatctctaaattccttaccaatcataattttagagcaaattatctataaagtcaattaataatttgccttgcttcatgtattacataatagttgctaatcaaaatgaatagtattatactcacagctttaactaacttatagctaagatcaggcttgctttgtaaacatctctctaaaaactcagaagtccatgaatactaagactttttactcctcctgtaatttttgacctctactggaaatctcacctgctacccctgacctcgaatattgcaagtattaatacagtttctgtatatagtgtacttaagccaaaagtcagaggcatgagaaaggtaaaggccgggacaaaggtactacaattcagctacacacttgtaatgcttcccattagttcgttagttatattagttccagaaactattttaacacggtaggctgatactgcaagcaaaaacaaaaatcatgagaacaatgaaatagtaggtcttagcgcttaagcatatctactagtagtaatacttgacaagcagcccaccttctttgtgatctggaaatgatttgatgataaagccaaattctagaaatataactgctatcttttgggagatcaaaggtcatgtgagggggagagctaaggtcaagagcaagccccttaagcctactccagaaatttcactagagggtgctcttgggctttcatgacttctcagttcttcaataagaaccaagtattgcttagataatatattctgcctagtataacttggactccatcatggatcccatatccaatacttcaatatagaattaaaagatatctccagcagaccctgggcctggttttttattttcctgtgtaatttccttgtttctactgatagtacacttgtgagtttcacaaatttaagacaggtaagagatcttaagaggtctccaaaagtctacattctattaaacaaccacagaaacttcctaatacatcaaagtaagattaaatggggattaactgataaatctatttttgcaaatatatgttttacaaacatattttaatcttataataggttcataatttatatacctattggaagaattattattccataagatctgtagagaaagtctgattgtcaaatagaataaatttcaattatttatatatgtattattcatatgtctcatgacatcaaatattgagcaccaagtaagtactgaataaatatttcttgaccctttattgcacatacatatttttataacacgttccaacaggatgacatataattaaattttaatctctacaccatatgtttgaaattttttctataaatgcagtttcacctttctggaattcacgtttaatgacttattctgtttatttctaatgataatcgctttttatatactttccatttttgctacgtttttaagagaaaatgaaacatggaaattgttttgttatgtgattaactttttaatgtttctatttgtttattagaagattaagaaggttatttatttctacattaaaatattggcaatggcatatatcaatgcatagtgattttcttaagaattgcaatgagtgactcagtaaaattcttcttcactttcaggatgtaaagaattatggctactagccattatgcagggtgatgttcttatcacacataattgaaaactcaatagttttagcatctttagggttgacagtaaaattctgaggttgactatggaatgctaagtctttgaaggcacttccaatttggctaaacttacagtttcattattccttaattgaattaagtttaagtttctcttaaaatcagcttgaggcttttgacaaattagaaatttgggtcctgaatagtagccctttacaatatatgaatctgcataaagatgtgttttaaatgcctatttgataaaaagataagcctggtcacttatggattctagctcctttcaacatcctgcatggattgcaaccagtgtgaaaaattggggatctttaaagtggtctcagatctcttataaagcagtcacctgggctcttaaactgtatggtgcttctcaaaaagggctccttaagtatcctatctgatgtatgttattccccaattcaacttgcaaaggacagagtcaccagcatatattcaaactgtatttcatccaagtgggttgtcaataagcttaaatcactctatgaagaactggcaaaattcccatggatactgtgaaaataaagggaatcaatgaagagatataattattttagtctcagatttaattaatttgtgggagaggtcattttctctcaaatatattcaagtttcttcaaacacaggtcaatgtttgccagctgataggaaaaaagaaaacatttagtctgagtttcccacgtttatattaatctctgtatcacagctaaataaaatgtttcataaatcttcatataggcaaaagagagttcaagctaaggcagagtaacaagtattgccaatagaaaataacctcttaagtactgtttctactatttcctgttctaatttttctattggagagaatgaaacaaagtaatttcacacctggttttatgaatcagctcactaaagattctaggtagaagttacacgggagatgcaagtataacttcattattttacaattagaacactaagacaaagaaagaataaaagtggcgtgctatcccatgccatgcagttagcatatggcaggtcttactcagagtccccagttcctaatctagtgttctttctactgcaaaggtttccagtgctgcttggtttttcataaaggatctgtatatcatgtcaaaatttcatgttgactttccttgaaatttcagagaaaaagaaggcagtataagaaaaattactcttcattgtctaactcttcaagtcagacagcattcctatgtgcaatgatcctcgatacagtctaggtcaactgatctctatgagttttcatactcattaaaatgtatgcatcacaaagtacaattaatgttctcactgactttagggaccttgcatgtttcatccgttccctaacctatgccatcctgaatccaagaggcaccctgtatttctctgaaagtcagcccagcatgaaaatactgaaataagagtgcaggtgtactctttgctttaagaagacacaataagccaaattctgaacttaccaaacagacaaattatggggtgattattcacattttaaaaggattcaccacaggatgcttttaaatcataagctgctctattgcattttaaataagttgatttataaagcttcctttacaaggacttttcactatccagggttcatggttccttatccaaaggcaatgagagcttggtgagcataaagtcctattacctgctaagccaagcttcctttcccaaataagagaataattaggactgtagttcatttttgaaaaattaatgagtctctcactcctgaaaaatttaatataccctgagcacttattatgtgcctggcacagtgctaggcattttagataatgatcttatttactcctcctcaccacaactctaggagattagtacaattatcccaatcatggatgaggaaactgggactcagagaagttagagttaagtaacttgactaaattcttgcagcaaataagtgatcgtgccaggattcaaagtcagatctgtctggagctcttgcccttacatattttacaatataatttcagatgaaatttaatgacgtctcttacctctgacctaactgagcataattgcgctccaaatgtactattccagtgcagcaatcctgtctgtagcaatagggaccagtcacacagcctgaatacaaaaagatagggggctcactaacaaggttgcctattctggtcactgcactgccatattaagcccggatttatctcctgcaattcctacctattggatctaactttgctctacagtcattgagaacaattaaaatcccttccccccatacctatcatatttctcttatggtttctttcttctttttttttttttttttttttttttttagtatccagtgcctccaacctttttaaaatataatgggtttatccgctatttacatatattttattctttcttgaaactggttcttctggagcacagagaacttataaatgctatttctaagcgtttatgcaactaaaaattattggaacaatacacagtatagtggataagggcgcaagctcagaaacccagactgcctgggttcaaatccaggctttaccaattaatggctcgatttccttggtgaatatatttaaagtctctgtgcttcagtttcctccttcaactatgaaatgaggacaacagtacctagttaatgtggctcttgtgaagatttaaaagaggggcaatattaagcaaaaggcaatataaggaaaattactctacagtgtctaactcttcacgtcaggcaacattcatacagcaatattcatatagcgcttacagcctgctaggcagcaattagggtactgcctaggttgtaagctttatataaatgtttgtcattattattgatggtataggagtgaatgaatacttaactgccttggaaaaatatgacctatatcattgtatgagattgattttattatccagatataaagaagtcaagctcaactagaaaaggcacttgactggagaccagagatgtgcttctagtcccaactctttcaaacactccagatgaaagatcttggactttatctacctcatctttttaaacagaggaatgggactgtacctctgcctctaaaatgatatgtttttattctaggattctaggatcctattccacctggaccctgcttaaatttcattactcattatgtttgaaaactaccattacatactaacattttatctgcatgtttatatctgttgacatttcaatcagcttatctgcattgttttcacgaaacagaataagcctctgagagtctatagacaggtctgaaaaaacaaaaggtgttgtgatagcacagagaggaatttaatgtcactttggaggaaataacctaaagtcctactctgccaagccagtaaaatcctgtcctctgcctgcaacacctggcccagtccatgctatcttgctgaatttcagtgcagctctttggataaactcaaattcaggtttggatggaataccaggttgatacaacagtcattttttttcaacagaagtgcaggttggactaccttttacctaccaaaatcacctcattctttgatatatagaacatttagctaattttattatgacttagtatgccagtactcctcatatactttattgtccatccccagatctagtgaaggcatggtgactggtatcagtatcaaggcaattgtcttcaaagaatgtggcaatctattctaacaaagtaaattccacaagggaacaaggggacagccactctaaattcactaatgacaaaaactttgatattttgtaattaagcacaatgcattattctataaataaaaatgatgtccttgtaaatctaaaagctatgaaacgttatattttctatttctaaaattctctaggctcaaagtcaatatgtaagtctaatttttttaaatgcacaaaaagctatgatatttcaaatcttagatactaaatttgtgaattgagtgaacctggcttctcccgcttagacgtgaacattcctgttagtacataaatattaacgaatattttaggccaaaattttgtgtttggtgattgacttatggaatcagtctaagtaggtgtgaaggtgactagacttattttggaacatgtacaatttcataacagtaacacggccgttaaataattctctttaaatgatatttaactctcattttaactgttagcccttgcattatgaagcagcttgatgctgaagtaaagctaagatttcagtaaaaagaataagagctttatattctagaaggtagaaatcctagaaaaatcaaagaaattaaaattttggaagtttttgattcatttcttatattttaaataggattctaaaataacatatctcttctatacataagaaaatagtctggttcacatattttgatttattgaaaagttattacagtacaactcaggttgccgaatactaacattgctataccagcgttgttttggtaaatgtttgcattataactctggttgtattacagcaaaacactcagaagaaagagagtaacttttacacatattacatagcatctgtacagtcatcccttaaaatgcaacaatacaactgcaacactttaaatactttaaaatacaaatgcctttgaagaacataacttatatactatttattaataggattaaatcaacatttttatggctctctaagcttatcccagaaactcttccattatttcagtgagtaacaagagaattttttttattgtttatttttttttagatatggtttcactctatcacctaggctggagtgcaatggtgtgatcttggtacactacagtctctacctcctggactcaagtaatcctcctgccccagccttctgagtagctgggaccacagatgcataccactacacctagctaatttttttttttttttttttttgagatacaggttctcactatgttgtcagactggtcttaaacttctgagctcaagcaatcctctccttggtctcccaagtactgtgattacaggcataagccactgcacctggccgagggtcttatagataggtaatattaacaccattttgcaaaattttaaaaataaggcaaggaaaggttaaaataagttgtacaagttcaacaagtagtaagtgaaattcagccagactttgaacatagacatcctgttttagaatctcaatgttctttctatttttcccaaagcaatctcactaactaatgtacgtattagattgcactgatatagtaaggacaaagaaaacccattttctgtgtatattgctattgccttagaaaatacaaatagctactgaaaagaccaatgctatgaagcagtttggtaatacctattaaaaattttaaatctctgctacactgtattaatattttatatcttaaaaagttaaagaataatagagcctaacttagatccttccaaatttgtaactcttcaaaatctaaaatgaatttctaattcatggcttataactgctcaagtaggaaacttatgacaaaaccagagacaagcccttccaacagtgcctatgacatcacagatatacaaatctgccccattttacagtacccaaagaagaccggaattcagctgttatcagacaataataaacttcttctggtaagttcgtctcttagtcttagatttacattcccactgtcagcaagaatttttaagttaaacatttttgaaaagtaaaaattcaataaatagcatttacattatccacagaatgtattttcattgctttggtgctaaaatattttattttaggctgttcttttttctcttttccatccacctcttagctcctttgctccaatccttgcacctttccacccttgttctctctctccctgaagcctcagggaagagggctgcaaactgtctggatgcctggaccctcacgctcctgagattaaacccagacccgcccatggcaagagtcccgttctttgtctgaagcaagtgtctgattgagttagatatggagtcgttatcacattgaaaagaaagcctggattttttttatctttggtattaaaatatgttatatttgtattaaaatattcatctaataaactctcccaaagaaaacagtttcattatattttcaccgtattttctcattccattcttaaagccacagtgaaaggaaagttgttgtggtcaccccaaaatactctttcccacttctaatcaaggtctggttaggacaaagctaaacaataatttctactttgtatttaaggacaccagctactgtttacccactgatgttatttatactaatagggggtctctgaagtgacacctaaagcttgctaaaggtttcaggagggcttttgtaaagtcaattttctcccagtatcgctttatccccacagagtaagcagatgggagagttctttttccctcaaaataaggcttatagcattgactagggaatttaaatgtatctttacaattctcaacttgatctcccaggaagagcttttatagatttggatttttttttgtcataaagtattctatttatttcccagcagctggtgtcaaaaaagttgtttttttaatattccttttaaataaataaaatctgttttcatattgtgtaaaattagttttgcctgctgtgagtttgtggcattatgaagtgatcatttcttcccatgaattatttaaagtgaggatatcaaaatctgatggaacaatacaatgaactatacaatacaatttaattttataatacgccagttcataatagtatctcaaaatgcacagtagttgcaatacattggttcagaattagcagatcaagtataagcccctcagtttcatattttagtatttgagaatcagttctaaattttctagtggactagagaatcatgcatatttggtagtccatagatacctaaagacctttttgctaattcctcatgccaggcactgatgtttgcccagcctagatgacattttttttctttttttgtaaatctttaagacattgagtttgacagctgttaaccctttcattacaaaacaatattggtattaatagcatttcccctggagttctctgatcactttgtcttagggaacaaatgcacctatgtagccacaattattcttactacttattctcactgcagagtttctagaagaagggaaacaacgatccattcaaatgccccactgcacttataagacttacagcaaagctgctaaaacttaaattttaaggtgagtgaggtggcataagggaaatgaatgagctgctaatgaatagggcaagacatgattagaagctataacaaagtctgactcaaggaaaggccaaaggttatcttgtatttgatatgtgtgttttaataaattataatcaaaatactacactgactttttcctcagtggattttctagcattctataagagatattttgtctgattaacttgctatattgaaaagtgggagtcagtatatattacttacaaattctcaaatagcctctgaaaaaattccaccacaaagattttaaaaaatggaagtatatggaaacaagatgctacaagatgttggaaatggttttccaaagcaagaactggcttaaaacatagaatagcaataatgagcacttttcttgttagttctacatactgtaaactaatttatgccccaaacagaactctggtttccctattatccatgttgccacttcctcctctaatctaactgtacttctctcgtctcagtgaaaggtgccaccatctgccctgacagttgatcaggccaaacatcagcaactctttttgcctcacccaccacatctaatccatcaataagccgcattaacccaaacacaaaagtacatcccaaacccgaccattcctcactatctctgctatcacgaacaaaaatcacaattatctcttatctggtctcctaactgatttctctgcttccactgttgcaccttataatccattatctaaacagaagctagaattcttgaaatgcaggaaagatgatatcattcctttggtaaaattctacaagttatatatagtgcaataagaagaaattaaaattcaaaaccatgaccagtaagtctctccattatctgttcatgaccatctttctgttctcatcttctaacatttttcctttgttcaccgtgcttctttgcctattctgtctctaaaacaagccaatcttattcctattagccctggtctagctatattgcctctgcccagactgctctgttcctacatctctgcatgactgatttcttcactcgtagctcaaatattatctccacagaaaggtctttccttgtgtggccaagatagccaaagcatccccaattcattctaccctgctttacttttctcttagaactaattactagtatcttccttatttacatcctgtatgtatgtgagtatgcacatgtacctgtatgttcataatctctattacagtataaattccatgaggatgaggttcttggatgtgttagttatctattacagcataacaacttacccccaaacttagtaacttaaaaaagcaaacaccattccacagtttctgtgggtcaggaatctgggctcagtataggtaggtgcctatgggtcaaagtttctcatgaggttgtgatcaaactgtcagctagagctgtggtttcatctgaattctcgactgaagaggaggagacttgccatgtgggggtcttcacatgtgaaggtcttcacacaggggtcttcacacagggctacttcatgacttggactttgctttttctcagggagagcaatccgggagagagtgatagagggactcaagagaaaaaccacaagctttttaaaaacttaaccttggaagtgacatcctatcacttctgtcctttattaaaaatgagtcactaagtccagccaatactaaaggagaggaaattagacaagcaggtgaaaatagaggatgtggagatcaggtggggccatcttagaagctgcctattataattgcttaccagtacattcttagtgttcagaaaaatttcggactttcagtaaacaaattaatttaaaaaatgactctctcatgaattagttccattggacattttgccaatgatcaagaaaaagtagtgaataaaatctcactcaagtagtgacattcaaaccaaaagagatcaccccagtaggaaggtttcattaggatgtgtaagcagaaagtagcagtacagcctcagtttcttcatctgtaaaatataaagagtagttgtaccatactgtcggagacctaatgaggcaattcgtgagggcctcatgaatcaaaggcagtggatagatgttagctattatctattcttaataagtataaatgcaagggaagcatttttagggaaaataacacaaatcatgtttttataatgatggtatttgatacatcaggtttaactcaaaaaagaatttaagaaccactttcaattgtttcctaattatattagcttaaatatgagactgtaaccaaaaagactaataaaattttggaactcatcaagtgtactgaaaataggctagaaagctttccatatatttatgtaaagttttgacatcttcgaatggacataatgatgcatttgcaatctccacaatcatgagggcctaaagggagagagatgtgtagagccctggaattgaagatccatggtgtgactggggggggaaagtctctgaaaagttaaaagaagacagggcactgaaccctgatctaatatgtaatggggttatgaaatttaggcagagggtagtcatagaattattcatgaaatcctagaatagtaatactagaggtcaaacttcatattcagaaaagtacaaatagggtcaggtaataaagcactattccatatttttttttaatgcctgccttggaaggtagcaaaacttaagtaagaagttggagaaattcatagaagatataccaaaatagactgtagtggatgtatggattggagtttgccatcagagaggcaaacaaggatgtctttaaacttatttactgatgtttccatttacaaccaaatggggtagatgcatcccacatttaaagaagccattccaaaagcaggaacagcacccctataagatgttatcattcctgttctattaattacagtgtcactcactcttttactgatagccctgatggagaatcagcatgaaccagccattttcctccctgtatatacattagcaaaactttgaccattaaatagttcaaagataggcttgcctcgctgtctcatgcctataatcccagcactttgggaggccaaagtgggcagattgtttgagctcaagagttcaagaccagctttggcaatgtgccaaaaccccatttcgacaaaaaatacaaaactgtgcttggtgtgttggtgtgcgcctatggtcccagctacttgggaggctgaagtgggaggatcacttgcgtgcaggaggtcaaggctgcagcaagctgagatcacaccactgcactccaccctgcagcctgggtgacagagtgagagcctgtctgaaagaaagaaagaaagaaagaaagaaagaaagaaagaaagaaagaaagaaagaaagaaagagagagagaaagaaagagaaagaaagggagagagaaagaaaggaaatctcagatatatctataatagaggaatctctcaaaacaatttctgcaatatccagtgtggtggatctaatggtgaccttccaaaagaaacgcccacattctaacccctgaaacctgagaatgtgaccttatttggaaaaaggatctgtgcagatgtaatgaggttaaggatttctagatgaggtaatcctggattgcccagggaagccgtaaatccaataacattttcttataagagaaaaaagagaagacagagagagcagaaggccatgtgaagacagaggcacaaactggagttacatagccacaagccaaggaacctctggagccaccagaagctggaaaagcaaggaatgattccccctcacttagagtcttctgagaaagtgtagccctgccaacaccttgatttcagacttctggcttccaattctgggaaagactaaatttaagctgttttaggccatcaagtttgtgctaatttctaatggcaaccctagtaaattaatacacccagaacaagtaattatgttttccagagaggtaatgcaatgtagtaaaaaaaaacattttgagtgagacagatttaggtttagacctggggtttctctatactaattgtgtgtctttgaacaagttactttatatctctatcttcaggttcttctttagtaaaatgatggtaagtttcccttgcagggtcgctgtgtgatatgttatttctgctcaattcagtactcaattaacctgttaatgataaattcacgcatgtgcaacatgtctacagacgttaaaaactgttgttttccttgaaaatcaacatacattttagcaaggtattaattagaacatatgggattgattaatgtggaaactagttgtacaataccaaatgttttaacaaacctttattacaacctgactattcatgtcatttcaaataactttcctggttgtcagtggaaccatattcagtctgttcttttactgtctcatctgtaatatcttccatagtttctaatagagaaataatgaaaaagccagagtattagtagaaaatgtttgcgtctagcttgagcttaagtcagatatagagtcaaaattgtgatcacagaattctcctaaatgttagtctcagaaaattgacaagggcataataatttctaggacagagtagtcaaattcatacccaccattgataccttcctatccctgacattaaaacagacaaaaaaaagtagttctcacaataattttatagaggaagaatataggaatcatgcagtttaggtatctcttattctggaataactccttaatactaaattgaggctctagtgagagctattcaaaatgcataaatgaaagtaaaataaattttcaagaaccgatctttcttacttttctagcaacaaacttttgaaaaaaattaaaaattttaaaaagtaaaatatgtaataaattagctataatatcatttgtagctattgtaatttattttttattcattcactcaacaagcattattaaatgcctagtaaatgtcaggcattgtgttaggcactaaagacgcagccttgaataagacatactactccctaccttaaggataatttaggcaaaacaatcaatgataataaagtgcacattacaggaatgcaatgtaaggcaattataattagggaatcggggaaggcattccatagaaaataagctttaaattgagacttgcaagattggttttatgtcagtggaggtgagcacatgggggaagaaaagagtaatgaagagtattcaaaacaaagagtagaacatatgcaaagaccagaaatgagagtgagcatggtgcaccgaaggcatgaaaacacgtttagtatgactagagcatagaatgctagggggaaaggggcatgaatcagtctagaaaatgagacaggagccaggctggaagattaatattaaggaagtcagaatactgttgcaataacttaggtgagataagatggtaccctggatgagagtagtagttctgatatgaagaagattgaacagattaaggacattcttaggaggaagatcaaaagtaccaggtgattgactgcatgtggaacagtacaggatatggaaaaggtaatgtcaagtttctaatgtcggcaattatgtagcaatactggaggtgagagcatgtttggggcaaagaggtgagtttagaacatgttgagtatgaggtgtctgtgagtcatccaagagaagaggtctagaaggcagtgctcagagagaagcctgagctggagaaatatgtggtggtcattcagatgcagatgctaatgaaacctatgggagaaaatgagattgcctgggaggactgcccaatgtgaggagagagcctaagagagagttcagagaacatcaactttagtactgcaaaggttaagtaagactagcaaggctgcctctaatgagactttatacaacccccttcatagtaagttctcactttctacagcaattcagggctcacacttctcttctctcttttgactctcaaacaaaattataagataagcagggtgggcaacaggacttcttgaagataaaaataatctaggtttcaagaggttaggcttgaggtcatggatctctttatttccagattagttttctttccatgccattactctactcccaaggattagctccttatagcttcttctttgttgttagcctggactgttgcctaggtgtcattttagaggggtgaagtttttttgcattatattatattaaaaattttctccatctggaactgatgaaaggacagaagggctaacctgaggcaaaactcgagagtggcagaactgtttcttagagcttccaacctccctcatctctaccttaccccttctttaaaaacttttgttcatttactcaataattagttattaagataatttgtggatatggaaattaacaagccacaccaagtctctaccttcacggagcttacacagtagtaaaatggcagacataagaaccaatgcactaaaagttaagaaagaggagtgtagaaccaggagacaccaagggcatacctaacctacactgaagaggttaaggaacacttcttagaataagtaatatttcaactaagatctaaaaaatggttgaagttgactgtcttggccactgttgcaaggaggaaaactgattcaaccaacgaatttagaaaattgtaatggaaacgtataggttagtgtgccatcctcttgtatttttcaaaaaagaaatcccagaatttgcaacatttgatccaaaaagaatgaatctcctcaaactgtggaattcctgcactagtactgatatggtttggctctgtgtccccaaccaaatcttaccttgaattgtaatcccagggacctggtggaaggtgattggagcaaggggggcgattttccccatgctcttctgtgatagtaagtgaggtctcataagatttgatgcttttaaagttatttggcagtctctctcttctctctctttttctgtccttctgccgccatgtaagacgtgccttgcttccccttcaccttctgccatgattataagtttcctgaggcctccccagctgtgcagaactgtgagtcaattaagcctcttttctttataaattgcccagtctcaggtagttctttatagcagtgtcaaaatagactaatacaagtactatccaagtataagagaaaacattactctcacctatctcaactcataccatgtaggcaggcccttaatctatctccccctgagtccagatttgaaggcaaggaaagaactataagtaccttgtcttatttatttttcaggactctaagttatattatctccattatacagtagagaaaaatcatctgaaaaattacgcaaatctgcccaagatttcaagccagtaaatggggagctaggtcttcattctggtcagttggctccaaagcatctatttattctaccttgaatatatatacacgtatacatatattttacagatggtgtttcactatgttgcccaggttggcctcaaattcctggcctcaagtgatcctcccacctcagcctcctaaagctctgggattacaggcataagcccccatggccagccaagcatatatatatatatttttttttgagacggagtctcactctgtcgcccaggctggagtgtagtggcacaatcttggctcactgcaacctctgcctcccaggttcaagtgattctcctgcctcagcctcctgagtatctgggactacaggtgcctgccatcacacccggctaatttttttttttttttgtattttgagtagagacaaggtttcaccgtgttagccaggctggtcttgaactcctaacctcaggtgatccaccccccttggcctcccaaagtgctgggattacaggcgtgagccaccgcacatggccatatttttataaagacttgtgcacagatgctcattgctactttatttgtattgctaaaaattgtaaacagtctaaatgcccatccttaagtgaatggataaacaaattatagtatgtctatacagtggaatactatgcagcgaaaaaaatggtgaattattgatacatgctatgacataaatggatctcaaagtcaatatactgagtgaaagaaggacaaaacaagtacagaagattctatttttataatagaattcaaatttttataaaattctaggaaatgtaagctactgtgtagtgatggaaaatagatctatggttgcataagaaaattactggagtaaatatatatatatatatatatatatatatatatatatatatattagctgagagtggtggtgcatacctacagtcccagctactgggaaggctgaggcaggaggatcacttgagcccaggagtttgaggttacagtgagctatgatcatgccactgcactccaggctggttgacagagcaagtccctgtctcaaaaaaaaaaaaaaaaaaaaaaaaaaaaaaaactttcatttctcttgtgtaaacatgtaggcatgaaatggctggataacatggtaaacatacatttaactttttaaaaactgtcagactgtctctaaagtggctgtaccattttactttactgccagcaacttatgaggcttccagtttctccatatcctcaaaaatcttgctatgctcagtcttttaaatgtcagtcattctaaaggatgtgtaatagtgtctcatgattttaatttgccttcttctaacaatgattgatattgagcatcatttcatgtgctcatcatataccatctttttctttttcttttttttttttttttggtgaagtgcctgatcaaatctttgcccatttaaataatatgttgtatattattgagttttcgaagttctttgtattttctggatataagttctttatcagatatattctttgcaaatattttcttacagtctgtggcttaccttttcattttcttaataatgttttcaaagtgcagaattttttaattttcatgaaatctaatttatcaacttattcttttatgggtcattcataaatgaattgtgcactaatcatctcctaacatactacatgagttacttatcttttcactgatggatcccaagtggctagtaaagtactgaatacacattaggtatcaataaacatctgatggataaattaaaatttcaaatagtgaaagcaaaattatagaaacttagttcattggcagcacagaaaataaaatagcctctagtgcaaagccatattcaattttttgttatctgatctagtatgaagtttgatcgatacaaggacccaaatttattaaatcttgttaaagaacctgatgctctctctctagagacaatcctttcttccccaaaatagaaatgtgaaattccatagaacttaaatgtaaagcagtaagtcccctacccacctctgtgcctcacctcgcccgtgactcaagtgctatatgaacccctgcaaataaatcaaggctgctgaattctcaaaagctctaattgtgccaattgtaaataagcctcaggatgaatttcaaccagcagtgtccccaaaaccattatctgcaactataatccattacttttctttcataattaatttttctaataggtcagtactatttgttttgtttaagcgctattccagcaatcccattttaccaacaaccaatgtcaattgtaattatatacatattttctattatatacaacaaatacattcttatattatgcgaaacactaaattgggcagtgattttttaatgagtaataaggtaatatgctacattggtgctcaactgcacttgtcttgaccatatgaattaagagtctagtggaaatttataagcaccttgaggacttccaggtatgtgggtgcttaaataggtactcaaaagatgctgcttattttcatagattttaatgtctaaatcactgggaacaatgacaattaccagagatatagataggtggttagataaacacacaagagatatgtatgttagagacatacacattatagagagtataatagggttgtatacacacctacatatacctatataatgtgtgtgtctgtgtgtttgtatgcatgtgtatgaaatcaaaatgcaattcactggaacactgaagacaaagcggtcaagcagctgagagaattcaccatactgatgagctttcctcctcagagagcttgctcctcaggccctcactcaaaggctctttattctttttagatacaattctaaagagtttgatatctacttttccatccacaacagactaaatgctgaaaactcgagagcataggtgagcttgtgtttgatgctagctgcaagcagcctgacacagggagaaatgagagctctcctagagccaatctggggagtgtcctggtgagggcactgagacctgctagttaggaggaggcctagtgcaaacaggcaaaattgcttggatgaagggtaatcaatctgagcctagttcttttggatgaaacctttgagaactcaatgacaagaggatatggatccaacaggagactagtagagaatacaaattcattattttgctatacaatgctagttgcattttaaacaattgtttctctatgaattttactaccaggcttttctgaaccattctgtgtgaattcaatactgcctggatttttaaaaccacttctgacactataaaccagagaaatctttcttaaaagataataagaagatggggccttgcatttctcataaaaggaaaatgactccaccataagtgtattcattacacactgttgaggcatgaattcagggaaaattagactgaatatgagattaccatcctaactttctgaaacactcccagcgctgtcaccagagttcttacttcaaatatttactcttgatctaaaaatatcttagtccaagaaacggaatgattactccacagttaaagtatatttagtgatctgagagaggagaagtttcatttcactcaagcaaatggttttagtaccacaaccaattaatagcttcatcatgtgtgagccatgattataaaggaatcggactaattttttaaacaaatctataggcttctcacaagggctatttttcacaatggtcaccttggaagaaagtcactccagggataccgtcattacttcagatttgggaccttacctttagaattggttcatgagaaaaaaaaaaaaagaaacactacatgcttcatagttaccctccccacctaacactacatatccctgatcaccaactttgaatatgcctcatttacactgatcaaccaaaagcctcctggaaatggtaacacggcctatttatcctgggctttactgggagggtgggggatgaagagggtttataggaattaagagagtctatttttaattatttcatctgtgaaacatatgaaattcctttggccaaaaatgcaatataaaactcagattatcaagggccttttcgtgggaccagtgaaatggagaaaaaagtctccatgacaaaatagaggacttttgggaatccttttttttctgaggtttgcatgtgtgtgtttctagcttggctctcacctgaactgctctttcataatctactgtagtcattgggtacctggaatctgggaaaactccaaccttactccagcacttgtgcaataacacagtaaggcacatggagtcaagtttaagcacttagtccagggttctttgcaccctgtgggccttcagtaagcacttgttgattgactgaatgcgtggctcactatcaatgtgaattaactatatacatactgcattaaaatccaacaacccaaatactttctagctttcaggaagtaatgcatctaattgacagaaccactcttatgcctcctaatccccacttcctacaaaccagctcaaaggaagagagagaatttgaagaaacaaaaatgaacataagaaaaacaattagctgatgcactctgcaaagcctgtaatattatctagaatgacagcatagccattgttcgtgctgccagagccccgcgtgtttgctagctcacccgaggtcctgagagaataataaactaagcagattagatgtagactgatgcctccatgccaccaccaactcacacaacacacacactgttctgagtgtctgaacacatgcgggcaggtaaacccagaaaatgggcactccatgttggcaggaggggaagaggctgccaacaaacagggcctgtttattatttaacagttggtactgctagaggcctggcaccgctatagagcactctctgtttcagtgcaagtcagcctgattatgagagcgtgtgagccaaatcatgtttaccatagtctgtgagaacctctgtgcccccaacagacatggaaattcttacaatagctctcgtccaaacagagaaaaatcactcctgagatggaggtaaagggccccacgtgcttaaattttgtctgatcagctggctcagtgtctctacatgtagttgttttttccctgctcaagacaagtcattcctctctaatgatacagtttctaatcctctgcctttggttactttactttgggacctaaatcaaccaaatactatgtcaatcacccatctactaatattgcttatgctgtcctgcacgctttggcttttcagcaaaagaatctgctgcccagggcggctacctcctgcttctccttcgccagggctgcctctgcagtaagtctcctctctgccaatgtgggccacaggtggatgccttcctacaaatccaatcagcaggataatgtgctactatcacaagagtggaccttaatgacaaagagccctgcttagatggtcaccccattaactttgatttgattattctgccccagcagaacacttggcttcacaaccacagatggcaacagtccaacataaaacctgtagacagagtagtcatgttgggttcatacattttcaaaatattaaatttcatgtaaaaatataaacatggtaagtattgagagagtccctggttccctaggaaagcactgttttcttttcttttttcttttttttaacaaaccaaggtcagagcactgagacaattgtgctaactaggcaacagggataatctaatcatttcttttgaaattcaacataaatcaacatttcttttaagtgtaagaacctggcttttatcttccatatacaaccaaggcaatctttgatactttatgtgactctattctatacaactgtttttaaattcaagataaaattggctctatataagctagttcaatattttgaaatttaattgtaacttggatacacttcctctgtgaccatgagtaaatcattaaaatgctttctaccaatgagaataaaggcatagcaaactataagtcttacctgaaactgtatgcagtgattgttttgtgttttgttttctaattgacagttgatatttatacactaaattatcaaactactatttgtttttaattaattcctcaactttgccactcaaggaaaatgatatatgctttgtattgttaagtaaatacataattttatacttatcatgttattatggttttcaaagaaagtagttgtccctaggtcacagattatatacacatgcatagcaaaaagactttacaaaaacaaggaaaatatgaaaaaataattgcctagcttggatcaagttaacccctggtttaatttaatcatctcctctactgaggatctgataagagattcttaataacagccccaaattaaggcaatagaatcaggaaatctttttttttttttttttttgagatggagtcttgctctgctgcccaggttggagtgcaatggcgcaatctcggctcactgcaacctccacctcctggattcaagctgttttcctgcctcagcctcctgagtagctgggactacaggtgcccgccaccacgcctggctaatttttgtatttttagtagagacgaggtttcaccatgttggccaggctggtgttgaattcctgacctcgagtgatccgcctgcctcagcctcccaaagtgctgggattacaggtgtgagccactgcgcccggccaaaatcaggaaatctttcccaaaacatcctgtatatagcaacactcataactactactttatggcagaataatggacccgattacaggttcacatggaaaaagttgatatttcagccacgaccaaaatataaacaggatttttcatagggagtagatggtgtgttcatagcgagataggtggtgtgttcatctctgtgctgagatacttcatcttaactagtaagaaacatagtaatccctcacattcattaagaggtatgctgtaagagcttaatatgtatacacccatttaaccttcataacaacctttattttttagtgactactatttacagtgattactattattttctccattttacagacgaggaaactaaagcacagagtggttaagtaacttacccaaggccctgcattatgtaaataaaggggctaaaatttgaactaaggtggtctggctccagagtcaaagtgtaatcactgtgttctgcttctcataataacgatcactctttctgaagcttgtgttcaatttaaaactgtatattccctgaggctgtagaatgttagagctgaagtaatttaaaatgatctaacccatggcctaaagctccaggtggagagaggatgtttgggaagactgtgtagcctcaaaattttgtggataggcacacttttctgggaaaagaaatgagccactcatctagtctaaatgtctcagttgagggattaaaaaaaataaagccacaaagcaatggctgtaaatgctgcatattttaaggaagcaatataaaaagaaccaagcccagaaaccagggctgttttcattatcctgtctacccaaactctcttaggtggctcccttaaagccagaagaaatctgtgtgagggatgccgagtcagcctgtttctctacttggctccacatgactcagtaaagcaaatcaatgagacaagatatctactcatgcaagaaaaaacagaaatctagtgtgatgttttcttgactattcaatgctaatggaaaaaagttggtaacacatttaagaggtaagaagaaataaaattgtctctttacaaagttgactgatttattcatttagtagatacacacacaggtatacacacatacacacaatttatttattttagtggtagcccagaaactttctgaatttcttttgtatttctcttgagtcttttcctgtaatttatatttacttaaaatttatcccttatgttcaaatttttcacatatatatataaagtattcattataatcattttaatttcctccatttctctggttatttccccattgtatttccaattttgtgcatttgtgggatttctcatttagtaattaaatcatgtgatattggtttgtttattgttctgttattctctttgaaaaaaccaactctttgatttattagtgtgtctcttttttattttctaattccttaacttctgactttatttttttaatcaattccttgtttctactttgcagatttgttttttgttcttttaaccaacttcatgagatgaatggtaatacgtttataattattttctttcctgtaatagtcatgtttaaagatatggatattcctccgaacactgttttatctatatctatacatacttattttctgtaaattctgtaatgcctcttaagcaaaaaattaattttaaaaagttattggtcttttttcttatcaattcgcaggagctcttattttttggagatactatttttgtctgagatacgagttgccaatcaaaatgatcactttttcatatcatgtaaaaactgttttttaaatttttatttgcttgatttttcttattcacaattgtggtaatatcagtagaagttcttctccttcctctcccagctttttgcttcctatatggtttttggtcccattagagttttattttcttcttctacttccttcttgttctctcacagacaattttatttctccttatttgtcttatcacttattcaatcctgtttatctagtttttgaactttcattttattttattttattttatttattttattttttgagacagagtcttgctctgttgccctagctggagtgcagtggtacaatctcggctcactgcaacctccacctcccagcttcaagtgattctcctgcctcagtctaccgagtggctgggattacaggcgcccaccaccatgcccggctaatttttgtatttttagtagagagggggtttcaccatgctggccaggctggtctcaaactcccgacctcagctgatccacccgccgcagcctcccaaactgctgagattacaggtgtgagccacaccgtacctggccttgaccttttattttaaggaggccacaatgtcttctatttatttgctagtatggaaaatagatattattttcttgtataattcttcttgtggtatatgttttgatctggtttctttgtattgcttttgtttttgtttaaagctattagctttgcttagctgatagctaaatctgggtccaatgcaggttcctttctgattagttttcatttttcactgagttaattctatcagctgtttgctgcaggaaagaggctggcacagtaaactgaggacttcagggagtttctttttggtaccatatttcctgttatgttttacctttctcaccaactcgaccgtgcacattgttcaagagatatggatctgcttagtgttctcagtgtcttgtcttccccatttagattagcgggagttccaaagggcttgcacaaagtcctgcctgatacattttccaagtcatgatctaatatttccttatttctcttctcctgaaggtgatcaacagtggcaaaggctggtgtggtttatcttctccaccttgccacccatgcatcctgcttttggcacatgtggcaggctggtgtcattcctcattcactgccacctcctctgttatcatctgttgtagaacaagccttagcaacccttctgcagaccacctatagcctcacactttcctgttgcatgtaagtaactggagcatgtgtccatcaacttttggatgttctacctgctgcctatatttaaaatactctcgacattgtccctgttctaaatttcgaaatatcccatggtttctgatttgagagtgtacctgccttctgtaagaaaaggcttttttatatgcatctcattttctatttaattgtttgttgcacagcaacatatgcgacagtgttgcatttagtttttcatctgtggcctcctaaatggcaaaaacaaaacttcacttattagctcctctccaatccttctctcaatcaagtgcttgcccgtccttgtccttaaacccctggactaatcccttgtaaggtgtcctgttgtaaggtgtcaactacagcattcacattcattgaccatttatatttcccctcataagcatatttgcatttaaataggagattttaaaaatctaaactaaactttagactaccagatgaagttataaattaaaactttgattgtagaatgacaaataacatggtatatgtggaaaagaagttagaggaccccaattagtatctgtaaaatgacctcatgtgagtagcaaagttatgtgtgagttgctttaatctttaaaattagcttctgcaatgcttcattgttttctataatagaagagtaataggaaaatgaggcatttgttgtaagtaaattttctagttacctgtttaagcagttttcttttaaactttaagatgaaaatctttacaatgagttcctattttctgaaacaaataagtgacttgatatggtagaaatgtactggagtgagtagttccagattcttaagttctttctgttacttattattaataaagttttgacacatcatttagcccacccaagcctcagttctcccatctgtaaaacaggaatagcaatacttcctttcttgcaatataagttttctgtgagtggaaaatgacataatatgtgtcaaaatactttgtatactaacaactagaaaatgataagagccttaataataaaagataatccaaataaaatattacactactatcaaagataatagaggctaacagggaagttatataaatactttcatgattcttttgtgtgttttttcctagttgtttagccaaggtactcacttctatttcagttctcattgccatcagtgagtctgcctctagaaaaaacactttctgttttcccgcctcctcttctccagtacatttgtatagtttttgtctttgtttctttggtatgttttctgtggctttaaattggctgcaaaagattgcatagggtaatgaaaagagaaagcagctttggagtcagacagacctggtttgaatcctgactgtgtttttgtgctcatcacttaacgtccctgaatctgtttccttatccataaaatgaatttaatcactgataccctgcagggctatctaatatgtgaagttcttggatttcatcaaatctcatttgccttcttaaaagtatattttgcttatttctgtgtttttaattgaagctttatgacatttgacaatggatacattgctgcactctgatcagtaattattttattcaatgaatcatttcactttttttctaaatgtcaccaaagactctagcttccttaaaatctactttttgttaatttccttgactaatcttatagttccaatagtttctctgcttcaatcagctttcttttgtctaaacttcttctgttttctcttgtaaaataatttatcctaatcttaaatctttacgacagagaccatatcttctttggccataatgcatcgaatattctgtaaaaaccacatcactatcaatcaataattatgtgtgtgttataagtatgtaaatgttatagatctcatagaacttatccactctgccttagcttattcctagaagatcacagattactattatatagcatttgtataactctttatcatttgtgaacctttcgtaattatttaatggaggtcttcaaactactagtatagattgattttgttatttctattgttgggaagggaaaacaaagacagaatgatgaaaacttgtcagatatatcccatgttaccaggaaaaacaggattagcacacagtctcttattctctgatctgctgatagtctgttgagctagtgttttcctagcatgaaaggaagaaacatctattcatttccaattattattttctggaaaaggtattatggagatggttctctttatgttcaaaataaataaaatgtccgagtgattcctggaacttgggagaaaggggaaggtaaaccaaaaactagggccagagagcaagaaggaggtaaaggagataaaattcgtggtgggtgaatcctcatccgtcattacatgacagaagtatttaaaaaggaaagctactacctctcctcatctgaggcttcctccagaaccctgtaggagaggaagatacactgctgagtcttcatttggggagcagcaggagaaggcagtgcctccttagccaaatgaacctttcctgacagctgtggggatatgtgtttgtgccaccaggccccttagaaaattatccctaaaataactaatgtttagtcagtcaaaacaacaacaacaacagaaaaatagcagcttcaaagcgaaagttatgtggcgagagtaaataacccaaacttaacgtgaccttcctagcattattttagggaggcgttagggtatagagagtgaaaaacaccctgaggtgggatttacaagtcttaatttcagtttcagcagtttcactttctggctgtgtggtattagacaagtggcttaacctctctggacctctctgatccttcagatttaaaatgagggggttgattactaagtgacgtctaagagcccttctagagataaaaaattccccaatctatgataataataattaacatttgatggtcctttaccacctacaaatgatttccacatacattatctaatttgatcttcatgccagttctgaggtagtattattatgattatgcccatttttggaagagagattcagaaaccacaaaatggcagagttggcattgaacagatgttcccaagaggcaaataccccttcagtaaaagaagcagctgatgctaacaaggataaataagagcagacaattcagcctgtgagctcttgtttaggggtacaacagaatttctggaagctgcattggggtaatgataatccaccatgtggaatgttatctgatgatgtatttatcaaaaaaaactaataaaaagaaaattaaaaaaagatacaataattgttactgcactacaccctaatgaattattgtgttcaaggttcttacaaaaaaaaagtaatattatactcggcttatgttttaattgatttattaatattttatcacaggaatgtaatttaagctcctcatgatttagatctcataaacctttagcattttgcaaattcaaattccaatttaaagccagggcgagcaattaacttttctatcatcttgtcaggggagaaggttcgtgtttaatttgagacaaagtgacagaaatatatatacactgtatgtattactccaatttaatttatgagtcagcaccatccaccttcaaaatgtagatttaatagaagaggaggaagaaaaggccgtgctgtcatgatagggctgtaatatctgccctgaatttcttacatattaaaaaaaagtcactggtttgttgagataccaagctagattgattgcaggcctatttccagttcttttgtttcacattccacttcctgattcttttctcatacagcacataatctcatggatatcacagggagttcttacccccacttctacctctactcctaccccatcctccattttcatgcatagctgcttctacaggtttatcctaaatcttgacaagtgagataaatggtaaatattgctttgagatcacgtcttcatcacctttctcatctttccaaagccaccttctaagtgctctctacctaaaacaaacaaacattaaaactcctcgcaattttatattttaatgtgcagggtgtatctggcacggtaaaacactggcactttcccgtgatcctttacaaaatatttaaggacaggatatgaataaataagctaaaaccacagaaggtagtcaggtgaactgtagggaagtacttccccttggtggttattaagcactggaacagggctgcggagagaggttaaggaattcttactagcgccgttatcctataattcaccaaaggcacacaatgctctatgctgatgagatgagttacatgacatctcctccctggttcaatcaaaggaaagcaatttacatctcaaaccagttctctcatcagtgggacataaaaactgcagaacagagatgcagcaaatgtgcttatttatacagaatcaactcagttgccactgttctttattattttccttctctcccacctcccctgtatggtggccattttgaataggatgcttaaaattctaaaagtgagaaaaagaaccaagaacaattcagtaacaaaattaactaaagataacttgtgcttctgacaatcagtgtcccttgtggtgctaggccaatccctttgttccacttaaaaataaaatcggattcctcttgctggccacaggaaaagaattagaagacgattaatggaaaattctggaaggtagccttgtaaatgtttattcacttttcaggcatacaatgttgtgctacataagtgaatacagtgcatttgtcaaagaaaggccatgttgaattagtgtgaggtcttcattcataaaacaagcttatttttactaataatctctattaatctcagcttaattatattaggcatttttcacttgcatacaacagtaaaaatggccaaaactgcatttactgcacctgcttaaacgcagttatatccctaaaaacgattgcagggaacaagctcccacagacatggcttttaggcagaatatgggattatggcagaggggtttaaatacaggaggtaaaaatggtaatcatattcatcaactacacaaagaagtaaaaacaagaagctctagataattctttttagtggactcactaaaataacaataacagcttgatgaagagaacatgattgtcgaaagcttgtccattttacattttctctttacatagtgcaataaaaaggaagcacctgcagtttctacttgtgcgtgtattcgtgtgtgtgtgtgtgtgtgtgtgtgtgatgttgaaagaaatcatggacatcatatttgctttaggagctactagtctaatcttaagtgcacattccctaccataaagttgtatttgagctccgtgcagtgcagaaacattcttcagcttagaaagtgcagtctttgcttcacacccttttccttcattcagacacatcagcatcttatcactttggacattaaagtaaaagagacttctttgtcatgaatatttttagacaaattacaccaaaatatcttgtattttccattttttagtggaatctactttactgacatataccagcccaccataacatcactgttgtgatgtcctactacttatctaaaaaaagtactattaactacatattgcaggtatttgaagtatataagaaaaccataaactgaattacattgtatggctggtatgatctcacatgaagtttgagctatcattattaaaaacagaaattgcatttagttaatgcatctgacagtaagccagtcaactttcaaggttgtatgatgagaaaaaaaatattttttaaaaaaacagaaaatgcctgaaaaatttcacaagagcatttcacatgacaagagaattcttcctctcccttctgctgcctgcctgcccacctttcttccttccttccttcgttccttcctttcctccttccttccttctttccttcctttcttctttcttttcctccttccttccattcttccttccttcctttcttccttccttctttccttccttccttcttgccttccttcctttcttctttcctttttcctctctccctctcttctccttcctttcttccttccttccttccttcttccttttcttttctcgtgcttctctcccttagtttctctcttctttccttccttccttcaatttggtggaggaggtgcaaaaatttgagtaagaaaataatatttttgtttcagaatccacatgcttttactattcatcatgctaacttagggggaaatttagataacttcttatggcgttttttttttttttttttgagtttatagatatctttcaggggtcaagctatttccaaacattcttataatggcctccaatattccacactgcaatatatagcatgctctaagcaaaggcagtcttttataaaagactgcaatagctagtgaagaaatacttttttttgattacttttataaaggcacagagcaaacgacagtacagtatgtacataaataaagcaaaggttcaaactgcacttttacaactacaatgtcactaatagacctcatcccctctctgctattctatatatataggttgaaatctgaggcttaaaacaatgtttgaacaacaaaacagaataaatgactaacccaatctttcaggttccaaaaacagtactggagagttttctatttttataggtgtttgtcactatggacattcaatatctataattctgaaattacagccgggcgcggtggctcacacctgtaatcctagcactttgggaggccaagatgggtggatcacgacgtcaggagatcaagaccatcctggccaacagggtgaaaccccatctctactaaaatacaaaaaattagccgggcttgttggcgtgtgactgtagtcccagctactcgggaggctgaggcaggggaatcgcttgaaaccgggaggtggaggttgcagtgagccgagatcgtgccactgcactccagcctgacaacagagcaagactccgtctcaaaaaaaaaaaaaattctgaaattacaacaaaattaggatctgaatatgtgttttacaaaatgatttgctataggccttcatgggggagatggcaatccctagtatatcaaacactgtggcttaattttttttaatcttcacaaaactcttcaagaatggttgtcataatgtaagaagtgtcagcattaccagaacaatcagagatttccataggcagaataacattagagattacgtcattacaacagatagccctcatactcaatgcatcttacatggtcagttaaaccaaagggtaggaggcactataggataattgtgagaagagttgctttctaagtggaagaaaggtgaaaataaagcacctgcagtgctgtgctttcactttacttcctgccctcacagtcatcctggagatcttactggtgtgctttaactgtcttgtggcattctctttcaaaagcatcttcagggactaaagttcaggttttatcagaatagacatagtcctgtgctacttgacagaaggcattttactcttttttatggtttcactaaaatcaagagtatcacaaaaacatcttaagatctgaaactgggaatcgcctcataagcatgtcttccaaccctacaggttgtataaggcaagtatgtgtagattgaatggaaccctctatgtctggcttttcagtattgtaaagactttcaaagctcattaagtacttctttgctgatacacaccaagctaagtcccacctcagggcctttagaccttttgttacccatgactggaatgctcttcctctagggtttagcatgcttctctctttattctggtttctcctcaaatgtcacctcttcaggagacttacactgaccatcacatctgaaatagcttgccaactttactctacctatctcactttattatttttcatagtatttatttttttccggaaattatgtactgcttattatctgtctcccctaataaaatttaacttctttgaaccaaatactttgtcttattccttagtttattgctagtgtccagtactgtgcctaatatatggtaggtgctcactatatatttgtcaaataaataatacttaaaatttaaaaatttattctcctttaagttgtacagtttaagcctcaccttattttctgctgataagagaaggtatcacctacaatgacccttcacattctagacaattaacaaagtctatgtggaagaataactattccaggaagaatgtgttcagacctggtttgaaatcacagcctgttgctgtggggcatttattacccaccatttagctagattactgaatagatggagttaaccaaaatgctgacaagacacacaccacacacacacacacacacacaaacacacacacacacacaccccccaaaaacgaaacctcagccctccaaaactctccttactcttgtaattggagtgcattgccactttgctccaagccaaagaacagataagaaagagaagcaaaaatcagaagaactttggaagccatttcactagagctgccacctgtcacttacgtaagaagatgcaatcatccatctgtccaaactggtgaatcataaggtcttaaatactatttactttccccaaaatagtgaatcccttgcaattttatatcacataataacaaagggacatgattcttatttgtttttcctttagatacacatagaacattttctttaatgtggcatacaactttaaaaatataaacaccaattcactgaggtatttttttggtagaaaaaagtgtctatcataattttagtagcaataatagttctgtacatttcttttagcaattacaacctcagatttctaagcactgtgcaaacattaatttactaagttctgctgtgttctctttgtgaattagaatattatcatatcttcattatttttaggtgagagtcacatggctatgacttgccagggccacacggtaaataattttttttaaagtggtaagatgcctctgttttgaaagtggatgcccagggaagattaataaaataggataagaacatacctaaaatggcatctgtttttttttttttaacctagtgcttccattcaaattttgttttgggatatgaagtcacctgatagctcagttcaaaactcgaataaacatccttgaaaatagtagggttattctttaaaaatagtagttatcaattattgagtgtgcaccttgtgccaggcacagttctaagagatctagttctaggagggaaagtgtacgagtccatgtgaacaaggacttggtgtcttattcactattgtatgctccgagcctataacatacctggatggtagtgagggttcagttggtatttgttgcaataagtgtataaataagggaagctttcttggttccagaaaactaaactgtctgaattttgaaacacaacctgtttgtaagttgggggcatcatattaaacattttcttttggaagcagaggagaagggaagagattttatttgacccaatatataaccaaatctaggataatagtgatcctctttacaataaagttcatttattcaacaattatttattgaatacatactatgtgccaggtattggaagaggttctaggaataaagacaaggtccttatttcagaacttaaattactgtttatgggcataagaggaaaatatcttcatatacaatgcaattatgaggcaagatttttctatgaaccagtgacttctgtttgtttttaccatgttaccctcctaatttactaaggcttcaattacttggttttcttctgagtagccaggaggacattatagcaaaaagtaagtatactgattaattacaacatatatccataaagtggaggggatatctgaaaatcacctagagaatctgaccaatatctaagaaattaatttaggtcaaatgattagttctgaaatgtctgagttatctatattagttattcatattgccagttcttaacttgttctatacaaacacaatctgaagcttcatctgggcttcttcaaattggaacctagttacaactcttaatggataagttcaagaataatgccactacaataaaaaagaaataaagaagggcacaaagtattagaagataaattatctagagattaataaagtctttggtaagagtttgcaactctatcacatatgggctaattggaaatcactgcttccagggctaatgacctcatttgaggttaccctgtgggacaataacatggcctacctctgtccactaaacaaattctgtcaaaacataacttaccaaagtatagcttgttgaggggtatacatatctgaatttattttactctgataatctgcccgagaggttctgttacttgaaggcaatatcacttcctttgggttcacttgtaggacacaaaatgcagcttttacaagtatttctgcttgtaaactaattcttcagctatagtatataaacttcactctataagaaaaccaaagaggccaagggacattaagtttggtgtttaattgctatcagcaattaaaaattgctagcagcccacttaacattttcttcttcctctaaaaatgaaactgaaacgtatcttttagctgagagttctgtaatgctgagaaaacatcctaaatacatcttggcaaaggaagaaaagaaaaaaatgtgatattgatgtatttgctttcctagtatattgaaatcaagaactagatacaggtgacagatctgcttccacctgctggctcagtgaatttgtaaaactgaaatctgttatctaaaaatcactagtacattcagaattacttagcattccctttctgtttgtacatgttcatgacaatgataaaacagccccaggaattctgctaccaatcttcatatatatgtccattgacattgtctccatcaaattcaatccaataaaattaaatggagttaaataaagcagtctgcttgaacctcagtatctctcatttcttattgtattgtacctcttatcatttcttatttatttagccaaggttaaaaaaaatggtttccagattcaattataatttccctcctggtctcctatttcttaagtattttttcctttttattttcatataattacaaggatttttttttttggcaattgacatgaacaacattattcaaaggaaaaaatacttaaagtagctactatcttatagcaaagaggacatttccatctatgtttaccataaaaattttcactggattccaacattttcatataatactatctacaaatattgcctgctttgagaagactccaaattttaggaggtagatgggcgataggtaatgcatggaggaagttggtaaagaagacaaatttctaactatgacttccggagttaaattttaaaagaaattgagaagtatacaaaagtgttaagactgaaatatatgcaattggcttacaatttctccaaccacttgaggcaagagggtaactccaacttttgccccttcattgccacacttcttcaatctgcatatggattttatgtttcccctttacggctgcccttaatattaattttaacctcaaataaaatttttttggaaggaagagtaatatacacattataattttctctggagttttcctcccataagcaacagccagatgacaaccaacttctcattagtctcttgaaaaacgaatcagaaattttcttatgtccttcacacaggattgccatctattataaatagtgctgaaagaccccacacacagcaaactgaagcatgtggcatttaatacatcacacagaaggatcaagaattgagtcaacacttctagggcttctacccctcaactatgcatttccatggtacccatttccatggtttttagacttttaaacaaacacatttgtctaaaaacaaatacatatgtaggaaacatttctccagggctctcgccttttcagctgcttttggttgacagatgagaacccacatacagtattctgaaattctgcgtcttcttgtcttaagtactagagaaagaaatatttggtcctaggtggcagatcttacttatatcacttctattaaacgggcaagatagagtcacaaaaagaggacttatgattttcaccttataatggattccttcttggcttccttccacctcctatacatggatttgaacttcattttgaagacacttacaattattctgaatgaaaactatcattttcattctccctctcaaaaaagtttctgaagaaatttgttgcaaagccatgctatctgtaacattacgaatatgttagcatatttttagtgcttcactagatttcataaatcttacttacccatatcaataacaaccagtataatttgaaggaaaaaggagaaatcttgtgtcttaaattatatcatttaaaattcatggatgaaggtagtatccctagaaatgatctgattctatgtgactccgggaaagatactatttcatttctgttttagagattaagaaactaaagtacagataagttaactaacttgcctaaagccttctggtgaatgagatagccaagatttgaaccgtggagtccaacgccagaggcttaaccattacattattctacttctgtgttaagattaatagagaggaattaaatgcataattttggaggcaaacagcttaagttcaaatcccaatttcaccagttactagctacatgaccttgggcaaagatcttaaccactatgaaactttatttcctcatgtatttaaataatagctgttcttcactgagtactaagctatgttccagttatcgatgctaagtgttttacatgcattattccatttaattatcataataactcaaccaagtatgtagtgttatcatcccagatttagagatgaagaaactaaggttgagtaatttgcctattgttatacagtaaggggcgaagacagaattctagtaagggcaatctcactctagacaccttactcttagtcattaaatttggtgataataaccaatagtgtctacttcatggggtttggggttgtgttttggtcaggattaaattaggtaatggaggtgtaatggctaattttataggtcaacttgactgagccacagggtgctcagacatttggtcaaacattatttggtgtacttcagtgagaatgtttctggatgagattaacatttgaatcagtaactgagtaaagcagattggcctccctcatctccaaacagttggaggctggaacagaacaaaaaggctgactctctcacaggtaatagggaatttctcctgcttgacagcctttgagctggaacattcctttttttttcctgtcttcagactcaaactggaaacatcagctctctgcaggtctctggcctaaggaagttcagactaggactataccattagctttcccaggtctcaagcctttggactaatacgttggactaacgcaattggctctctggggtctctagctttctgactatagatcttgggacttgtgagcttccacagtcatgtgagtcaattccttataaaacatctcttctatacaggtatacattttattagttccaattctctggaaacatagtacatagtttctgacacccagaaatagttaatgaatgtttcttaaactgctttcccaagaaaagccaacagaaaaggaattataggatgaaaaagcccccttcagtaagagcaaagataggtccagatgaggaggataatgttctgtgggcactcggctcttaagagaggagcaggggtaggggcaaattttaaaacacgatctgcagctaggtcagatgataagcttgtttatgaaataagagatggcaggaaaaccaggttgatccagatatcaagaagaaaagccactttcatcttccactaccctaactggaagggaatcttggttccttaccatgatagcaagctgactagaaatatagatgtgatctttccctttgaaaagtaacaggttacagggaaagtgaaggaatttatagaaaaggtcaagtttgtttagtgccttactgtgtactacttcaaccaattcagctctatcacccaggttggagtgcactggcacaatctcgtctcattgcaacctccacctcccagattccagcgattctcatgactcagcctcctgagtagccagggttacagacgcaccccaccacgcccggctaacttggtattttcagtagagatgggatctcaccatgttggccaggctggtctcaaactcctggcctcaagtgatccacctgcctccacctctcaaagtgctgagattacaggagtgagccaccgcacctgccccaatccaactcttacatacatactttgtttccagctataaaccataggggcataaaaagacttctctatggaacaggttaggtccctgaagttttcaggtctaaacatgctggagatggcaattaaagctttctaatatatgcgagttacattaatatctttgaaatacccattcaattaccccagctcaacacctgttagacaccctctctgtcaaatctcttctgaataactttgtttagttagatttggggccagtatcgtaacttcacgtagtctgtacaggaagaaaataagtaagctttactctggatctcagggaacatgtgtttctcccatcatctaagctaaaaaacaaggaagctgcaacagctgggacaagaaggaaaagccaatttgatttttaaagaaaatagaaaataaaagcaatttgtccaattccaatgtgtggtatctatgctgatttttctcaaggaaaagtgcttatcattgccaaaatccccaaagtaaccacagctgacaaacttctcagcatcagagcacttggcaactgacaataagacctgctccttccccaagcggataaaaagccaggaactccccaaacaaaaccaacagcttttctgtactcttagtctgccttcatgtcttttgagcacagtatattgtcctgtgtaactggaggttcatgtagcacactgattttacccaaagcatcaaaactaatataattaatttatataatcttctagttacactgactatagaacttaccttcactacctacccaaatgtctgctgctgatatatacatatgattgcacaaattctaaagagtactctcaataaacagaaatgtaagtctgctaaaaatgcttaaatatacaaagaaatgcaaatataagctctctaccatacataggatctttgtttataccagttgcacatgatcaatggaaaaggacattcaaaacacttttgaataaacaaattattatcttgcattagcttgtatcaatagaatccttccaagtattttttgttcataataaaaatgtgtataggttggtttgattattttttactcttatcatggcaactcaatataacaatactgtgcaggtggaagagggaagaggggaaaggagagaagctgcaaataaccaatttaattaccctaacagtcatttttttttgcaggaaaaaggttccatatgataagaatgtttgttctgatcaaatatctttgctccataaagaccttatgaatcttccttcaatgtgaagctaagctatttctgaggagctactggaacctcctcattttttctagaggtatccatgttctaaaaatctcaaatgatctcaacttaggaggttactgaagctacataaatgtcaaaagaaatgatagatttacacttctccaatttctgcatttgttatgtagcataaattcatgacagaaaaaaaatgatcctcaaaactccttagaagctcgctcaaaatcttgttttaagtctactcaaaccaaaccaagttctgctaatgtaaacccttaagatttgtggtagtttttcattcccaatattaaaatagtcttttattaattctccatcacatcatattttcccttgactactaaatcaggtccacatttgttgcttctatgtttttgacatcatggaagaatctggagcagtggtacattttgctcttcagagatattttattggtttaaaatgtttgattactaaggggtttaatctagtaatactagattaagtactgtctaccataggaaaaaattcatcagacttaaggtgtttcctcttaagtggaagtagaaagccaaatttcaaagcctaccgtgttaataacaaatgcttccttttatattttcatcaaaaaacaagcctatttccttatctaagttctgtgcaagtctttctgattttctcacaataaactatatgtgtgaaatcccatcagtgttatcaccaatatttattcctgatggccacagcttttctaatctttgtgtagccatatgcttaatgttacataacccacttggaattcctttcttacaaacaaatagcaaaaatgtaagtttatgaagtatgcattccttttttaatgccaaaaataaaaacaaaggaaaatttctaaattggacatgtgataatacataaaatctatctgataaaaagtgtgtaattactgtcacaaaatcttcacacaatccttgaaatctcagcagtagggtggcaccaagttcccacacatcaattaaagcatgtacatatacgtcattggcaataggtcagtctcacagagaataatctcatgatgccaaagctatcctacctgaactttaattcctgaataacaatgttggctaatagtgttttactggatattgtcttacttgctaacatttcttatggggatcttgattaattggctacctaatccccaaagattattccagaaaataataatgtctgaaaagtagaggtcttttctttcacctatgcacaaatttgtcatagttaatatgaaattactttgttcatctgacccctatcaagtaaaaacacatgaattaagatcagcatgtaggtgaaatgcacaagaaattagggccatcttgagaggactgtcatctagtatgaatcacatactggttgaccattctccctccaatcccatatttttatggggttatacttaatacgaagaacaagtgattaatggagcattaatcacagaagtctactgactaaaaaggactgaaaattctgagccttgcttcagtggtgatggtggtgggaatgtgggaacaaagttgctgcacaggtaatccctagttttgatccaaagaaatagcagccaagcagaaacagacagacagacacacgcacacacccctcaatatatattaaaaagtcaaatttcattcagtttctcaagaaaataccaagaagaataagacagaaaatctctgttcttagtcttggccactttattctccacatggacaaccactttgcatcaaaagtctctctctacccttactttcacctctaagtcttttctccatcccttctatcccttatgggtacttttctttcctccctcctcatttttcctgtctctagccccttccttttacccaagtgaaattttgtcacttttgagttcccctcccctatgatcacttttccagttctatttttcattcccccaattccacactacccaagttttgacacctagctggcatgaagagagttcttagaagaaatggaagagaatgagaagaagaagtcttttctgtgatacaagaaaggagaaggccatgactactgacatgaaattaaccttgtcccaaccacatacacgtacacctcaaagctttgtaaaccactggcaaataccctcttattatctcccctgccccatctcccctttcttttaattttttggttagttaccaatcacaggagttaacttcctacatagagggtagacaaatcagggcaatctatgatctctttaggtccatggatagatgttcacccccaaatgcagagctctgctaaatacatctttcagtatctctgccttcttagatactctaagctataactctactttagttttagggtcctttttgcctttttctggccagaacatattgcttttatatgtcttccttttcatcttcccaaatgccctaataccagcttaggctaaatgtgctactggtataaaatgtatctttctccttaaaaaacaccaattattctcaacctctgggatccaaagcatccggaataggggccctcttcaataataatcagtgagtgagtgatcttaaaagatatgtggtttaggaagatgaagttaagtatttaaggtcacaaatcaagtgtggagtggggctgcaacccagatccagatgttctttctgacatgatctctcattgtcttttttcttgtattaatcagttgctaagtcttattatttcttcttcataaaaaagctaatgatcatcttattgcaacaccacactctctataccacaactatatatacttattttggaaagctaagattattcaagtaagactaaacaacacataggaccttcaaaatatgctcctaatcttcccttcttgtcttcgtttctgtctcctggtcccagttcctcccaactttatgtatgcatgagtcttttcatgatcttctctctgcctagagtttactttcacttcccgccaggaaaaaaagaataagtaccctttttaaataagcaaactcaaatattatttgctccataaagccttcccaatatctattccatgagcctttcccaacatctccactttcctactaacagatcatatatcctgttgctttaaaattcctactgctttcaaattctttcttcttgctagattgtgacatgcttactggcagaatccatgctagatactgggaacacaaggattaaaaccacaacccttgtactcaagaggtttccagtacactagtaagtcaaaaatataaacaactacggcacaggtctgatgtagaaaacatatttctatttaattgacttgaattatagttgcacacattttgtgttgtaaccaagattatgttacatatgataatttaagtagccaaaagttgactcaggttgagtagagaagtaaaagcacataagaaagagaacaggaagaaataaaactgtaaagatgtaatgggagagaaaatactgagttaactgaagtaatggcttaatgcagaaataagacgtttggggaaaggaagttgaattagttgaagacatttttggtaacaagagtcatgaagcctacagttgccagaaataaaaaaaaaaaaggactgactatggagtatttattaaatactcatactcactgtttgaagtacaaactaagaggaatcagaggatcaaagtggttggttatgacttgctcagctagtaactgcaagtgccaaaattcaaactgtggaatatttcaaagtccgccctttctaaattcaattttggcctaaatccaaggaggtagtgtccacagaattagctagaaattacttatttcctaaaagatcaaagtcccaaagaactctgtatgatttcaaggctgctcatatggtaataatggatacatttcacttcatagtctaatcaactaatagactttaggacagtgaatatgaatgacatgaaggtgccttgagaaccatcaagtcctacctcttattttgagactaattgaagatactgaggcccagtaattgaatcatatagattgctaaaagaagttctgagaagaaatgaaatacaaaagcttggtttctaaggctgaatatcatgagaaactatcatgttatcctgtgtgagtgagctccacgaggccaggtatcttgtctcttttatggtcaactgtatctccagtatctaggagagtttatggtactataactagcacatagtgagcacttaaaaaaaatcaggtgctcaaataacacggtttagtgaaggaattaacgggttcatatatgtgaatgtgtgtaaagtgggtgcaagcatgtaattaaatggaaaactggtcatatttagttagatgttactaaatttatttttatttgccatttggatcacatgattttctcctttaaacatcccagtgacattataaatgtcttatgtagcaaggtctttggcttcaaatgccttcaccaggaattaagagtttagtacaccatcaatgaatagaatttacaaagtaccctttgggcagaatcattaaggaattaaggaaagttttttaacatattgagaaataacacaaaaggttctgaaaataaaggataatatgaatatttcatctttgtcttagttttggggggtggggaacacagaagcaatatttcatttctaaaaccatgttcccatgaagctgagcagaaggactgcttataacataattttccagccaaattcccaaagggcccccaacaggctttctcaatttgtgggcgctgtcctctaacaatctatttctttccagactctccttggaaaccaaagatttatgtcattctcttcatattttaaaatgaaattgttccaggttaaagaaattatgaaaactgaaagcctgtctttatccaagaaccaacactgcctggacaaataacttatgaatacatcctattctggaggtatcatcaatgactttgcctctgtagcactcttaccattatttggacatttccagaaatcaagatccacttcagtttgtgaagatgagctgtgcttagacataggcttaaaaagaaaaggtaaataaatattctgtcaggttatatagagggaagcagaccctcccttttataaataacgtatacatttgcttaaactccagagtaaaggaaaaatctcatggactgaaaacattttttaaaaaaatgaatattcactaaacaatcctgaaatgctttttgctctctgaatacattcaaacaagtagatatcacagcatttcattgatagcttatcaaaccacagaatagaacaggaggacagaatacaaagggcattcttaagggagcaccatcatgattgttctgtaaaaacatatgaacatattgctataaactcatcttcacaggaagtcacacagcttaataagcacagacctgcaagttaatattaaaattcactttgatttcagcagcagcaaagctgatccaactaggagctattacataaaacccttattgtcatattcgtcatcaccactctcaatagagaccactgccagcaccaagaagccagccctcagttcacctcaggaaacaggctacacagacggccgtcccagtaacaatgcagcagtgagatggccctgtttattttatcagaatggcactcccttaatttttcagttctctttattgatgtcctttttcatgtacaggtctattagattctacttcctttactgtcctcccaggaattggtgcttgccaactacaataagttgttttgacaacttgtctagctatacaatactctgtttccttccctctacagtctttttggcttcaaatgagtgccttcaaaatatagcagagactatccaaccaaactatgctacaggggggaggagctttctatgtgtaagcaatgtcctgcccaaactacaatctttcatgtgctcatagtcctctttcttttcctatttatttttatggataaatcccccttgctatcttgtctactcctatcttaataaggaatgactgccgtgactacccccatctagctatgccattcaccgccagcacctctgctctcctcgtgtgcttcaagaagaactgattagcactttgcataattaacctgattagcactgtgcataatcaaactgattagcactttgcataattaaaaagaaataataataataacaataataagcactaagtaatatcaaaagctgttagtcccacagccctttggttacctccaagattagttcagtgcagcatattttgcaccttcacattgaaatcttttctttaactcaaaagtcaagaaaataaattaaaatgcttgcaatccacagactcgttatggttttcatatccataccagttaccaaaataatcagtttcttacccatacacatctccctcagtttgggtcttacatattttacccatgttaaaatggagaaaatggggatataaaaccaagtgaatgaaaaatatttagaataacattagaaaacaagatatatgatgcgtatagaagcatagagagagttatatagaactatataaccctcccttgtgttgcttctgggtgacaatgaggcatgtggaaagaactggacaacctatcagaaaaacctggctatgacatttcctggctaagtgatttaactttttggaacctcagttccctcatctgcaaaattaaaataataacaccagttctgctacctcaataactgtaattaaaataataatttaggaaggtgctttgtgaactgcaagacactttacgtacatgaggtattccattctaggtccctaaatctcctatcccccaaattttatttcacaccatggacaatattatacattatgaataataaattttaggctcagtgcagtggctcacacctgtaaccccagcactttgggaggccaaggcaggaagatcacttgaggccaggagttcaagaccagcctgggcaaaacagcaagatccccatctctacaaaattttttttaaaattagcggggtatggtggcatgcacctgtagtttgttttttttttttttaattttttattctcataggttattggggaacaggtggtgtttggttacatgagtaagttctttagtggtgatttgtgagattttggtgcactcatcacttgagcagtatacactgcacacaatttgtagtcttttatccctcacaccctttccccctggtccctaaagtccattgtgtcattcttatgcctttgcatcctcatactcagcaggctgaggcagaaggatcgcttgagcccaacagttcaaggctgcagtaagctaagaaggtgccactacactcctgtctgggcaacagagcaagaccccatctctaaaaaaataagataaaataaaaatttatatttataatgccttaaaattaaaaagttataaagtcctgttgcatgctttgccttatttcttattcagggctgaatgtgactaaaattttgacttggagttaaaactggactctagtaattattgtttccatcacagctctcatttgtgtttctgtggaggttaaaatcaagctgttgctggaaattcacaagagaggagaagaaaatctagtacattactattaatttgggactacaacataagagaattctgcaactctgcttttctccaccctaccatagccaaccatctgttccttaccaacttcgaggcttagttcagttccactttcctccaagaaaccacctatgatacccatagattggaaattctctctttctctctaatgcttccataatattttatctcatgcttccatagtacagtgtactatttattaaatatgtgtatatctatctgatacctttagtagattagctgctcctaaacagaactatgctgcctattcatttttgccccagaaatagctgccacaataaataatgtagtggtgaacactcaacacctttgttacagttggcttaaggaaactggatggtaaactatttttttcactaggcatttactatataattgctaaatgcaagcctgagaaattgtttcaataactatatgctagagaatacaaaggtgtttgacatacccataactacttaatcaaccattaaaaccaaccattcatttattaaaaaatagatagaagtgctagtaaatactaggcattgtgctaaacactgaatacagcattgataaagtttaaaaggaactgttggttcctctcaaggagcttatagtctaggtctctattaagaagttcatattagagaggctggagtggagtagtgtggaaaggaaaccttaaaatagcaagatacacatcatggagccactaagcctctatcaacctacgggaaaggaacccaaataagcagtcagtgttcttgggcaaatcattcattttacaattcatttaattcaagaaggaaaatgctgctgtggagattattcaagtccaaatgttcctggtgaaggtgcttccagtaattctgggaaagaagccaatcccttagttttatatgtaaatatttttaaaacacacacatatatataagcacaaaagaaaggtcaggaagacgtaagtcttttaaaaatctattttaataattttttctataactgtccacaaaagtttgggctttttttgtagccttacattttcttttacacaatacacctgcttttttttctaaactaaatatttcttccatctaatgactctctttattagacagcatctaatttgcatacatttacatacaatttaactgctagcttgtgagaacaaagaaatggctctgtattgtactgaaggacaatactcagtaaaggaaggtataaaaaccaaccagcttggtgactgtgtaagctctttgtttcagatataccaggctccctctttctcttttaacataccatttaaaaggggcaaaaattatttcatcaaacaatgaaaaaaagaaacagccctactttgtttaactgtccatttcctctccagtttggttactacaattcaggggtccaagttccctgaatctactacaatttcctctattatatttgatagatttaatccctttatctatttttgtttcgtgtctcattcctaaaacaacctgggattccactgcgataaagctctgttctgatgctaatttgtgctgccatcggccttgttcccaagcagacagggtagaatatggcatcatgctctccagtgaacaatgcatacacttacccttaacaggttaatagattttattgagactttgggtctttatcatatgaaccagctcttcaaaaagaaatggttttcagcatctactggagagatgatggaaaagaagacttgaatatagggagggaaatggtaaaatagatgttaggggtaaaagagtacttgagtcaaatgtttctccactcagcaatgctatccctttgtaagtctccaaacctgcatgactcttggagaattaaaaaaaaaaaaaaaaaaaagaactgaaaaccagggacccttgactctcctttgaaagtaaattcacatactctgtgatacggggtgagtcactatgactcttctctctgtagctctcatccttgacacatggaaaaggagattatgtaaagcaatcttgaagaggtttgttcagtgttttgtaaatattaacaattattgaaaacacacaaaataactaataaagctgcggtcacaaccaactgaaaataaacactaggctcattcaagtttctgaaatgccatgtctaaaataacacacaaaaaagaaatatggtacacaaaaatgcttcaagattataacaagctatacaaatgtaaagcaggacataagggcaaactgaaaattataaagccaggtacgaattggcaccaaagcctcgatggaattatcatccgtatctgggtgctgcaaatggtcatgggagatgcatttccttggacatatatttaacattattaatttggcctgttttctgcatctgataatgcaaatttacaattttagtgacccaaagaagtgtgaacttgtcagtgataagtgaagaaattctaccactctgtggggctgcagaatgcccacataatttggaacctttagcagccaaacagattgcacaatctcaactagcgatcttgaagcatgtctgattttccacctggtgagaagaagcctgagttatggggactgtatgagtgctggagtgctggcataaaccaactctgccaacttcttaacccataaacaattatgaataatgatccaaacagcatttaaaagaaataattagacactgcactttaaaaaaaaaccctcagtagtgactaaaatctagtcactggaatgagtagtcaggaagttgttgatcctccgaaaaccacggcttagttctaaaaacagccttaaattgcagagaacctgaccctgaccttcaaatcccttgctccatgaggaaatgagactaccgcctcctgagtgctatagtgtctgttctttcagagattgtcagtaagttttacaatacaattcctgtttctgaggctcattagatcttccttatttatacggatttgaggcagtacttgcttttgtgtgatagaattatctgttggtatccgacgtcagacctattttctacactctaacatattaaattctgccttgtttgtttctaaagcacctcttaataccaactcagccaacatcacctgtgctggaggtggttaagatccacctccccaatgcatgttaccacggtgacaaagtagtgacctaatttacacacacctgctgggttaattgggccaaaatgaaagatgatatatatgctcaaaatccaaaactgatttttttcctcaaaattaaatatttgattttttaaaaattagcagtttctaaagctaagtaacatactccaggtgtgcatttgccagttaatgtaccctgaatgtttcatgacacttgaggagcaaaatatattgagtgatgaatacaaatcttttatgtattttctgtgtgcaatgattagtatgagtaagtggtctcgatcactgaatacatggggtgtgcttgaagggtcaggccactgccttaaagcaaacagagacatctcaactgtgccaagttagcacgcagagtccgggccgcctttgaaagtgcaagtttgctttggagaaagctgttctccatagcctgaggctgcctgcaacatctcttagacaaaaacatcacttacctctgcttgacctcttcccacctctttgtattcattcttcccagaccactgagagtttttctttgaaccatattaagttttatgccaagaactgatgaggatatgaacaaatagatactttcagagactgctgggacagacacagcaatgtgtaaatggtatagctaaatgtatcaaaacccttaaaatacatatatctttgattcaattattacacttaagtatttacctgatgacataatcagggatgtttataaaaaagattgtcacaataatattcattgtaattcatgtttactggagaaaaattggaagcaacttacatgtccaaaaattagagatcagctaggtaaattataacacatccattgtatggaatactatataatcaattaaaaaaatcatgtcacaaaaaatattgacagaaacaaatattcataatatattgctagttgaaaaatcagaatcataaccttgcataatcctatgttgttgcatgcacacatacatatacacaccaaaatattaagaataactttttctttaagtggtaatagtaatatcaatggtgattttcttgtcttctttctgtctttttgtgttttccaaatagttttacactgatagcgtactacttttagaaaggaaatataaatatgatattaaaaataaaatgaagagtaggaaaaaagttaaatgacatttcctaatccctctctcctacttagatttcacatttcacctatatttacttctctccttgtcaactacagatgtaaatataatagatgttaaactggtcaatgttcttttattactgaatattcaacttttctagctgaatggatctttcacttatttacaaatcttacaaagatgtcagtcagcacaactcttagaaagagtctccaatctgctttttatgcttacaaaaaccatgtgaaataattgccttttaataacaatgattacttgaagtgaacttttcaaggtacaaataaatctatttatcaccaagctattgtgtcccgcttaaattacaactttcacattttgatttcatttgtacagatatagggtcttactgataagtaagtgcttttgttaagtaaataaaattagtattaccatatgaactggatttgctgttaaaagtatctcactaggggtttgatttattctatgatggtttcactgatttaatcattgcttaaattagcaaaatataattatatatttttataaagaagatgttttcttgggattttcctatgtcaccaagaatagacatcagggattgataagtaataagaaatgtcaattttaaaattacatttcttggtctaatatgctttctttttaccttagtgatgatcgctgccttcctaaaaagttcataaagcttcagaaaaatctaaaattcatgaaatttcaaagaattaaaaaaattggtgcttttatttcaagtgataaaattaaactttattttcattctcaaaaataagttttggttgaatcaaagatgtaaatattaagagactaaatcataaatgtgctagaagaaaatctgagtaatttttctggtgtaagaagttttctaagccataaaggaaattattgaaaaaatgaaactacataaaaaatttttctacatatacaaaactcaaaaagcaaattaataaccaagaaatatgtctaacacatactacagaaaatttattttccataatatacaaagaggctatacaaaccaataaaatatttttaaaaactcaatagaaaaatacagaaaagtattatagccaattcacaaaaaagtaaacaaaaatgtaaatggccagtgaaattttaatatgttgtttaatctaactcctgagtaaagaaatgtaaatcaaaacaatggtgaaatatcattttcacttttctgattaggaaaaatttgctaaagcccagtactgatgaggctgtgagaaagcaggaattctcatataatgttgttacatgtgtgtgtcagaaaaatgtttttgaaggaaaatttttaacaggcatcaaaattttaattatataaacatatctaagaaagtatgctatgtggatattaaaataaaaacaaggatatatttagaaagctgttttgtaatatttttaaacagcgaagaaactgtaaataaccaaatttccataaataggcagtggttaaatacattttgtgacatccataaaatggaaatattaagtagctgtttaaaaagaggaaaaggtaaaatataatataccaaaatataaacactataaaatttctagaatatataaaatctctaagacatggcattaagaaaaaagtacaaatgtatttgaacagtatgattccctttctgtttttaaattaaaggtatatagacacatttctctacgcaagtacagttgaaactttttatctctggtgaatagtgctatcagtcggtaaagacatacttttcactttatatccttgtgtaccattcaaattttttaaccctgtgagcacattttaaaaatacaaatagcagaaagattgttcagtgtaatggtaaatggtgaaaggtatatacatggaagtaaagagtactgcactgttaaatttctcattctagacttctctagtcccacagtaaatcattcaacttcactgggatttcatttcctcatttgtaaaataataattaaattagctcaaagaataatctgtaagttaccttatagttctaacagtacatattttcatgtgttaataatccaatacagaatggtggaaaaatatgtttgagacttaaatatcaattttgagcacctgtacctactacaataaacaaatctctacttggtattttgtatgtagactgtagccatgtctttatgacaaaaacaaacaataaatgtactgaaaattttggctcattgaataaactaaatattatcttaaagaccatccccatgcacaagtacctctgggtctcaatggtttagttctgccaaggtgttgaaacaagactatcaaacaaaactgatcagaaatgtattacttacatacttcactgccaacttaaagccacaaccacgaagctgacttgttgaatctaaccttgattaatgctctcatatatacaaaataatgtcaaaatatcaacattcatttataattcaggtatatattgccacaagcactcttaatatgtttttgatattggataacctgatagtgcatgctcacaagttaaaatagtaatatccatcttgtttttaatttgtggtacttgaggcttcagtataataatggccttcttccattgtgacttaatattcctatcatttggttatatatttttaaagcaaaaatctctcgatcgttattcagatgacaaattatatggtcatatctgttagatacagcaaagtctgcactgtggtatttctaagaaagcaagtagttcattccttcatttctgggttccattgtgataaggacagaaccatgggaatttccttggtaagattcaaggggtataactggtaagaatggtgtgttctttttttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtgtcgatctcctgacctcgtgatccgcccgcctcggcctcccaaagtgctgggattacaggcgtgagccaccgcgcccggccggtgtgttcttaatcacacaccataggtacatttgtaaattaggatgtggctaaagcctactaaaaagtatattgatagatttttagtatctgtagtgaaaaaagttagattctcacatctaaaaacctcacaatttctgaaactgtcatctgactgtgtttttcaaatgttcacagtagacggcctacttccttgtgcattttttcacatagtatcagcctgggtcatggtaatactgttatctggtataacatcgagcaatgggaaaataatgtggtgaatgaacagttgattagacacattaaactaaggaaaattcaatcaaagatcatcagtttcaatgatttactaccatacatctttgcttagctatgaataaaacattttgaatgaagcttttggtgaaatttctgtttcaagatgaaagtagaaatgagaaaaatagacatcctgtgctcacctcaaatggagagataactatatattccgaaaaagttctatgttaaatcttgggctcctatgagactaataaaaaaaaataagtttaacccttcattttcagtttcagtcttgatatacagaaaaggaggaaaagggctgatactactacttgaagaagtgatttgcgaaagggagaaatgatggctcaaaaacccctgtagctcctctaacaaaccctggtaccagagcagacaatgaaattgctagggagagctaagagtagcaatgaattcaatccctccctttgtggccaaacttagttctgctttcagaaataacaaaatttcaggagatatggttaaaatttataggatatggcaaagtttaaggagatttggttaagcatttttaatccattcccaaatgcttactatggctatatttagtaccaggataaagaggaggataaactggttgcccctgaagaagcagacctcccaactgtacattgttaatagttgacagaacactcctcccttgccacagctactctaatacacacaaaccttggatgcacaactctgtgtaacctgtaatgatttagagattgcatttcttgtacacaagatcttcccttgaatggctccttcacgtcattcaagtcttataattcaaactttatttcctcagaaaggacacctacaccctgcctccggattaccagccattcttcatcctttttgttgtagttgtatgttaatttgtttagtgtctctctctcggtcttctagttcagagctctgtctctagtgcctgagatcaactgaattgtaattatttactcatgatagaagagtaatcaacaccagaaagaaatctgctatctaacaaaataatagtttcttcttttttttttttcggcaacagatacaagacaaactaaaacaggttaattcaattaatgtgttttgggtgcaaatcccagtttggtattatcaaaggcatattttcacatttaactatattatcatttcagggattacttaattttcattttcatttctatttcatcctttcttttctggcagggaagcctaagctcatttgtaaaatttttctgtcctctgagcatacaattatattttatccagaacagaagtgcaccaaaagagctgaaagttaaaagaaatgttcagtagatgagacctataatactggttctgattaattaatataatcactctattaattatctatgtttaaaattcaaatttatctatgttggcttattgagcattcttaaagaaaacatacttgtaatatcctacaaccatgaggtggaaagggtcagcaaatgcttccaattatatcccaattattttaggaatggtttacttcaccttctgctccctctacccactcaccctaatagtggtctgctccttacttaaaaggggaaaacacaaagatttcctgcagtttgagaatcaacttgggagaaatagaaaaacaggtgtctgagttgagcagagctgagtttagtcctgtgtcagccatttactagctatttaaagttagaaattaactttctgagccttgggcttgctcttttaatctagacctggatattcatgattccagtgttcatttaatggatgtgtatttgtacgtatggccatatccatagttctctaataaagacctggccgatgctaagcagagaaattagacggattgtgatctcaacatgcagtcatccagcacaatacttttgtccatctacgacactaaatttcaattgtatacttggcttatattatctggagatcattacgaaaaacattttctgcaactcttgatttacttaggtcacaagtaaagttatgtgaaagtaccatggactataagagtatatttggcatctcaacacacatggattgacagaaaagttggatgataccaatgtcagtttttagttctgcagtccatctgcagagttagtgactgttggttacctattctatgcctcaaccttgtcatctataatgagaagtttcagtagtttaaaaaagtatgacagaaaatgattcataattccatgaaattcataaaaaataccaaggtgctaaggctacaagtattctaaaaacagaggacaggataaactttgtcaaataccgaggggaaaaataattaacatgttagcatatgtcttagtctgtttcctgtcgcctataacggaatacttgtaactcagcaatttataagaaaggaaatttatctcttatagttggaggctgggaagtccaaggttgagggagcaaaactggtgaaagccttcttgccgtgacaacactctagaatcctgagacaacgtaggacatcacatggcaagggggcagactgtgctagcgcaggtctctctttatgtttctataaagctaccagtcccattcccatgataacccagtaattcattaacccaagaaaagactcatccattcatgggccctcatgacccacctcttaaaggccccagctctcaatactgccacactggggcttaactttcaacatgagttttggaggggacaaaaattcaaaccatagcagtgtgtaaataagtcttccatagatatttactaccaaaaaataacattactctctatagtaggttgaatgttgactagagtccccaaaatttcatgttcacctggaacctcagaatgtaacattcctgggagatacggtccttgcagatgcaactaattaagaaccatgagataaaatcatcctggatttaaggtgggccctaaatccaataactgatatgcttttaataggaggagaggacacagagggacacatacagaggggaaggtgctgtaaagatgaaggcagagtttgacgtcatagtgccaaaagccaaagaataaatgggaccatcagaagctggaagagccagggaaagattttcactgtgagccttcagagggaatgtggccctgctgcattttgatttctgatttctagcctccagaactgtgagagaataaatttctgtcgtttttaagtcacccagtttatcataatttactacagcagccataggtaactagtacactttccctgtactctctaggactaaaacagaggaagacatacagaagttttataagtgtaaatagtgatctcaaagcccccaattgataggagcacataaggacaaataaaaatcaatgagaaaacttaagaggttgcagtgatggtttctggtagtagtaagcctcaaacgaaatgtactgccctctatttggagctgttccctcttaaatcaaatgcagatgccctccaaaagtgatgcaacatcttctgatccaatcctttcaagcaagccagaaactgatcttaacgtggaattggtcattaaaaaaaaaaaaagaaagaaagaaagaaaagaaaattaataggctgggtgcagtggctcacgcctgtaaatccagcactttgggaggctgaggcaggaggactgctggagcccaggagtttgagaccagcatgggcaacatagtgagacccccatttctacaaaaaaaaaatttaaacatctgctgagcatggtggtgcacacctgtagtcccagctactgggaagctgagatgggaggactgcctgggaggttgagactgcagtgagccatgatcatgccactgcactccagcctgggtgacaaagtgaggcctttatatttttaaaaatccaagtggtatattgatgtaaataattaatatcttacaatgatatatgatcaatagcaaaagtatactggaaattacttaattggacataaatcagttctcaaataaaaaattatttatgttcctgaagaacttgattcagagagtaaatatacctatttttcatcaatggaaatttaaatataatatcagtaacaaatttacatagaggaaaatcaattttattttggtctagagtatatactatcatgagacttggcaaagaccctaataagtatacagatcacggcttgaggcatcagatcagcatgattaaagattatgtttgaattgtctcctgatatacaaaattaaccatttcttaagtaatactaaactcagctatcctatttgctacacaaatttaagccattatagaagcaacattttagttaattttcaatatctctatttactttctgtgcatatttttatgtacttacacttaaatcttaactttcagatagtcctaccttatttaatttttttacctttaaaaagtcataacctgtggtataatcttcttttgatatgcttaacaaaatataacaatgaaatgtagtgtaaaaagtttaaatacttttaaaaatatatttttaaatagcttaagaaatatattttgaaaatatattttacacaaatatgaatgtgtgaaatatctattcacacatttttaccctaatgcacagaaatcctttcgtttagaaaaatagaaattgtattcataatttcccttaaagactctcaaaaccataaggatgatacatgcagatattaactattagatattacatgtttaaagcaggaaagaatgaaaacgttaacttcctagaaaactgcaaatatcaaattctttttcttttggttttttaacttaagagttgtgcattaattactattagtaattaattagtcaccaaatattctaaaggtgggaacaaaaggttcttacaactcagagatgaatctatttatatttgactttttttctcagacactggtctcctaacactttataagttcaataagatgtgaatatagataattagggtattcctatataatcaggtagaaagtgaatacatttgtgtcagtagctacaataatttgcattaaatgaatgagtgaataaaaaataaatcataaaaaggcactgtttgggattggtataaaacatttacttttaatacataaattattaatattaagcagttatattacaaatgacagagaactgttattgaggtgcaaataactcaacagtaaatattagccatgactaggttatagggtgtttctggaattcttgcttctttttagattagtataatgctctactcaaggtgtagagtaaatctgcaataactagagcaaataataagtggtagaaaaaaaaggatctatacagaagaccatattttattacatggtttcagaatagcattatgattatgatgactaatgagaggaggaagaagaagagatgtttttaattttaaagtgctttggtatgttgtcatctctaatttacagatgaggaaactgagcgtaaaagcacacgaagagctgcctatatctcatagccaataagtgataacagagaaacttaaatccctctcttctatttctaaaccctgtactctttctactctattatattgtctctttattccctgaaaccagagatatgtattaacagtaaaattcttaaatactgcagttaaaatagaaattcctccaagccagtgttgaaagcaccacagtatttataaaaataaaaatcagcttcttaaaaaattattgttcttaaataaatttaaaaagaacaaaatcttctttgagttcccctatattcctcatacagaatcttggcagtgataatctgcaccgtaaactgtgaagtaaattgtgtatgtgaatgaaaacaataagaacctacagaaacacatgggagatctaactcggataggatggtctgagtagcgtagggacatggatgaagctagaaaccatcattctgagcaaactgtcacaaggacagaaaaccaaataccgcatgttctcactcataggtgggaattgaacaatgagaacacttggacacagggtggggaacatcacacaccgggcctgtcctggggtggggagacgggggagggattgcattaggagatgtacctaatgtaaatgacaagttaaggggtgcagcacaccaacatggcacatgtatacatatgtaacaaacctgcacattgtgcacatgtaccctagaacttaaagtataataaaaaaggaagaaaaataataataatattatcacatttcacagagtttacagtctggcggaggagaaaaacattaaactaataattatataaccacttatttatttacacctgaggtctattcgttatctttgactatgccacataattccaatctgaactcacttgtatgcattacttagcttggcgatgcttgatgttctcctttctatttccttatgtcctatgcttcatgtttttttcaaggcccagcttaagttcagcctcttcccagcagttcacagagatctctgcctccactaaatatctttagcacttaatgattctttttcaacaatggcaaatgggtttcctattacatgaaacttccaacaattggtatggctgtcaaagtactgtcttcagagggactctgaggtcaagttttggtgtagtgacagagacagccataatggattagtgttgtttcatggacagtgaaggggagacaggggatgctgaatttagaacattgacttcacaaatagactgcctaacttaaaaaaaatgtttgtagcatttattttacaccaaatccaggtctaagcatgcaatttgacactgagagtgccttgttttattttttaaaaaacctgtatcatgtctcctcaagtatcataagattcttgcatgtaatacttctctatgctcacagcatgtagtcatgccttgaaacataggcatttgctgatgacaataaattaccattttagaattcactcttattactattgtgaactccatttatgtcatagcttctctcaaaatattatcaatattgaacccattttagaaaaactttgtaacataagctataaaatgtaagtaaatatattgtctttaccatgaccagattcaaattcaacattaggatattgataacacttaacgattaaatatatacctgccaaataataaaatgaaacaaagagaagataactacttcttaaatgagtttaaacattttttaaaaatccagccaggcgtggtggctcatgcctgtaatcctagcactttgggaggcccaggcaggtggattgcctgagctcaggagtttgagaccagcccgggcaacatggtgaaaccccgtctctactaaaatacaaaaaactagacgggtgtggtggcgggcacctgtagtcccagctactcggaaggctgaggcaggagaattgtttgaacccaggaagtggaggttgcagtgagccgtgatcgcgcctctgcactccagcctgggcgacagagcgagactccatctccaaaaaaaaaaaatatccaaatctgtgtatttcaaaatatattttacatacttattatgtcctaaaatttgtatctctcttttagtatacttcattttcctgcacatagtaagtgttgaagaaatccacagtggttagtttagaccttattttagagagatagctccattttacattccgtcttgctaaggaagtgtattcatcatattccataacagctcacagtttgttatacattaactgcttattctctgtgccaataagactgtgctggaacagcaaataaatttggtgcattcatttaaatgattctgcaaaccacaggctacccagttgtctaatgataagagagccccaaagccacctgatcaccattatactcccttatttttttggatttgcatggtcagtactgtcaggatctgaatacagagaagaatgagaagtaaaagtatacctcagacctaatcatgaaaagggattttattaatttcggcaccagtgatgatgtggctaggttggaaggggaatgggatataagatctggagtgctttatctgctccaagaccaatgctggttttggcacttctctcactctagtgagttgcaaaaaaacaagcaggtgctagcaatctgagagaccacatgccagctacagctgcttcaaactgattcaattacatctgcctgaatagtcccaggacatcaaactagttgaagagatccataggttgcaaggagactttgtctatcctgatggacaactgtctctgagataatgacctgcaaatttccaggttgtgatataaagtgatcattccatcaccaggcataagagaaaagatgggggaatgcgatgttttattcactttaaaattaaaaattggttgtagaaagcacaaaggcctctttgaatttaaatctgaaagtcactgaggccttatggataccttgaaacagcccaattttgtgagaacatttcccaaatcattgggtacagcacatttacagaacatgctcttgggatccggacttcgctccaaaccttgtttgtacaaaaaggggccaagcagctgggaaattctggagtggagtgtgtcctcattagttcccatctgccaccagaactcagctcatggcaagtttggctaagtcctggtgtactcaggtccaaatgtgggtcagttttaattacactatacagaattcagtgtgcagttttaaaatccttattatacagcacagaggaatgggcagctctccagctaatcaattttttaaaagtacatatataaaaattttaaaccaggctagacagacagtgggtggaaaaaaatctttaaatgagtacaagggttacttaagagaattattagtgaaattgggtcatgaacaagttctgctttaaagcttcaaagtgagaaacaaactgttttcattggtaagttggaaaacttatgtaaggtacacaatgtgccttgctctttagtgtgaataacaataagcctgtggccagggtacacaacacacctacaagtgaactggctttcatgtaagcagaaatgttcccaattttgtgactcttcactccatccccttttgatgtttatcacttatggcaaagactggataaaagaaaaaaatcacaagctacctggtaaatagtgaaaaaaaaaagatgaggaaggggagggagtgagagaaaaggagagtagaaagcacaagtgctgagtagcagactctgggcatgacttgtctctcagtgccatccatacaaatgggggccagaatcaacgcttgcagtctatgttcagattccatcctgtccaaaagctttatcaggttcaggagcgctaaaacactaagccttcgaagacaattgtcagtaaaaaattcaggagtaaacacgtcggcagtcagtgattaggcatttatgcaccatttttgatagataaaatgtcccttgacacaagtcctaatgacaacaacaacaacaacaacaaaacacaaaaaccttaaatgttcaaagtatctttgggcttttgactgagtttttatcaggtttatccatttaaaagcagcacgggatgctaggttcaaataccagcattgaatatttacaagctatatgactttggacaaattgcttatcctctctgacattttgttttctcacctgcaaaatgggagaaataacatcttcctcacagggctgttgcaaggatcataaaacatatatgcatacatatattggatattacatatctatatatacatacatgcatatatatacatatacactcacataaatgtgcatatgtatatatatagcatctggaacatgaaagtcactcaataaatgttaactatcattaacccagttatgatgaactaaattttgttccccaacccctccaaaaaaaaacatgtgttggagttctaaccccaagtacttccaaatgtgatcttacttggacataggtctctaaagaggtaatcgagttaaaataatgcaattagggtgggcctgaattcaatatgactgatgtccttataaaagcagagaaatctggggacagagacagatacttacagagggaagacagaggaagacatatggagagacataggaaggagatggccatctatatgtcaaggagaaaggctggaacagatccttccctcacagccctgagaagaaccaacctggctaataaaccttgatttcagacttctgaactgtgagaaaacaaatgtctgtttaagccaccaagtttgtggtcctttgtaatattcccaactaaataaaaattccattaatcatcaatatttaccttgattcatcatggtcgaaactatacatttgatattaggcaggtctgtattacctctggtgagtaataatcaattctatatatattatctagtgatgttttcattattttaaaagaatccttttctgattgctgtacaagaagatactgctgcaatataaacagcctggcagaggaaaatggtttactataattaagatcatctagttattattaaagataattaagggaaaatcatacatataaattcataaatccacttttctactgttgagtttgcatagaaggaaatcagaaaatcttaccacactaatttccttctcaagaaaaaataaaaccttacacagcgatttatgcactgacaactatgctcactaaacctgaggctgcttagattaccaacaggaccacttttaagtcattttgatgcatatgaaagtaactcatcaagcatgggttcttcatcctttgcaagagactgcttttaaaggtatctgactttcagaagagggatgagagttgtctgggttgtgtcaacacgctttctattgcaagacatacctccataatcaacagacattgaagtgaatgtgagcatccccatcttaagtttttctttaaacagccctagccttctatagaaatgtggcatgtatagttagaaattatgagtctaattatgttgaactgagataagcaacagatatcacaagagccataattggaccaaagttaactttcttaatgtatgtgtcccacacttccttgaaattcctatactactgattataaaaatttttatattttgtcaagagaagagaggaaaaaataatacacagagactactatgcaataatacataggtggtagtggtgcacaaaataaagtattttgtatacctaatttactttaatccacatatccaccattaaaaaggtaggtgttgttaccaccatactatacataggaaagcttgaggcttagtaagctctgccaacctcgatgaggtcgcacagctactgaataatggagctagacttttggtaaaggtcagtgggagggaatccaaagctcctaaattcaaactcaagcatgagatttacaatccagatatcctaagtgcatcactgggttccaagatggtgatttatttaaggaattcacaggcgtgttgaaagcatttgaactcacataagcagtagatgtgttcttgctaaacctaactcaacttattctccttatgaggaaatcaatgctattcacaaacacaacctaaaaggctttattcaatttaaatgaaattaatcttattataagaacacatgaaaatggaattaccatacaatctagcaattccacttctgggtatatactcaaaagcattgaaagcaggttctcagagagatagttgtacacctatattcatagccaaattgttcataataattaaaacatggaagcaatccaagtgtccactgatgagtgaatggacaggcaaaatgtggtatatacatgcaattaattattattcagccataaaaacaaggaaatcctgacatgtactaccacatggatgaatgctgaggacattacgctaagtgaaataagccaaacacgagaagagaaatactatatgattccacttatataactacatagagaagtcaaaatgacagagacagacactaaaatggtggctgccagaggctgggggtgggagtgcagagggaaatgggaagttatattttaatgggtatagtattttagttttacaacatgaaagtgttatatagagatgtattgtggtgatggctgtgcaagcatcataaatgtatttaataccattgaactgtataccaaaaaatagttaagatagtaaacttcatgttgtgtgtatttttcccaaatacaaaaatttggggaaaataataaaaatatcacatgaaggtcttttagattcagtacattgcttcatgatttttataatatcttctaaggccagggaagcagaggtaactttgtatagaacctctgagtacaatctatgtgataatgcccaaccaggatccctgctcccaggcaattagatgttcttttttcagagtctaaactgcagtagtggtgatggcgagggaactggtagtgatagaaatgacagtagcatagctaagatttcttcagtacttgctatgtgccaaccagtggaccaagaatcttacatgtagtgtgttattaactctcagacaacagatactattattttcccagttttacaaatgagtaaacaagggaacagaaacattaggtaacttgattgagaccatactaataataagtggtgaagtcaaaaagaactctattgatatatctttgtctctcactagcctgtatcctcttgagaacaaagattttgttgtattcatctagcctagcacaatttctagcaaacagcagacatccattcaccatgcagaataaaaggaaatgaggaaaggagagagggaaagaagggggaaaaaagaaattatatctagtcatgctatgttcttaataaatgtggattttctttctttatttccttaaccctgaaatcgcaggggaacctgcaataatgctcaggaatcctagggcataggaattcctccctctttgagattccaggctaattcctgacacaggaccctcaaaaagctgctaatatctgtctagtttaatgattaatattctagcaaatatatattcttggctcatctcctaatttctaatattgagactaacagagagatagagttcaatctaccacactaagattcactggaaaaaaccgatgtctttgatattggcctcttgcacactggtgtgaactgaggtaaaagaaaaactgttcccagaggaaaggtagttccatgcctaaaagtacatgtgtcataaaccagtggtactaaaatttgagaagcctaaacaaaaggttttaatgcaatagataactggcttattatgtaaactgtgccaatcttatgtgacgggcttatgccacacaaaacggaacattagaatgatctatctaaagcaagtcttaactgttctattttgactctactcttgcttggctttacctctatttataattaaaatttagtgagtcatagagaccataattataaacatgtatacagtaaacacagggtccattacttttgcttagaaaaataattacagattttttaatattctgatcttaactgacccaaaggaattaaacacacattttatttttgtgttttagtgagatagagatagggagggagaagcataagccagtgctcaggaaagacgaggcattaaccatataacatagatttgtttatttatgggctgcaaagtatttccaaggtgacaagtaacttagccattaatgcctcagccttatgtgtataatgggaataacatacagacttcttgtaataagtaaaagttagtttaaagcacattgcaaatagtgttatttcaattattcattaaaatagtcaaaaaggatcagttcttatacattaatttctcattttaaggacagaatttatcagtattctcatatctatgtaactggcagtatgagaactaaaggccatcaagacttatctaaactgtataacaagtaataagattttaggacacaatccctctatttctaatacaactccagaaatgttttattcataaatgcattcattcaacatttactgatcaactactatgtacaaggcattgtataagaggctgtggcaatcctctacttacctttgtactgtgtttcctacttccaaagaggttaaattaataccaaagtgatttgttaaaaatacaaaaaaggattccaaatgggccaataaaaggaaaagacacaccaactctaagaccagatttatgttactaaataccgacggaaactcctcagcatttaaaagaatacattaaggagagtaatgcaagtcatttggatgttttcaatatgagaaatttgagcctactgaataaattaattaaatatctttaatattgagttgcagctttttattgcatttatagaactttacctattagtaaaatatacaatctataatagcttgtctatatcaaaaatatagatatctgtcagaaaacatacaaagccacaactaaaatacatttaatatcattaccagtaacatttgtgaaaaaataccaagcatctagcatttgttaaattaaagaataatattccataaaatctacatctggattttagcccctcttttagaattactatttaatcttcactttttttctctctcacttctaccccaacagcaacagaaacacatgcacaaattaaggaattatcttacaatatacccttaaattttctgaatatgccccatgtgtccactaatagccaaatgctttcaaatctgttcagctaaatggatcaataactacatccagcctcacatagtggggctgccaacacggtgaaattgagccaaacacaaaatgtctctaccaggacaaaaattattatcaacccagttatctgaagagatctactctcccagatattctttcgagaagttggcatacacattatctagggcagtcaacagctactaaaaaaaaaatatttgagtcataaaacagaggatttaaagaaaatattcagaagctaaaaccagtgagttttagaataaaccaatgtaacagttcaaggtctacatcaagtaagaatctttcagagtcagagtacacaaaacacgtaagagcacaagcacactgctaacaagcttctctgtgctctcactcatatgacacagctgcaagcaacaattgagcaggtgcaaccaagcttttgagaattcctgcctgttgcccaggaaccacaacactgcatggttgagattttaaacaggtgcaaacatttttttttcccattcgtctagtgcttgagacagtggagcagacagtacatctgcaaccactccatacctaaagcaaccatcacagaaaataaactcaaaagcagcaaaataaaaaaaagtttaaataaaacaataatggcaaaactgtggttttgcaatggtctgaccccacatcaccgttcactttaatagtacaattccataaaataatctcttcaccagatgaatgctttgtaattaaaattatttgccttatcaaatcttagaaatgtttacttgattcttacaatagaataaaataaaatatatgtataaaatgtactatcctttgaagctgtcattatctgtaagtaatcaagaattaacatttttacattatgaaatctataagcaattttaatacataaaaatattataacttgttagttaatatatagatttacatagttataggtaattcatatacatacctgtgcagctatggggcacaaacttgcaattcatcaattctgaaatgtaaaagaaatatataagtaaaaattaatttactaagttggaaccagtatttatgttgcaacaattcctgcagagaagtaggaaaagtttcagtgcataaagaggtaaattattttttatcaatattttccctataggatatttcatatatctgaaaatatatacacacacacacacacacacacacacacacacacacagagtcccttagcagtgtatcataagcactagcaagggactctgactcaccatggcctctgaaactcaaatgctttcactagaggacgaggcaaacactttaaaatgatttttttttttggtattcttccaagactattgccttcctaatacaaatatgactgctgctctctaaaatgaaactactcagattcatctgcactcagtttggatagaatgttgttaaggaagaaaggtgcttttgtagagcagtccacaaaaaaatgcatgaataaatgaaagtaaactttgaatgttcgttaactttgagttacaacagcaaatagaaatgaaattgattgctacaagaaggaatgctaacaccacgtcggatataatgcaaaatgcctcaactcaacacactttgacaaaactgccagcgaagtaggtattgatacagaagactatgtaagtccacattaaacaaaagtagcagtttacaattagacctgaaaaacatttggatttaggtggaaactgtattgcaacatacagcctgggaactactggtactcttaaaaatatttcctagttctagccaggagtggtggctcacgcctgtaatcccagcactatgggaggctgaggtgggctgatcacctgaggtcaggagttcgagactagcccgagattacgctattgcactccagcctgggtgacaagagagaggctccatctcaaaaaaaaaaaaaattctttttgaaagcaaacggacatgtttaatttatatagttcttctgagcacagtcgattacagcaacacattatagtcagtaagtccactttataatactgcttaaaagtatatagaggtaataattttgatgatggctcaataaaacaacatcttcgtatattctgatgggaatgtggattacaaaagactttctagaaacccactgagtactatgtatcaagaacccaaagttcaatatttttactcagtaattttagtcccaggaatcaaatgtaatagaaaaccaacagaaatttatgtaaaaaagataatttttatgacagtaaaaaactataagcaacctaaatatctaatagaaaaataattaaataaagcatagcacatctatataaaggaatatttggcaaaatttaacaaggtactttaaagaatattttaaattttacggaaaaatgcaaatttatagtattatgatgctaaaatattatataaacatgtagactaccaattacatggacagtatgaaattatgtgaataagaaaaaacaaagaacaaaacaaagaattaagagtgattatatctggataataagactttggatgattttaattttttctttttactttcatatatagttaattatctacaataagcatgacttttataataggaaaaaataatagtaggtagggtaggggtaaaaggaaaaagttataaaatgctatattgaattcataaatgtaaccttcctaagagaaataaattaattcagtcacaaataaaacccagtaactgtgcctacagtgagaaacaccctcactgcttcctcaaaggggcatagccagggtcttttttatcccagtgctttggaatctacacaagtaattcaataacacatttttaaatcatcttagtaaaacttctttacttattatgcagagtgaaatgatggcaagaataatttaggacttcaaatctcttcaacctagcacagcctaacttattcactaattcaatcacattcagtgagcatctactgcctgcatggtgctgtgtttggcactgcaacgtgctaacagataaattaggacacaccttaccctcattgagctaacaatttaaaaacactaaaaaatgtttagacacagctcacatgaagaagtaaacacaatacagttcaaagcatttgtgacagatttggtacattttaaagcaagaaaacatacactaggtttattttttatatttctgagcaaacacctatctttaggtaacaataaaaagtcatgtgtattagtatcacttattaatgcactagcaaattaagtatttaagttttttccttatgtgatctattttttgttaatggacagttacataataggagattaagtatgaaggaatagtgacccaatctggaatgcagatgtgtaagattgtctcagtttatctgaggccacataaaacacatgcacaattattaacaggctgcagttatttattggaaaccaaagcaaataagttagttactggttaatcctgctaaaagacactgttatgacaacaccaccagggaaagaaaagaagatagagcaaaccacttttgttatgcagataaaatgattcagcatagagattctctcaatagcagttcagtttcctgctggcctgtaaacataatcagcaatgcccttctgaggccagtgctgcaggattattccaatgtgaggtcaatggggtcaatctgtgtgaagtggtgacaaacactaagagaaggtaagaagctatttgtgtgatcagtgatccatagactggggctcagagttctgggaagcagtagagttatgaggtagggtggtagttaagcacttagcttttgccatcaaacaaacctggaatcaaattccagctccccatctttagttctgtgatcctaagcaatttaaattttctgtctgtaaaatggtgatcatgttactcaccctacgaggttgtctatgcaggttatatgttatagccatataaaggaactagcacagtgccagccatgaggtaagcatttgataaaagggaactgttagtactatcatagttgtatgaaaagggaaagcatgtctgtccctttaagctaaggaactaagctaggcaaggagtaaggagataaagaaggcttgttgaagacatcaccctacagtccagcagctcatccaaaagccagtcatgtgcttgatgttcacagaacatttctgaatcaggcaacactgcaacaatagtaatagccacaataacaattctaaccagcacttttaagctccattcctatgactgaaaagaaaggcagtaaagtctaaataatacgtgcagcaacactgccgaacttctctgggtgaaaaatgaaggatcactttccacatttaactgaaacaatcaggaaaaggaaaataaggacaaaatgaatataattactcaactggaattggaccaaggtgccgtgtaatggtcttagcaatcacatgtaggcacttatcacctttttatgtattctaaggagatcctgcagatgaccagagccttatatatgaggtttgcaactctaagtaaaaaaaaacgttagagtcagtttttttcttatggctgggaagacagaaatggatgcatactgatgttgttctagtccttatttgtgttttgatttaaaggacagcacagatcctgagttgttaagtggcgtgtcttcagattcccacacagttcatgtaattgctagagttgtttcactcgcattgggtgaagttactattagcaccattccagatgcagatatactatagagtgtttgtttgtttgtttgtttgtttgaagttctttttacttctaggttggcatagctgtgttctccagtgggataggtccaattctatgttacagaatacagaaatagttcatcttcccttcatactagttgggcctggctagagatgccccttaagccattaataaatctacttgctaattcacttagagtactaacaaggatctcacctgggcctgtgggtacaaccactccatagaagagctctaaacctaaatttaaacaaaaagaatttcacccatgactgaggaagcatccacaggactattttacatgctttacatttaaatttgatattttgagagaagactatgtaattcaaaataattttattttatttaatatgtatttagtccttctggacccactacagagctggatgttgtatcattattatatggttattataaaatgtacactttactcatcaataaagccaattttacttttgaaaattgaggtacctggcttctgtggtttctctcaacagaaagtcctatgaagagtaagaactataaattgtcaagtagacttgaaaaacttatgcttattttgtaaattactgagctaggtctggcccttcattttgaaaagctatctgcctataagaaagaggaagtatgaggagcacagttatctattaatcaacactgtgaactggaaacagataaagtgcaataaagaaggaaaaggaaatcatatggtaaacaccgttaacccaacggcacagttgatctgtctagaccttaggtcagataagctgtaataaagctataaaatccacgaaaaactaaagcttatttacaaaaactgcaaaatttgaattttctataattaatgccacttaaaatgaaagaatttaatatcaaatttcatgtataaacatgataaatttgaactctcaagtagaaacctcatctacaatacactaagtgttaataattctaattgtcctataatccacacttcacagcatattctagagaaaatagctgttgggtttttatgacttaacttaaacttcacaacttttaaaataaaagtttaagagctaatttaaaaatgtatttaagaacctaaaatttagaaaatattaaaaattatattttcaaaatatcctcaacttgaagttatggctattgaaatcaatgatttattctcagaaaatgtgaaaattttactggcctgcttgtatacatccctggggtcttagtttagatattatctcctccagaatctgatatcctgtgtctaatcctgtcataataatcattttattgcactggaattgtcttttacataagactgtaaacttggggaccagcatttgtatcttattcaccattacatctgtagtttttacttagcacagtacataatgtgtggtaggtaggtcttaaatattggctaaaggaatgttgcatgaattgtgttagcttgtattcttgatgattaagaaaattcacactgcataaaaaattaaggaatcacattcgtaaacaagttattcccaatctttaaaggactaatcttccaatctattttcttgtgctttttctacctatttttcctcttaatcagtacaaacttaaaatatgagaatttgagtctcaaatgttaacaccaggttagaaagcctcgttagtttggccccacattggacaagaatgagttgtccaaatcctacctgttaacagatactcggtatggaagaaactgttacacagagttcactgaaagagttctgcagttcctaaccaattatgtggttcttatactttctctaaaaaacttcttctagctatagttcctgagacagatacctccactattttattcttttgtggcatatatgacagtttaaattattggggtgattattggcttatgtgtttattatctctttctttcccactagattgtatactccatagaggccacactactttattcactactctatacccagggtctagtttagtgcctgacacacagtcaacacttaataagtatttgtcagatgtataagacaaacatgagttcaaaaatatgagcagtaaatttagagcagtagctttcaatcaagagactataaaagtaggcagttaacagctacccctaaaaagtgttttcatttgaactctgtggaagccttgatgatgtagaaaatcttttattgtaaattctgttcaatcaaaggcaaggcagaaaaacttcaaaagcaattctaggtaggatgaaggtatagtacctagaaaaagcaatggaatcacaacaacagcaaccactttcaattagaagttttgagtttgaattaaagcttactaggtatgtgtcctaggtaaacttacataaccatctctaatattcagattaatcatatttaaaatgagggggattttatataatataaaatttttatattatataaaattttatgtttttatgatgacttaatgagattatatgtatacaagtagctattagcattatctatggcatttaggagaaggggctcactattgattagttcctttaccttggccagccagcgtctgcaacaagattgagctaaaacttcatcaagtaaccaggataatacattttaggtaggaaaacatagatgaaataagggcttaaatgcagagaaaagtaagttggtgttagggttaatacataaaaaaaaatgtgtaagacagagtagcgagaatttcacagcagttagaaatggaaaaagatttcaacatgatacaaaaactgccaagaaatctattagcttttcccttaggtgacgcagtcttcccctcatataaataaaataattgctactattatagttggagaaaaatcaactgaaatgtacattaaacacgtattagagatttaacattcttcacatcatttcacatgctgaaaactcaacctttgtaaatatagccatgaaccttattatttactataataaagtaacagcatatccttttctatgtactacttgcagaagtataaaaggcaaatgtgttcttgctctttaggtgcaattacaaggcagcagaatgtagttaggctaattttttgcattttgtgctcatcagacagtggctaccaaccctgcaagaaaaaactggtaccaaaaatacttcatcggaaattctattttcatacttagttgctttcagtattcttactaatttggtcaaacttatgtcagctccctcattaaaattgttttctgtctaaatcgttatcttttctgtgtacgtatatgtgtgtatgtgtattatttggtcaatattcagacagaacaagtctgagatgcaccgcataacaaaagtaatcaccccatccccatacttctcagggaatatctacctggtaccaataagctcatcaagagttcatctgaattcatagcctttgtcaatcagaggtgataaactgtgattttagtagtctatgttccctgcaagaccatcgtcttcatgagggctagaatctggtttattttctttcttttttgtcatcaccacctagttcaggacaaagcacacaatatacaaccattggatatttcattcatttattctaaaatgtttattgagtacttactatgtgacaggcattgttccaagtggtggtgatttaggagtgaacaaaatagatggaaatttctgatctcatggagattatatatatttgttgtggatgtctgataataaatatatagaatgacagacaattatctgcgctaaggaattaaaataaagcagggaaagggaaaagtaaatgatgggattgggagttggggttgaaattttagatagggggaccagcaaagaaattatggaaagatcacattcaagtgaagacccaaaagaaatgaaggagggagttagccagaaatgccttggagaaaaggcaaaggaataggaaagagtttcctttaaaatgccaggctatattcagatagaaatgtttctattaaaatataaaggtatacgaaaggcattcaagccaaagaaataggaaagacttttctttaaaatgtcaggctatattcacacagaaatgtttctattaaaatataaaggtcctatagaaacatttctgtacgaatatataaacatcaaatacataaaagttttaaaatgtttcataagaaaggaacttagaaatcaagaagatagagctagggtatttggcattactatgattctaccacaaccctcccaggggaattatccagctcagtaataacctgagaaatttaggggtacaaataaagtttgcaataactgtaatcactgagaatggcaacctcctaatagatctggaatacctagaagaaacaaatccacttttgcaggataccttcaacaactcaggtcatgtgggagtctcacagaaaaagcaaacaccaatgaaaaagagctcatatatcaaaaatatcaaatccgaagaaaggttcatccataaatgagtcagcagatgaaaaactttaaatgaaatgtacgcattaagttcaaaatagggcacaatcttagggaactaatctgagggccaaaataaaaaaagaaagaaactatgaaaaaggcagatttgataaatatacagagatttatagaaataaaattgtcattaaaattaatatctgaagtgagaatttatcatattaaatggagctaaagggaggattactgaactgaaaaataattccaaggaatttacctaccataaaacagagatagaagatattttttaaaaagattaggagatataaatgacaaaataaaaaactctaacatatctaataagtatttaagaatgaaaaaaaataaagacaaaaatgcaatatctgaaatgatgatgaatcttttccaaaactgataaaacctcagaaaactgtaaaacagcatcaggtaggtccttcagggaatatttcagaaaaaggaatttttatcacaggagatgacagctccatgcatgttattacgccagaagaccttccagtgggacaagatgtagaggtggaggacagtgatatggatgatcccgaccctgtgtagacctggctaatgtgtgcatttttgttagtttttagcaaagtttaaaaagttaaaaaaaattaaatggaaaaaatacagaataaagatgtaaagaaaaaatattttgtacagctatacaatttatgtgagctttaaactaagtgttattacaaaaaattcaaaaagttaaaaaatatgtttataaagtaaaacacttaacagtaagctagggttaatttattattgaagaaatatgaaacttttataaatttagtgtagcctaagtgtacagtgtttataaagtctacagtagcatacagtaatgtcctaggccttcacattcattaaccactcactcactaactttctcagagcaacttccagtcttgcaagctccattcacggtattaattataacttataagcaaaagactataccatacagcatacgtgtacaataggccataccatctacgtttatctaagtacactctatgatgctcacacaatgatgaaatcacctaacaatgcatttctcagaatgtatccctgtcattacgagatgcatgactatatatcaaaactcatgcaatgcagctaaacagtcttagggagcaaagtacaactttaagttaatatgctaaaaagaaaagacaagactaaaattatcaagacattagaaaagttacaaaaaagtaaaaccaaaaaatgtaaaagctgaaacgtaacaataatactgagcataagggaaatgaaaaacaaaaatgtaaagacagtcaacaaaattaagtgttgctttttttaaatgactaataaagtagaaaaatctctgggaatttttattataaaaaagaagatagaaataaaattaaaaagaaaaaacaaatctatttggacatttaagtgattactgaatactatgaaatactttatgctaatttgacttaaatgttcaagttattttacaagtgaaataatatgaacaattttgtagaaaaatataacttgcctaagaagaactagaaactctgattcgacaattataaagatatcacatatgtggttagaaatttatataaacatacacacacacatgcacgcgtgcacacacacacacacacacacacacattaccaggcccaaatatatttaaatataaaatttaataaacctttaaaaatctgttgaggtctatgtgataaaaattggaccatagaaaacaggaaagcacctcaactcttgtataaggcccttgaacactgatatcaaacccagataaaggtattatgagaaagaaaaattatttacaatggtgaggatttagaagaggtacaagctagccaaaagacactcagaaaaagaaaagtaacaatagctattatttatttagctactactaagtgtttgataagagttttgcatatattatttaatctgtatatcagccatataagtggttttattttcattattatcacaattgtataaataaaatgatgctcaaaaaaaataaatgggctcaaagtcataaaattaataagtagcagcagttgatagagggagactctaaagaccatgtacttaaacactgccttgtactatttactcatctttcttaattatgttcacagaggacattatgctgtctccctaacacttcacccaattttaaataaagcataatttttggtttttagcagctttactatgatgttcccaagtgttgttttcttcacgtttattgtgtttagagttcactaagcttcatgtctttcacaaaatttgggaatttttaacctttcttcttaaagtctttaaatattttctctgtcctattcttgttcttcaataccctacatgagagaacaggaggtccctcagacatatacccccacagcaataaaaattttctagttatcccaaaaaaaaaagtgccctagttgaaactttggggctcaagtagggggttgtgaacactagtgacacccaagacctaagaaggccattttgagagggtagaatcaagcccacatgacagacttgccaatgatggtcccagcttcagacatggaaatagctccaacatcctgtatcaaaaacatcgacaaaggggcctggaagaagtcatgcacactaatgcctcaggtgacagtcatttgtcttggctgaggatcctaaaagggagctcccacttagctccagttcctcttggctgctctctcagagcagtcctgccagcacagggaaaaagaactcaaaataatgattttcaataagtccaatgagatgtagaaaacacaaataaaccacaaaatataattaggaaaataattcattaaaaaattagtttagtttaaatattatattccataaaaaaaggaccaaacagataccctatagctgaaaagtatgaagacagaagtgaaaaattcaatacagggcttcaacagcagactcaatcatacagaaaaagaattgatgaacatgatgacaggtaatttgaaattacccacctagaggaacaacaagaaaaagactgaaaaagcatgatgaaagtatgaggaacctatgggacaataccaagtgtacaaaaatatgaattaggaattcccagagaagacagacagagtaagaggacaaaaactaatataaagaaatactagcagaaaagttcccaaatcctgggaggcatatggacattcagattcaagcagcataaaggcttccaagagagatcccaaacaggaatgctctaagacatattataaccaaattgtcaaaagtgaaagacaaagagagatcttgaaagtagtgaaagaaaagagccttgttccatataagtgaacatccaaaagacaatcagtagatttctcaagaaaaaccttgtaaaccaggagggaatggaataatagattcaaagtgctaaaagaaaaaaaaaaaaaaacctgccaaataaaacagtatatccacaaaagctgtccttcaaaaatgaaggagggataataacataaccagacaaaggaaaactgagggaggtcatcacaagacttagaagaaatgctaaagaaagctcttggagtggaaataaaaggatactagatgataaaataaaattatatgaaagaataaaacttactggtaaaaataaacatatagtcaaaatcagaatactctaatactgaaatggtaatacgcacatcactttttaatagggttatttgtctccttattatttgttattaggtatacttttaaactttttattttaatatttttggaacacagtaagtatatatatttatggggtacatgagatattttgatataggcacataatgcctaataatcacataaaggcaaatggagtatccatcacctcaagcatttatgctttgtgttacaaagaatccaactacactcttttagttattttaaaatatacaattaaattatttttgactagtcaccctgttgggtgatcaaatactagatcttactccttctttctagctatcgttttgtactcattaaccatccccacttccccggctcctactccccagttacccttcccaacctctggtaactgtcattctactctctatctccgtgagctcaattgttttaatttttagctcccagaaatatgtgacaacatgttaagtttgtctttctgtgcctcactgacacacaaaaaagaatgacagaacctcattcttttttaaggctgaatactactccattgcatatatgggccatattttctttatccattcttttgttaatggacacttaggttgctaccaaatcttagctattttaactagtgctgcaataaacatgaaagtgcatatatatcttcaatatactgatttcctttgttttgggtatatacctagcagtcagattgctggaccatatggtagatctgtttttagttttctgaagaacctccaggctgttctccatagtacttatacttatttacatttccgccaacagtgtacaaagattctcttttctccatatcctcaccaccacccattattgcttgtcttttggatgtaagtcattttaacgggagttagatgatatctcattgtagttttgatttgcatttctctgatgatcaatgatgttgagcactttttcatataccagtttgcgatttgtatgtcttcttgtgagaaaagtctattcaaatcttttccccattttttatttggattattggattattttgtatatagttgtctgaactccttatatattctggttgttaatcactgtcagatggacattttgcaaacactttctctcattctgtgggttgtctcttcactttgttgatggtttcctttgctgtgcagaagctttttagtttgatgtgatcccatatgtccatttttgctttggttgcttgtgcttatggggtattaagaaatatttgcccagtcaaatgtcctggaaagtttcctcagtgttttttttttcagtagtgtcatagtttgaggtattagacttaagtctttaattcatgttgatttcatttttgtatataatgagagagaagggtctagtttcagtcttctgcatgtgggtattcagttttcccagcaccatttattgaagagactgccctttccccaatgtatgttcttgccacctgtgttgaaaatgagttcactgtaaacgtatgaatttgcttctgggttctctattctgttccattgctatatacactgttggtatgccagtaccatgctcttttggttactatagccctgtagtataatttgaactcaggtgatattcctagttttgttctttttgctcaggatatctttggctattgtgggtcttttgtggtttcctataaattttataattgtgttttctatttctgtgaagaatgtaattggtattttgatagagattacattgaatctgtagactgccttgggtagtatgggcattttaacaatgttgatccttccaattcatgaacatggaatatctttccatttttttgtgtgtccctttcaatatcttgcaacaatcttttatagtttttattgtagagatctttctcttcttcagttatttcctaggtatttaattttatctgtagctattataaattgaattactttttaaatttctttttcagattattcaccattgacacataaaaatgtcactgacttttgtatgttgactttgtatcctgcaaatttactgaatttattgatcagttctaatagttttctggtgaagtcttcaaatataagatcatctcatctcccaacaaggaaaatttgacttattgctttccagtttggatgagcattatttctttctcttctctaattgtactactatgacttctagttttatgttgaataacagtgatgaaagtgagcatccttgtcatgttccagatcttagggtaaaggctttcagtttttccccactcagcatgatactagctgtgggtctgttgtatgtggcttttattatgttgagatatgttacttcgatatccagttttttgagggttttttttttatcatgaggggatactgaatcttaacaaatgtttttttccagcatcaactgaaataatcatatggttcttgtccttcattctgttgatatgtggtattatattgattgatttgcatgtgttgaataatcattgaggcctgggataaattccacttggtcatgatgatcctaatgtgttgttgaatttgggttactagtatttgcttatggatttttacatcaatgttcatcagggatattggcctgtggttttctttgttttcttttctttttttttttaaatgtgtctttggttttggtattaggatgatactggcctcacagaagatggacacattccctcctcttctatttttcagaatagtttgagtagaattggcattagttctttaaatgtttggtaaaattcagcagtaaagcgatcaggtcccagggtttcctttgctgaaggactttttattacagctaccatctcattacttattactggtctgttcaggtattggaattcatggttcaatcctggtaggttgtatatgtctaggaatttactcatttcttctaggttttccaatttatttacatgtattaatagttgcttatagtagcttctaatggtcttttgaatttctgtagtatcaattgtaaggtaacctttttcaattttgattttatttatttgggtcttctatctttttttctgtcaattttgtttatcttttcaaaatgtctgtcaattttgtttatcttttcaaaaaaccaacttttcatttcactgatcttttgtattattttcttcatttcaactgcatttatttctgcactgatctttattatttatttaattctaccgattttgggtttggtttactcttgcttctctagttctctaagatgcattgttggtttttttattgaaagtttttctactttcttgatgtaggcacttgtcactacaaatttccctcttagttttgatatgttctgtttccattatcatttatttcaaaaaacttttaaaatttccttcataatttcttcattgaccaactgatcactcaggagtacactgtttaatttccatgtgtctgtatagtttccacaattcttcattattaatttctagttttattccatggtgatcagagaagatatttgatattatttcaaatttttgaatattttaaagcttgttttgtagtcttaggtatccttgagaatgatccatatgctgatgacaaaaatgcgtattttgcagccgttggatgaaatgttatgtaaatatgtattaggttcattcagtctatggtgcagattaagtccaatgtttctttgctgattttctgtatggatgatctgttcattgctgaaagtgggatgttgatgtcttcagctattactgtactggggtctatctctctgttaagctctgataatatttgctttatatatctgggtgctccagtgttgggtgtatatttatttacagttgttatatcctcttgctaaactgacccctttataattacatagtgaccttctttatctcttcttgtagtttttgtcttgaaatctgtattgtatgatatcagtatatttcaagtatacttccaaatatgattacagtattataatgttgtttttctatgtacatattacgtacataccagtagtattatgtactatgtaatagtaataatatttttactgttactgcaagttttgtaccttcagatgatttcttattgctcattaacatccctttctttctaattgaagtactccatttagcatttcctgtagaacaggtctgatattgatgaaatccctcagcttttatttgtctgggaaagtctttatttctccctcatgtttgaaggacatttcaccaggtatactattatagggtaagagtttattccttcagcactttaaatatgtcatgctactttttcctgggctgtaaggtttccactgaagagtctgatgccagatgctctgttgtatgttatttgtttcttttctctttctacttttagaatccttttccttatatttgaccttttgggaatttgactattaaatgctttgagatagtcttctttaggttaaatctgcttggtgttctttaaccttcttgtgcttgaataattatatctttctctaggcttgtgaagttctctaataccgtcctcagaacaaactttctacctctacctctctctttacctcacttttaagaccaataactgttgccctgttgagtatcttgtaggcatgcttcattcttttttattctgtccttttgtctcctaaatatgttttcaaacagtccttcttcaagctcactaattctttcttctgtttgatcaattctcccgttaagaggctgctgcattcttcagggtgtcaactgcatttttcacctccagaatttctgtttgattcttaaaaattgtgtcaatctatttgttaaatttgtctgataggattctgaattccttctctatgctatcttgaattttattgagtttcctcaataattctgtctaaaaggtcacgttatctctgtgtttctgagattgatccttggtgccttatttagattgcttgatgaggtcatgtcttcctggatggtcttgatgcttgtggatgtctgttaatgtctacacagtgaagaagtaggtatttattgtagtcttggcagtctggacttgtttgtacccacccttcttggggaagcattctaggtattcaaagggacttgtttattgtgactaaatttttggtcaatgcagctgtgtctacattgggggcactccagggtcagttacactgaggctcttacagactcatagaattaccatattggtggtcttgtacaagatctggaagaattctctggattactaggcagagacttttgttctcttccattactttctcccaaacagagtctctctgtgtgagtgtgcttagctgcctggtgctgggctgggagagacataatacaagttcccctgtggccatcaccactgagactgtgctgggtctgacctgaggccagcacagcactgggtcttgcagaaggcccactataaccactatttggctgctgcctacattcactcaaggccctggggttctacaattatcagttaccaacaccagccacatctgtgtcctttttttcatggcaccgaatgcccccggccccagatggttccagagaggccctctaagatccagggcctggagtaagaaaccttaagaatctacctggtgctccattctactgcagctgagctggcacgcaagccacaagacaagtcttttccacaagcacagaagtctcttctcttggacaccactgccacaggcccatggggagtactaacaagctactgtcaatgttcattcaagacccaaaggttcttcagtcagcttgtggtgaatgctgccaggcctgggactcatccttccatgtggtgagctcccctctagcctagggaaactccccaaatgccattcaagaaccaagtcctggattcaggaaccccaagagcccacttcctgctctacaacactatggccaagctagcatctaagctgcaagacaaagtccccttttctctcccatctgtttttctcaagcagaagtagtctctccctgtagccaccacagctgggaatgttctggatcacacctgaagccagcatgtttcagagtctcactcaatgcccatgacatgtactgcctggatattgctgctgattaggaaaggcccaaaggctctttagtcagcaggtgatgaatcctgccagggctgggtccttctcttcaaggcagcacattcccttctagcccagagtatatctagaaatgttatctggaagctagtgcctaaagtgggtgcttcaagactctacttggtgccctatcctactgtggctgagtgggatccaagttgcaagacaaagtcctgtttactcttcactcctctcctcaagtggaataaaggagtctctttcagagctaccaattgcattgcttggtgtcagaggaggggtggcagaagccctcccttggccaccctgtctggtgtctcactaggtcatatgacccctgcatccactggctccaagcctagcagagcactaggacttgcctaggagttgcagtccttgtggctcagactgccttaaagtttatttaggaccccagagaattttagcccatagtggtgaagtttgttgatacttgagttccaaccactgggatggacaatttctctcttgtaaatcccttttaagcctaatataaaagataaaagacaaaaaatatcaaaaacaactatagctagaatatttgttaatggatacacaatataaaaaggtataaaatgttatatcaataaagtgggggcctgggggaaaagcaagatacagagtttttatatgcaatggaaattaagttgttatcagtttaaatttgatggttgtcattacaaggtgtgttatatatgcctcaaggtgaccacaggaaaaaacctctagtagacacaaaaaatagagacatgaatcaaagcaaaaattgaataaaatacaaaagaagacagcaagattggaagaaagaaacaaaagaactacaaaacaggccaggcatggtggctcatgcctgtaatcccagcactttgggaggccaaggggagtgaatcatgaggtcaggagttcgagaccatcctggccaagttcgtgaaaccccgtctctactaaaaatacaaaattagccgggtgcggtggcaggtacctgcaatcccagctactcgggaggctgaggcaggagaatcacttgaacccgggaggcagagtttgcagtgagccaagattgtaccactgcactctagcctgggtgacagagcaagactccatctcaaaaaaaaaaaagaactacaaaacagtcagtaaacaattaacaaatggcaatagtaagtccttatttgtcaataattactttaaatgtaaatggattaaattctccaatcaaaatacaaagagtggctcaacagaaaacaaatatgtaaaatccaacaatatgctgcctataagaggctcactttagctgaaaggatacagagccaaaaagtgaagacatgagaaaagatattccattcaaatgataaccaaaagagaataggagtggttatagttatatcagacaaaatagactatcagtcaaaatctatcagaagacacaaagaaggtcattaaatgataataaagtggtcaattcattaagaggatataaaaaattgcacatatacatgcactcaacattagagaatctaaatatataaattaaatgttaacagaacagaagggaaaaatagacaccagtataataatagtaaaagatttcaatattccactttcaaaaatggatagatcatatagacagcaaatcaccagggaaacagtggtctttaaaagtactacagaccaaatagacctacagacatatatagaacattctatccaacagcagtagaatatacatttttctcaagtgcacatggaacagtctccaaatagatcagatgttgggccacagaacaaatcttaacaaatttagaaaaaactaaaattatctcaagtatcttttctgactacattataaaattagaaatcaatcaaaggagaaattaaaaatgaaaaaataaaagtggaaaaatcacaaacatgtggcaattaaataatacacttcttaacagccaatgtgtaaaagaagaaatcaaaaccaaaatcttgcatatctttaaacaaatgaaaatgggcacacaacaagagggaaggacataacaatgaatgcctacattaataaaagaagaaaaatctcaaacaacttaacttcacacctcaaaaaattaaaaaaagaacaaagtgcacaaagtcagcagtaataaggatatattaaaaattagaccagaaataaatgaaatagaaaatagaaaaataatagaaaagatcagtaaacctaagagttcgttttttgaagacagataaatctttagctagattacccaaggaaaaaaagaaagaagactcgaatttaaaattttgtaatggaaaatggacaattaaaatgatagaacagaaacacacaggattataaaaagactacattaaacaattacattccaacagattagataacttagtaaaaaataagttcctagaaacatataagatgcaaagactgcatcataaataataaaattcggaacagattaatagcaagtaaggagattgaatcagtaataaaaaattctcccatcaaagaaaagcccaggactagatgtcttttattttttgagacaaagtcttgctctgtcacccaggctgcagtgcaatggtgtgaccttggctcactgcaacctccatctcctgagttcaagtgattctcctgcttcagcttcccaagtagctgggattacaggcacccaccactacacccagctagtttttgtatttttagtagagatggggtttcactgtgttggccaggctggtctcaacctccagaattcaagtgatctgcatgtctcagcctcccaaattgctgggattacaggtgtgagccaccgtgcctggcaaaagaactagatgtcttgatgagcggattctaccaagctttaaaaaattaatgcccatccctctcaaacagttccaaaatgtttacaagaatgacacacttcctaactcatttcaaggccagcattgccctcataccaaagctggataagagtgctttatggatatacaccatcagcaagctatcgcaaggacaaaaaaccaaacaccgcatgtcctcactcataggtgggaattgaacaatgagaacacttggacacaggaaggggaacatcacacaccagagcctgttttggggtggggggaggggggagggatagcattaggagatatacctaatgtaaatgatgagttaatgggtgcagcacaccaacatggcacatgcatgcatatgtaacaaacctgcacgttgtgcacatgtaccctagaacttaaagtataataaatatacacatatatatatataaagagtgctacaagaaaagaaaattacagagcaatatcttagatgaatatagatacaaaagtcttcaacaaagtaccaccaaaccaaattcaacagcacattaaaaggatcatacaccatgatcaggtgggatttatctctgggatgcaaggatggttcaacatacacaaatcaataaatgtgatacatcacattaacacaatgaaggataacagtgcgggaaaagcacctgacaaaaatcaatgctttcttgataaaaagcctcaacaaatttggtacagaaggaacgtacctcaacataataaagatcaaatatggcaatcccatagaaaacatcatactcagtggtgaaaagctgaaagcatttcctctaagattaggaatgaaaaagcatactcactctcactatttctattaaacatagtattggaattcttagccagagcaattaggcaagaaaaaaattggaaaggaagaagttaaatggtctctgtttatagatgacataatcttatatgtagaaaaaccctgaagactgcagcaaaaaaagaaaaaaaaacctgttgaaacgatatatgaacccaatagtttcaggatacaatgtaacatacaaaaattagttgcagttccctacattaataaagaactctctaagaaattaagaaaaagatccatcttagtctgtgggcattgcttattacctaaggctgggtaatttataaagagaaaaagtttttttggctcatggcttttccggatgtacaagaagcatggcaccagctcctggtgagagctcaggctgcttccactcatggcagaaggtaaagtgaagccagtgtgtggagattacaaggcaagagagaaagaagagagagctgccaggctctttataacaatcggctctcatgggaaccaatagagaaagaaatcactcaatacatcaagacatcaagaaggacatcaaaccacttatgaggaaactacccccacgatcaaacacctctcattaggcctgatagctaacattgggatcaaatttcaacatgaggtttgtggggacagatatccaaattataaaacgattccacttacaatagtatcaaatacaataacatactaagaaataaatttaaccaagttgatgaagaattggtacactgaaaactcttagacactgatgaaagaaactgaagacaaaaacaagtgtaaaaatattgcacgttcgtgaattgaaagaattgctatttttaaaatgcccatgctacctaaagcattttcagattcaatgcaatctatcaatattataatgatattttttacagaaatagacaaaacaatcctgaaatttgtttggaaccacaaaagatcacagatagccatagcaatcttgaaaaggaacaaagctggaggcatcacactctgtgatttcaatttgtcttacgaagctacagtaatcaaaatagtttggtaccagcataaaaacagacacttaggtcaatggaatagaattgagagcccagaaataaatgcacacttgtatggttaactaatctttggcaagggcaccaactatacacaataaggaaaggaaattctcttcaataagtggttttggggaaactggatactcaaatgcaaaagaataagactggatccttgtcttgcactgtacacaaaaattaactcaaaatgaattaaagatttaaatttttaatttaaaaatgtaagatccaaaactgtaaaacaaagctccttgacattggtcttggcaaagagtttttggatattgacacgaaaagcacaggtaacaaaagcaaaaataaaaaaaagtagaactacaccaaactaaaaacctttttcacagcaaaggaaacaaaaactgagaaggcaacctactgaatgggagaaaacatttgcaactatatatctgatgaagggttgatattcagaatgtatgtagaactcacacaactcaatggcaaaaaaaaataataacaataactcaatttaaaaataggaaaaaggcctgaatagacatttttccaaagaaggcatacaaatgggcaagaagtatattaaaaagtgctcaacatcaataatcatcagggaaatgcacatcaaaactacagtgagatatcacctcatgcctgtcagaagggctaagagataaatatctgcaagaatgtggagaaacgaaaacacttgtccactgtaggtgggaatgtaaattggtatagccattatggaaaacagtatggagtttcctaaaaaaatttaaaatagaataattatatgatccagcaagcccacttctgggtttatatccaaaggaaatgaaatcagtatctttaagagatatctgtaccctcataattattgcagcattattcataatacccaaaagatggaaactacctaagtatccatcaatgggtaaagcggataaatgaataaagaaaatgtggtacatatacacaatgaaatattattttgccataaaaataatcaaacctgtcattttcaacaacatgaatgaatctgtaagacattatactaagtaaaataagcaagatatagaaagacaaatagtctgtgatctcacttacatgaaatcttataaaaaggtgaatctcattgcaacagaaagactgatgattgccaggggatggtggtggagaaaataaggagatgttgattaaagggtacaacatttcagttataagttgaacaagttccagggatctaatgtacagaatgggtggtgaagaatgtgtgaattaacttgattgtgataatcactgagaaatgtatgcataaaacaatcacaatgcacactttcactatatacaatctttgtcaattaaatatttttaaataaaaaataaataaaattgtacttccggtttttgagatactgcttattttttatccactcttttttctcactcctttttagattagataatttctattgatctatctttaagttcaatgacttttccttcaacccctcctccattatactgttaatcctactaatttatttatttaatataatacatttctctgttttaaaattcccatttggttcttctttttttttttttttttttttttagatgaagtcttgctctgtcgccaggatggagtgcagtggcgcaatctcggctcactgcaacctctgcctcctgggttcaagcaattctcctgcctcagcctccctagtagctggaattacaggcacatgccaccacacccagctaatttttgtatttttagtagagatggggtttcaccacgttagccaggatggtctcgatctcttgaccctgtgatccgccccctcagcctcccaaagtgctgagattacaggtgtgagccaccgcacctggccaatttggttcttttaataatttcttatttctctgctgagatttcctatctttttgttcatttcaaccatattccctttcatctcttaaagcgcagttttaatacctgctttaatttttttgcctagtaattccaacatgtgggtgattttaagattgtcatctgttgattttctttatccttaagaaagggtaacattttactgggttgaagtaattatggggtttttatttgtttggttgtttgtttttgttttgttttgtcttgagacggagtcttgctctgttgccaggctggagtgcagtggcacgatcttggttcactgcaacctctgcctcctgggttcacacaattctcctgcctcagcctcccgagcagctgggactacaggcgcccgccaccacacctggctaaatttttgtatttttagtagagacggggtttcaccatgttagccaggatgatctcaatctcccgacctcgtgatctgcccaccttggcctcccaaagtgctgggattacaggtgtgagccactgtgcctggccaattatgggttttaacttagacatcgtcaatgttaattgtggatactccagacttggagtccttaacttggacaatgtgttacattgagccaaagagtgctaatatctttgttctcatgggacattaatttggctaatctcatattgaaaaatttgtgctttttggatctcagtgtggactgatttcagtctgccctgtgcatgtgcagttcaggggtcagacaaagacttaagacagaatttatacacacaatatcccatctctgtctctttactttcctatgtttttcctcattctctgacatccccgttccttcccagagttcctacagcctacagagaaagcaagggctttctcttggagttaaattgtcccatgttgccactgcaattggagatgccctcagaaaaagcctcagaaatgtgaaactcacttcatctcatgacatttgcttaatacaaagtttgaacctcctctaatatttctctagtcttatccattctccaaaacctttacagagttgtattgtgttttgttatgctttgcttttatttttggtttttgtccagagtttatagctactatctgcaggctggttgtttttttggaagtttatttctccacacaagaagcaaaactcttgtattattactaatcctgagaacagaaggttacagagaaacagaaaacagaaggctttaaaaaagtaccaagagatacaaataaaaattgaataaaaaacaaacaaacaaaaaactagaaaaatgtctcctgcttctaggagagggctgaacaaaggcagatgaagaggcaataaagtaggtaataagtacatttacagaaatatatgccatcaaataggtaagaatgcaagtaaaatttatatataacaaatacccaaaagttttggaagcagaaaaaatgttagtcaatagttcatattgtctaacaatcaatctgtcacccaggctttgtcacccaggctggaatgcagtgacgtgatcatagctcactgaaatttcaaacactatcctcctgagtagctgggactacaggcatacaccaccacatctggctaattttctattttattttttgtagacatacggtctcactatgttgcccagactggtcttgaacttctgggggctcaatcaatcctccctgcttggcctcccaaagtgctgggattatagtgtgaaaggaaaataaatcttggggcccaaaatcactaagctaaagggaaaagtcaagctggggactgcttagggcaaacctgcttcccattctattcaaagtcatccctctgctcactaagataaatgcatatctcattgcctctttgtcaaggctaatcagaaactcaagaatgcaaccatttgtttctaatctaccaatggcctggaagccccctcccactttgagttgtcctgcttttgcttcaagttgtcctgcccttacgaaccgaaccaatgttcatcttacatatgttgattgatgtctcatgcctccctaaaatgtataaaaccaagttatgctccgactgtcttgggcacatgttatcaaaacctcctgagactgtgtcatgggcatgtgtccttaacgttgacaaaataaacttcctaaattgactgagacctgtctcagattttttagtttcacaacaggcatgagccaccatacctggcctcaaaagtttcaaaaccaacactcttcatcagatcccagaaccaaagaaggaaaaaacaattgaagaatttatgtccacagttatgccaagatttacactaatgcataccacatctcaaagattgaagaactctctcaagaactggcaataattaagtttccaaccaaattatattttctaaattaaaaataagcacacatccaagtgtaaaatttaaaaaaacctgaagctaaagcacattcaccttatagataaaaatatagtccatacctctctattttataaatgcattttcagacttgatgcattataggacatggtaacttcaaacagcaaggaaaaaactcttatttaaaactcagtaagaatataatctctgtaagaaaattatcattttaaataatttcattaaactgttttctcctttgatatacccctggatgtaacactattaggttatagtgaaaaacaccctcaattaactctcaaaaagtatggttccaccattaagctactatgagactttggacaggtcccttcacctatctaggcttcagtttactcatgtgaaatgtgaggctagaacatatggtttctgctttccaggtgtaaaattctataactacataactttatcccttcgtttcatgcagttttatctccgtcttccacttctgtgtcttcctggctggagtagctttatctgtcgtctgaggcatccggggcacaccccatcatttcaggcttagccgtttctaagtcgaaggctgcagtcactgagggcagcctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggaaagattcttgtttaatttctaaaaaataaatttggcaaattcctcagatctcaggcccaaagaaaatatttcaggagagatacattatgcctttcacgcaagtgcaaaaaaattaaaaatgtagactcccacacacaatctcaagcaaatcatcaactgacatctgatgttgtcttacctacagagttaagaagcttgtttacatctgtacttcaggtgagtgagataattttgtgaatggtaggttaaaagtaatttcaaatttgagaattaagcaatgagaaatgtgctgtaaatttcaagaaaaagatgctgcaatactgtttaggattctgagaactttagatctatcttcttataaaaacttccacttagaaacaaagaaataaacaaaaaccaggataaacaatacaatgctctttccaacttgctggaattacattcactcagataaacatttattaagcacttagttggtacaaggtgtactgtcctctgtgagacacacactcatagaaaagaattttgtatctgctttagtgagtttataatatgccagaataaatacatactaaaaggcatatatacataaataatataatgcattgcaggaagaggtaagtactatgatagagggacacagaaagtcctgtgcctcaggccttgctccctgcagggcactaagctatttcgaatcacactgcaggaggtggccaactacacagtatgcagtgcatcagtgctatccagggaagaaaagactactacatggttaagagagcctgaaaaaacagaagcagagaggtggacctagaaaactagcagtcggttgaaggtcaatatgttcctacctggaaaatagggtccaactactgggcagaaggccaggacccaagggtgattctgtgcaactgggggaggtgagaaaggagagaaaggaagtgagtattctgctgtgggaagaagggaattccaagatgacaacacagcaagagcttaactatagatgaaggaattctgaatttcttctagtttcccatctcatgatcatgtcaatataaaaggaaattactataaaatgtaataatttctaccagtctacagattctggcaggctaaattaaacctgaagataaggacaaaattacattccagttcctacttacaacttctatcacataaagaggtacttacatagttcatatgtgcaaactgagttgcatgctttctaaatcgttttatttaattgtgaaatgtttggaattgggtgtcactggtcttcattttgttttgaaaaggcaatataagtgaattaatctatcatcaggctaataacaagaataagtattttaactccttcctttgaaatgaaaagacaaattctttagccaagagcttccaagtttaatttacgattcacaaaattctacaaacataaattatatagtagaagtttcccttattcttacttgaatataactctaatcatttgaatatcagttttaacaaaatgaataagagtacaacagagttcagatgaagctcgtttcttgccaaaatccatatgaatgccaaataccttccaagcacaaataaatcctgccttccatttaaacaaacaaacaaacaaacaacaaacaaaacaccacattgcctaagattgggcaatcactactaagtgactactaagtagtgagtaagagctaagggaaacggagcgaactttaggtcaccagggcacggtacactgaaaaacatgtgctgcgcttcttcagaaacaagctacaacagcagaaagacgaggtaccttatatcttgtttataaatcttactttataaaggagaaaaaaatgaaaaaagggaaataatattcccttatatcctattttgtgctaggcacttagacaatgttttattatttaattgaaacttgagttcaatcggtagcaggagcggcgagcggaacccagagagccctgagcagccccaccaccgcccccggcctagttacagtcaccccagaaggagccacaaccctgcagccagcaggtcaccatcacagcaaccacaaccctgagcaaagacgccaaggcagccaaccccaagccggcaccacctgcagcggcgcagggagcagtggcaagggcgacctcacaggcggcgcctgctgatggggataagatcaccgcaaggaagattttgggaacagtaaaatggttcaatgtaagaaataaatggtttcatctatgcgaatggcaccaaggaagatgcagttgtacagcagaataccatacagaagagtaaccccaggaagtaccttagcagtgtaggacacggagagactgtggagtttgatgatgttgcagcagaaaagggtggggaggcagtaaatgttacaggcccctgtagagtccagttgatagcagtaagtatgcagctgaccttaaccatcattgacgctatccatgtggtcctcaggcaattaccagtagaattaccagaatagtgagagtggagaaaagaacgaaggacgggagagtgctcccttaggctcggcccaacaatgccggccctgctgcaggcgaaggttcctgccttactacaggcagagaccctacggaaattgaccaccatattctaaccctccttgcagggagcagcgacggagggtgctaacaactggggtgcaggagcacaaggtaggccagtgaggcaggatatttgtatggtttatagaccacgattcctcagggaacctcatcgccaaagccagcctagagaggacggcagtgaagagagtaaagaaaatcaagatgagacccaatatcagcagcgacctcaacatcggtgctgctaaaaccccaattatctatgtagactcccagaaaaccctaaaccacaacatggcaaagagacaacagcagccagtccaccagtcaagaattctgcacccgaggcagaagaaggttgagtaaatgccggtttaccatctccaccatcatccagtttaatcatccaacaagaagaaatgaatatgaaattacagcaatgagaaatgcaggaaagaaatgctgaagaccttaagtgcttgctttttgcccattgatcagaaaccagaactacctgcattatctacgaagcatggggtttttaaaattatttttacctacagacatgtctttttggtaataacaaaggtttttattgttgttgtttttgtgtgttttttttttagtttggtttttctcaacatgcctttaaaagcttttaaattggttcatatgtcaagttgagatttttaagcacttcacttttaatttgtaataaaagtttacaacttgattttttcaaaaatgtcaaccaactgcaagcacccattgaaagtcttaaataatacaaaaactttaaattaaatcaaatgggtattaacaccatataatacaaaaaagaagtgaggttcgaaaatccttatgcttttgtgatgccacacgtcacctaactggtagcacaacttgattgcaatctgactctgaagcttttcttcattcctagacatcctatttttgttgaagtcctagattttaaaagtataatttttttaggaataaagatctggtaggcaggaaattctgctgaagctgtttctgggcaacttgactttgccagggcctttgcactgattgtgttaatggccacctcctcttcagatgtagggttatggatcacctgtaaccacctgtaacctgtacagcaagctgaaggagtgtttgcctaatatccaatccacagaatttatttcaaaaatggtgagcctcactaaggtgatagcagtagcctgtccacaggctgatcaacaaaatcttgtctttgatccatggtttctgcttcttggagtctcccaaggtacattctgccactgctggacctagaatcatagtctcctttcctaccagccttctcaccctgccaaacttatcatatacaattgtttgacatcacagatattatcaatccctaggcctctctagctttctgctcttgcaatttcttttacattgtctttgtcacccagcacagagcccatacataagtcatcactctattttcttagaaatactttcagttcacttcttggttttcctatctcacttaccaagctgtcttagtacagatctaagatgagaattttagtacaaataatttattttggaaacaaccccatgaaacactggtaagggagaaaggatggaaggcagaaaagggaaataagatagaatgtttgcaaagataaccatcaatagttcctcaaagccttgctctagcatgctgctcttcccatcaagaggcagagtttgtttcccccactcttgaatctgcactgaccttgcaccctttttttgaacaatagattgcagcagaagtgatgctatgctagttctaagccaaggctgcaagagtcctggcagcctcttcttttgctttccttagatgcagataccatgtaaagacgctcagactagattagtgaatgatgagaagcaatggggagagacaggcccagacagaccccagccattctatacattgcactgaggcctaaaacccataagtaaagccatcatagtcattcctgacccagacaggcttccagtcaagtgcaactacatgagtgacccaagctattactaatctaagcctgggcaccccaaagatttgtaaaaaataacaaatctttgttgttttaagtccctgtatttgggggtagtttgttacacagccataaatgaaacagggacaaagccaaaaaagggtacaattattaaacaagttactgctatgggaaatgagtttagtccttctgggatactctggaaaacagtaaagaacatgcctcacagttatcccatgtgaagggtaaggatgatagtgtaatccacccacttgctaacagttatttgcttaagtctttttctagtgacagtaactatttggtactttaagcctgcccaacactgtgagccaaatctgctcagcagccacacacaaaaaatgccttcaggcagacagtcacagtatcaggaataagcagtcttctgtgacaagaggtgagtggtggaaggaaacaggaagagcgtcaacataggtgaaaacccaggcctagagcagtccagctatctgctttctccactcctagaactgcaacagctaaagtgggtcacatacactcacagattataaccactacacatctacagctcccaaacttagctgggtcccaaatgttacttaataatccttccaagtttccctaatcatctgtttactttagtatattttacatctatttcaaaacttcccacttttattaaatcttctattccacctacccctcccccttcggtatcagcaaagcaatatgctctctatcccaatgagaaaataaaggtcatcagatcaattttttgctacctccattgcactgcattcagaatcatccttccttccttccctactaataccacaggaaagggtcaaggtaaatgcagcattaatccagcacctctccatctctggaataccccaccttagaatacaagaacccattatgtacttgcccttttctgtctctcttaggtccctaatgcatgaatctcatcgagttatagatctgttgaaaccctacacctatggatctttgcaccaagcattgttcctactgcctaaaatgtaccttccccaactttccccatttctagactctgccctggcagagtcctcttcatcttttagacctccacttacctgcgacctcttcaggaaagccttctttactttgctgcccacgattcctcaaatctatgcttacctctgccacagcactttgctcttttctgaaatcgctcattcctttttctgatatccttttcctcctcctttacctcccactgaaaataagctcctccaaatcaggtatttgccttatatatttttgaaccatagtatctgtgcctagaacatagctgtggattaacaaatagcaccaaatttaaataaattaattaatcatctcttttccttaagttactttccagagtaactttagtggaagctgcaggcaagatttatgtgtactgtggcccttcctctttctatctttttttttctttttaacattctaagaggtatcatacaggtcatgataaactgagtctcttctaaatttgcatatagtgaaaaataacacgtcaaaatgcatttgcttagaagctcaggaatccattgttcagttaaaacttgttgccttgttataatgttatgacaaaataggcttccatactggcttttaacatataattgttaattatcatcacaaaagtttcaaaatttcttcagttttaaaaagattttcataagtaaaaatgcatacagtacttgtatactcacagtgagcttatttaataatatgtttgtagaatgtaaaatagctttctgttttatggtcagatttgataggcctatcaaaattggtttttatagatatgattgctactttcatcaaaaaatgaaccatcaactttaagagaaatgaaaaaatcaatttgggtcatggtaacttctaagccctactacctagtcctagaatttgttcttaatagaccagactgtctgcaaaatactttgaaacaaagaatgtgtactttgcctcctccctaccatgttcttggcaactagggaatatgggacattttaagtctttaagataaaattaatcacactgatttagaacaactaaaatcttgtcagagtaattcctaccttctcccttccccaccatgttacctttaggaagaggagacacacttgaggaagctcttcaaggctggtcttcagggaaataaagacattgaaattccactccaattattttttattacctgccaccttgaatccagaatatatgttacattatgaagtgtcgtattcttgactcaaaacatccttccaattaagattttcttttttaaaaaaaattaggttaaagcaaaaatgcagaaaagaagggtaaataagattagtaaaccatctgaaaattactgcattttgtaaactttggtaaaatgtatgaagaagcatgttttccagtctgctttctcggcctgtggatacctgggacataattcagtttgccatcccctgttcccagatcagctcagtctttgttcagctccatcttcaatctggcatataattacttcttcagctcctgtgctatttggttttaagcacctcttacccccaaggcctcatggctctaagggcttgttgaatttaaacaagcacatttaaatctttgtctttaaatgagtaaaataaaagtcttaacacctaacacagagtactcttctacactctaaatgtgcatgttataattgcctaccagatcataatgagcatctatccatcctcaaaatcagagaaaggggggctcattctagaggtaaatttacaataaatggctttattcttgattagctatgtgtgtttggggacacagagactggcacctgcataatttaaatacctgataggaatcagatgatcaggacaccttggaaataaaggtggaaaaacaatagtggaggaaacacaataatggaggaaatacagaagaaaaaaaacaagattgttaaaagaaattaataaaatacaacttaaggaattttaagcttcacctctcattggaaaaacactgcaaactcatacacacactgatgcatgcacacatgcatgcacgcacacatgcatgcgcacacacacgtatgcaatataattacagaaatgttaaaactgtctgtctttcctgagagtcaggagatgtggattctgccactactgctgctggcaaatcataaataccatccagggttttagtttagcctgagtaaatgagtaatcattacatttgttccacatacatactttactccaaacactggtagataagtattgaatgagaccctcattcaaatacacggtcaaaaatgccacaaaaagaagtattataattataactattaattataagtaaagttttttaatgaatggataaattagtaaaacaaattttaatagatataaatggaaaacaaagcatgtgcaatctcactagtgatgaaggtaatagaaattttaaaagtgagatactagtctttcacctatcagatcagttaaagtcaataaaagaaaaattcagtgttggaagaggcactgcagtgggagtgtacattagtaccattaagcactatgtatcaagggcctgaatcatgattatgtactgtgccagtttgggtcctcttgtgccaaggtgaattgggtatgtgagataattatttggggtagaatctatacatgataaaggggaagaggtgtaggtaaggagagcactcagactatgatgcaattctgacatctctgaaaggagaaaggcaaggaagcatttggtaggaagagatctgcatgcaggaaagtcctgagaaagtctcagccagggttggttccaagtctttgttattgtgaatagcgctgcaataaacgtatgtgtgcatgtgtctttatagcagaaggatttataatcctttgggtatatagccagtaatgggattgctgggtcaaatggtagttctggttctagatccttgaggaatcgccacactgtcttctacaatggttgaactaatttacactcccactaacagtgtaaaagcgttcttatttctccacatcctctccagcatctgttgttttctgactttttaatggtcgccattctaactggcttgagatggtttctcactgtggttttggtttgcatttctctaataaccagtgatgacgagctttttttcatatgtttgttggtgacataaatgtcttcttcttcttcttcttttttttttttagatggagtctcgctctgttgcccatgctggagtgccggggcgcaatctcggctcactgcaacctccggctcccgcgttcaagtgattctcctccctcagcttcccaagtagctgggactacaggcgcatcctaccacatcctgttaattttttgtatttttattagagacagagtttcaccatgttagccaggatggtctggacctcctgacctcgtgatcagcctgcgttggcctcccaaagtgctggaattacaggagtgagccactgcggccagccgtaaatgtcttcctttgagcagtgtctgttcatatccttcagccacgttttgatagggttgtttgttttcttcttgtaaatttgtttaagttcctggccgggcacggtggctcacgcctgtaatcccagaactttgggaggctgaggcgggtggatcacaaggtcaggagatcaagaccagcctggctaacacggtgaagccccatgtctactaaaaacacaaaaaaattggccggccgtggtggtgggcgcctgtagtctgggactacttgggaggctgaggcaggagaatggcgtggaggcaggagaatggcgtgaacccaggaggcggagcttgcagtgagccgagaacgtgccactacactccagcctgggcaacagagtgagactccatctcaaaaaaaataaaaataaaataaaatatttaagttccttatagattctggatattagccctttgtcagatggatagatggcaaaaattttctcccattctgtaagtcgcctgttcactctgatgataatttcttttgctgtgcagaaactctttagtttaattagatcccatttgtcattttggcttttgttgccattgcttttggtgttttagtcatgaagtctttgcccatgcctatgtcctgaatggtatcacctaggttttcttctagggtttttatggttttaggtcttacgtctaagtctttaatgcccatcaatgatagactggataaagaaaatgtgccacatatacaccatggaatactatgcagccataaaaaggatgagttcatctcctttgcagggacatggatgaagctggaaaccatcattctcagtgaactaacacaggaacagaaaaccaaacaccgcatgttcgcactcataagtgggagctgaacaatgagaacacatggacacagggaggggaacatcacacattggggcctgtcgggtggtggggaagtaggggagggatagcattaggagaaatacctaatgtagatgacaggttgatgggtgcagcaaaccaccatggcacatgtatacctatgtaacaaacctgcaaattctgcacacatatcccagaacttaaaagtataataaaaaaaaaattctagaaaaagaagttgcatctgtactgaacatgtacagagttttttccttctcattattccttaaaccatacaaaaaagaaagtctcagccatgttggtagggagtccctgaaccagagttacccattagaagaatctagtattgggcagaaatgtccccgttctggtattcctgacatgttcagtcactcggtggaagcagccccaaagaaggatggtttcagggtgaatgttgtggtggatccacaggtatagcagctggaggctgtcaattatctatgctctctacaaaagctcctcttgaaaacagagctgagaaagacacttgtatacatatgattttattcccgttctaggaatctatctcaaggaagcaatctaaataccaaaataataatgataaagagctttatgaacaaagatgctcatcgcagtcttttaaaaaataattgaaaggatagaaacaatttaaatgtccaagcataaggattgattaagcagctatagtatgtctactttaccaaaaatgctgtggctattacaatggaaaacttatattttaagtaaaattgaaaatagagataaaatatggtataacttttaaaattaaaagctttgaaaagatacatattttaagactggcagaaaataaaccaatatggtagtaataggaagtttttttgcatttttgaattttccaaattttctttattaaaatttatgacctttagctgagggaaggaagcattcaaaataaaaaggcaaaaaagcaaaatagttaaaatgatttagagtcgaagtaagcaggggaaatatgaagctatagaagagaaaacaaagaagacaataaaaatatctgaagaatactgtcttaataattctgggactaggtgtggtggctcactcctacaataccagcactttgggaggcccagccaggaggattactcgatgagcccagagttcaaggctgtagtgagtgattattgtgccgctgcactccaggctgggtgacacaccaagacccagtctctaaaaacaaattctggaaaacagcttcatggctccaacataacattgaacaaagccaaagatgggaaaggaaaagggaatgtttttattttcattgtagcattgggtttttaaatgaaaactgatgtttcatatgctcttctatgactattcagtataggtgtttcaccatcattgtaaggagtatcttctgtgtatgtaagtatgtgttcactagtgcattcattttttcaacatgtgattaaacagtttgagagtcaccatatgccaggtactgtgcaagcaaatcaaaggtcacagtgtaaaatgagaaagggtatgttttggccctctattctagaattgtttatagaaagtgcataatttaagcccatatgtcccatgtcctaaagatacctgtccattaaatacagtgcatttcattgccttttcagactctcttcactatgcacataagtgacaatgtaattgcaatttgattaattcatataaactaagaaaggaggaattattcattcatttctgatttttttttttttggaaagtatcccattcctactatagtttgccaaaccctctcagggtagacctctatttacttaaaagaactagtttcatagattgctgtcatgcaccctaattagacaaacgtgttttccaggtctatttgaaggacattctgatataatgcatacctatcttcttaatcttcttattcagcttatgcatatttcttttcctttaaaatccatcaataaatgatctgtgatctgtaagtaattaatttaatgattacatgaattaaaataatgcacattgctttaaaggagttagtattttcggtttatgttacaatattggccttgggtaaatatcatccattgcctgaatttcataatggttcaaggataaaccatttcctctttataattcagtaagtttgttccaaaggagcctattgctcctctactcaacaatgaaagaaatgcattcagggaccttaggttgcctattcttaataagatggaatcctttcccggtttgttaaattcactgaatttataactcattgttactgatgaaggaattaatccaagcccgttaccagattgatctcctaaaatccacagagcgaatttggtgtcatttttaaaaagaaataaaataacaaaaataaaaatacaaaggatgtcagtaagttacagacaggagggcatacctcatatttatcacctggaaaactagagaaaagtttcatcaaaactgtttcatgcatctgtgcagggctaaagtcatctgctaatcagcactaataatgatggggataacaataataatctgctacctttacataacagtttttaccttgggaaaagattttcacatactactcttcatttagttcttataatgactttgagaaactaacataaatgttttacaagtcccattttgtgaaagagaaaattagagtacaaagaagagactgacccaacaataacatttaactggagctagactcctacttcaggtttttaaaatgctttcaaatcaatagaattcatgatttgcaatgttttcctaaattctgttaaaacacacttaggaccgtaaattttcaccaaccataacagacacctggtaagcgggcatgtaataaacaattgagatgttagaaaaaaagatatgtctctgatgagcagggcaaaagtgaatgtaagtcaaaagatatctaaagactctatagcttctggaataataaattggtagttttctttatttttcatttgttgtttcagaaagtgtttaacttttgatactaccaccaatgtaaaatataatagattgttagtaacaataaatcaatctctacgttgtccaaataggtgtgtttacccaggtccacactgttcaagttttattaaaactgtttcgttttatccaggtttccagtattgcatctcctaagacaaacactgatatttatctgctgatgcttgttttactaaccaaatattacattacacatggtttatcacattacccagggaggtgacaatatttcaggaaaaaaattaacaaatcaaaataactttgaaaactgtttataccccatgtacaaaagtactgtctatgcctagttattcactactatcacaagatatacataaatcagagtttttaaataatactgacttccccttataaattcctttaccccttgtgaaaggaacctagcaccattatgacacagttaagcattagtcacagtttaataaataatttcgttatagcctcctagtctatcagtattatttggattctcagaatgcatgtaatcatgtaaattacaaaatttcctttgtatcagggataaccaactgtcttttataaataatgttatttttggtgatttttcaatatcagaacagtatagttttggctagagaaattactataagcattcaaataaagattaatcaatttatacaaggcaaataaactttttgtactcttaaatacttaaagaataatatatacattcaaatatttgtaagaaattcatatagaggggagtataaaacacatatggaaaaggaggtatgtctgcagaagttactttgtaaagaaacatagtgctcaactaccaccctccctcaaatatcatgtcaatcaaattagcatcataagaagaactccagttctactgtgatagagtagcttatatcaaatcaccccctcgttgagaaaaactattaaagatgaataaaatgaaattattttaaaaactgtttgaaggcaccaggcaccaaccaaagtaatttcaatttaaaactcaatagtctataaaggaagtaaacacgttaaagtaagccctatgttgtttattacttttcaaattcaaggcatttgctgtttcctaagtagaacagaatgcgagactgagcacaaagctccagattagaacattaagaagtcttgtaaagagaggagggcacaaataacactttggagctgtcagcacagccaagacatgaagaatcaagatcctggataaactgtaaatgcaatgaggtgaggcctgtattctttttccacttttaacccctaaaacatttccagttcctctttcttggagtgagaaaatcaaaagagaaacaagcagaaaacagcaacctaaatactaggacattaaaaagaatattcagtagtcttataccaacgaagcaaaaactggagtttagtgactacttgaaaagcactccaaaattttatttgaacctctaaatgactatttataaaactaagggaaaaccataactagagtagccatcacaaagatggaaacccaacttcaaattgtcttaatccctgataagattaagtaaattacctttattctaataatctgtgaggagaaaattaaatccccatggaaaaatataataccatacaaaacactctaaatttttaatatgaaaaaatcatcaagcatgctaggaagtagaatcaaagaaccaaaacaaagagaaaaaataatagacaaaaacataaattcaaaaatgatacagattaaagaattatcagatatagtcttttaaaaacagtgataaatatggtttcagaggtaaaggaaaagagtgagaataatcagagaactgggatttatattaaaaacccaaagattattctagaactaaaaataaaacaaaattaataactcaatcgcagccagttagacacaacagaagatccaagttgtgaacttgaaaataggttaatagaaaatatccagaataaaacaaagagagaaataaggatgataataaaagaagaagcattagagatatatagaacatggttaaaaaatgttttaacatacaaatatctctagtcccagaaggaaagggtaaggagaataggcagaagcaaaattcaaagcaataatggccaagaattttccaaaattggcaaaagcatcaagccacaaattcaagaatgtctaagaaccccaagcaggataaacacaaagaaaccaactacaaaaaaaaaaaaaaagcctgtttgtaaaactatttaaaaataaacaataatcaaaaaggcaatctcaaaatagccagaaaaataaaaatgcattactttgtaaggattagtaagtctgataactgattgctcatgaaaaacaattgaagccagagaacaaagccatgatatctttaaaatgcttttaaaaagtaactaccaacctaagaaacccaaacaacagcaaaaaactaaataacctgattaaaaaatgagtaaaagatctgaacacacatttctcagaagaagacataaaaatggtcaacagatatatgaaaaaatgctcaacgttactaatcattaaggaaaagcaaattagaaccacaatgagatcacctcacacctgttagaaaggctaccttcaaaaagttaaaagacagtaagggttggcaagaatttggagaaaatgaaactctcatacactgttggtaggaatgcaaattgggtacagccattatgaaaaacaatatgaagattcttcaaaaactacaaatataactaccatatgatccagtaatttgacttcaggatatatatcctgaggaactgacgttagtatgttgaagagatatctgctctcccacattcatcgtagcattattcacgatagctaagatacggaagcaacctaagtggcatcagcataaaaacagataaagaaaatgtgttaaatacacacaacagaataatattcagccttagaaaataaagaaatcctgtcatttacaacaacatacgtggacctggaagatactatgttatgtgaaataaggcagacacagaaagacaaatactgcatgatctcacttaagtgtgaaatccaaaaaggccatagatacagggagtaaaatggtggttactagaggctgagtgttggatggtgatgaagaaaggggagatgttattcaaaaagcacaaagtttcagctagacaagaggaataagttttagagatatactgcacagcatgatcactataatttataagagtgtattatatattttgaaactgctgaaagtatactttaaatgttcttaccataaaaacacgataattatttgaggtgatggatgctaattagcttgatttattaattctacaatgtaaacatatactgaacatcacactgtatctcataaatatatataattgtcaatcaaaagtaaaataaaaataaagcaaaacatatatatacacaaaaaagtaaataccaacgtagaattctctaaccaatgaaagtattcttttaaaaagtcaaaataagaatattttcagaaaaacaaaactgcggaaatatttcaccgaaagattcatactataaagaatactaataggtatctttcaagtaaaaggaaaagcatctcagacaatgatagagaaatgcaaaaaataaagtacacagacaagattagtatgcgtataagtatagaaaaataataaaaataatgttttaggaattagagcacttgaagaattataattcaggacaatgataagacaaaaaatgagagagggacaaatataattattcattgaaaagagataaaaggtgtaagttacagtagagctcattagggtaaccactaagaaaaattaaaaatacgtaattagcaagttaaaagaggggcaaatgaaataacaaggttgattaataaaaaaagttaagacagaagaaatgggaaacataaaattggtagaaaaaatagaaaagtacagtaagatgatagaattaaatcaacaaatattagcaagtgcagttaatgtaaatttaaaaagttgcattgaaatacaatgtcagactttgaattaaaaatcaccattaataatatgctatttgcaggacacataccttaaaagtaagtatacagaaaatgtgaaaggaaaagtgctaaaaaaaatttaccaaacaccaacgaaaagaaggctaatatcactatacattataatatcagtctaagtagaatgaaaagaaatagtacaagaagagcattaaataatactagttaatctactaggaagatatcacagttccaaatttgtacaaaccaataacataagcttaaaatgtacaaattgaccaaactaaaaggtgaaataaacaaatacacaatcaagttagaaaattttgacatatttctctcagtaaatgatagaacttggtaaaaagttggtagataaataaaagttttgaacaccaagatttagcaaatttgatctaatttatatgtacagaatcctgcacccaatagcaacaaagtacacatatttgcaggtgcacatagagcatgcaccaaaagtatccttaaactgagtcatatagcaagcctcaataaattttcaaagtatttatatcatatagaatatcttctctgaccgtaattgaattaagctcaaaattaataacaaataagtattataaaatacatcaaatactttcaaataaagcaatagataaacttgataaaagtcaaaaattggggtcttttggtaaagaaagacaaatataagcagtagtcttctagaaacacaaatttcaaagatgaaaaaggacaaataaccttaacaggaatgaaaaaatggagtattgttacagatgctacagacatagtacaaagataataagatctggtgaacaagtttacatcaataaacttgaaaaaattgatgaaacatataaatcccctgaaaaacacatattaccaaaatggacacaagaagaaatggaaatccttcatagtactacgtcttttaaaagacatgaatatttgatttggaaaactcttctggacactggtctagagaaagaattcattaataagacaccaaaagcacaagaaaccaaaacaaaaacagacaaatggtacttaattaaactaaaaagcttctgcccagaaatagaaataatcaagagtgatcagatgacctgcagaatgggagaaaatatgtacaaactatcaatcagacagaggactaacatctagaacttacaaggaactcaaactaaataacaacgacaaaacaaataatcctatcaaaacgtgggcaaaagacatgaatagccatttttcaaaagaagacatacaaatggccaagaaacatataaaaaaaaaagctcaacatcactaatcaaagaaatgtaaattaaaatcacgatgagagatcatctcagactactcagaacagctattacttaaaaagaccaaaaacagcagatcttggcaagcaattgcagaaaaggaaacgcttatacactgttggtgggaatgtaaattactacaatcactatagaaaacaatatggagatttctcaaagaaccaaaaatagatctactatttaacccaacaatcccaccattgggtatatacccccaaaaagaaattattataccaaaaatatacttacactcatatgtttatcacagctctagtcacaatagcaaagatatggagccaacttaaatgtccatcaatggatgattggattaaaaatgtgaaatatatatgtaataggatactatccagctataaaaaagaatggaatcacatcttttgcagcaataagaatggaagtggaggccactattgtaagtgaaataactcagaaacagagacaaatgtcctatgttctcacttataagtgggagctacctaatgtgtacacattgacatagagggtggaatgataaacaatggagactgggaagggtgaggaggaagggggtggatatgagaaattatttaatgggtactatgtgtgttattcaggttatgaatacactgaaagctctgaattcaccactatgcaatatatctatgtaacaaaattacaattgtacaccataattttacacaaataaaagataaaataaaaaagtctttccacaaaactttctgactcaaatagtttcacaggtaaattatttcaaaaatttaatgaaaaaaaaatagcaccaatcatatacaactcttccaagggtagaaatagagggaatacatccgaactcattttatgagaataatataactatgcaaagaaaacctgacaagaacattaagagaaggtaaaattacaagctaatctctcttttgaatgcaaatagaaatatcttaaagaaaatattaagaaaatcaaattctctatgaaaaggataatataacatcaagtagggtttattctaagaatgcaagggtggattaacattcaaaaataaattaattaaataacaaaaatcctatgatctcaatagatccagaaatgtatgtgaatattccttatgatttaaaaaaaaaacaaaacagacaacacagaaacacacataaaacaacaacaccaactcagcaaactcacgaattgaagagaaattctctagtggatacaggaaatttacaattttcaaaaaagcaaaaaccaaacctagaacaaatgttatactagtggtcctagctagtgcacacaagtggtcctagctagtgcaacaagtcaaaaacacttataaattaaagttatatggaatgaaaaggtagaaataaaactgtagttattcacagaaaacatgactgtgttataaaaaattcaaaagaacccacaaagtctaatagaattaataagtaaatttagcaagattcctggccaaggtgaatctctctctctcctctctctttctgactctctctctctctctgtgtcatagatagatagatagatagatatgaattgttttcttatatagtaacaatacacatttagaaaataaaacttaaaatgataccaattacaagagcattaaaaaatctaattgtagaaatgaatctaacaaaaagtatgcaagtccactgtgcagaaaactataaaatattactgattaaagaagaataaaataagtatgaattataatgcatttatagattagatatcagtattcccaaaataccatctcaatcaaaatcccagcaaattacatattgtagagattaacaagcagattctaacatttttatggaaataaaaaggaacaagactaactaaaagaatctaaaagatgagcacagctaaaagatttacactaccagatattaagatttcttctaaatgttcactacttagtcatgcatcattgatgcaagggtaaataaatagattcctggaataagagtccagaaatatgtccatgaatatgtaggcagtacatttataataaagttattgctaacatactcagggaaagtatttttgacaaatggcacttgatcaattttttaaaaagaaaaaatgaatcctgtccatccttgcccccatctcacacctaacacaaaaaaatgaatttcaggtaaaatgcagacctacattttaatggcaaacaataaagattctagaagataacaaaggaaatgtctttatgacattaaggtaggcaaaagcttttccatttttttgtttttgttttaaacaggatagaaaatactaacactaaaagaagaaattgatcattgaagtgcattaaaataaaaaacttttgtaaccaaaagacaactataaggtcaggcgcggcggctcatgcctgtaatcccagcactttgggaggccaaggtggccagatcacctgaggtcgggagtttgagaccagcctggctaacatggtgaaaccccatctctactaaaaatacaaaaattaactgggcatggtggcataagcctgtaatcccagctacttgggaagctgaggcaggagaatcgcttgaactcaggaggcaaattttcagtgagccaagatcgcaccactgcactccagcctgggcgacagagtaagactctgtctcaaaaaagaaaaaaaagacaattataagagagtaaaaacataagcttcagaataaaagtagatatctgtaataagtatatctgacaaagaagtatatatcagaatataaaatgaaatcccagtaacttaataataaaaacagaaacaaacccaactggaaaatggacaatacctttcaacatgcacatcacaaaagaggatacccaagtggaaaataaacatatgaaaagacgcttaatttcactaatcattagagaaatgcaaaccaaagccatcatatcatgggctaccatgtcacacatgcctgaaaaactaaaatgaaaaaagaccaagtgttttcgacgagtagaacaataggatctctcttatacagtagtccccctttatccatggggaatacactccacctcccttagtgaatacctgaaactgcaaatagtacccaatcctacaaatactatgtttttttcctatacataaatacctatttaagatttaacgtatttatacctatttaagatttaatttatttaacattaatgtataaattaggaacagtatgagattaacaacatacttaatcataaaatagaacaattctagcactatactggttatatgaatgtggtctccctccctcctcttctctctctatttccctctcaaaacatctttttgtacttaagggtgagcccttcttgtgatgatatgagatgataaaatttgggctgcagctgactacggataactgaaactgtggaaaactgaaatcatgaatcaagtgggaggggcattactgtgctgctactgatcatgtaaattggtataataacattgaaaattatttggcactatctactaaagctgaacataagcacaccagcaatatcactcctcagcatatatccaataagaatgcttaaatatgtaaaacaagacatgtagtagaatatgcatgtggccaccacaattcataatggcttcaaactggaaataagccaaatgtccatctatagtagaagagctgaaaataataataatagaattgtgattatattaatacatggaaatattataaagcaataaaatagttttaaaatctgcaagcacatgtaaatgcaacataatataaatgaatctcagaaacataatgtgagcacaagaagccacatacagaagaatatataatcacatgattctatttctatatttttcaaaaataaactaatattagaagtcatgatagtggttatcctgaggaagtagagactggaaagatagataaagggatctttgtggtctgctaatgtttttttattggtctggtgctgcttacatgaatatgttcactttgtgaaaattcacttacctatatttttataatttctgaatttgtaactgttttcctgcactaaaatatttcatttaaaaattatctttaaaaacaattgcgaccataagaatttccattgcttttgtttttttttctctgttttcctgctacttagccttaaatatgggcatagtcacagaaatgtgcatatgaggtaaataaagccccagcttgctggctggaggacataaaggggagctccaggaaaactaaaaaatactaatgagagcacagagaaaaaggggctgcagaaagtgatcttatagggttacaaaattctgggctcatctttagctgtacatgcatggatctgatgttaatcagcatatgaatacaattaagaatgaaattaacagatagaccaatgtctacatccaagattgttcactggtatacacacaggacagacctgaaaagcaccgtaagcaaaactgatattgaaaccacagaaggaatcttgtatcttacaacctgaacctaaccaggtcaattgccttttaaaacaaaaatgtcaacattctccatagaatttcaatatgactcagaatctcataacatgatattaagaatatctaagaaataatcctaaatcaccaggcacaagaagaactaggaacatgtgaactcatatgagaaaacataatcaatggagataaaacctaaaatgacacagatgttggaattgtttgacaaaaactttaaatttactattctaaaaatgctgaaacaagcaatgagaaacaggcttaaaactcaaaaataaaattttaaaaaaatacaacaaaatatcactggatggtttccaacaaaataaagataatacagaaaacagtcaataaactttaagatagatcaactgaaattatgcaatatgagcaataaagaaaaaaagtggctcagaaacctgtgggacaataacaagaagtctagcattcatgtcattatattaacagaagcagagaagaaagagtgtgctatgtgttgaatgccccctccaaatctcatgtggaaatttaattgccattgtaacagtgttgagtatcaggacctttaagaggtaagtaagatagactaatgtcattaatgtgggagtttattagttatcacaggagtgagttgttgataaaaagaatagtttggcccagtgtcctctctgtcatgtgctttcttgccacatgatgccttccatcatgagatcacccttgttagatgctagcatcatgatcttagacttctcagcttttagaactgtgagccaaataaatatgtctgttctgtattaattatccaatttctggtattcttttatagcagcagaaaattgactaagattataattctgaaaaggtatttgacaaaatagtggctagaaaattctcaaattctgtgaaatacataaacccacagagtcaagaagtacagcaaaccccaaacagaaaaaaaaaaaatcaatctctggatacattaaaatagaactgctggaaattgaagacagggaaaactgtcttgaaagcatccagagaaaatcacacattatctgtagggaaacaccattcaaatgactgtggaattctcatcagaaaccatgaaaacctgaaggaaatggcaccccttttttaaaggtctgagagagcacagagaattctatatcctgtataaaagagacctgctctaaaacatttgctgaaaggaagctctccagacagaagacaaatgatacaacattgccactgatataaacactgaacattaggaatgaaggaagaggaaaaaaagtgataaacctatgagtaaatataagaaacgattattcttttgggttctttaaaacatgtttgacaatttaatgcaaaattacaacattatctgacggggcttccaatgtatgtagatataatatatgacaaaacaataatgcaaaactgggagagtaaaaggacttatatggttgtaagatttctacattctatttaaatgtctaaaatattgattctaagaagagtataaaaagatatgtatattgaacaactttagaacaacctctaaaaacaactatacaaagaaatatcgtcagaagaacaatagataaatttaaattgaatgctaaaaaatgttcaaataacccaaaacaaaacagaaaatgaaaaacaaaggaaaacagaagaaacaaacagaaaacaaaatataaaatgaaagacattaattcaaatgtaacaataattacattaaatgtaaatggcataaatataccaattaaagacagagattatcagaacggattttttttaatgacccaattatacactgttttcaacaaatttacttcaaatataatgaaaaaggtaggtttgaagaaaagtgtacgtgctgcaaactccaattataataaagctggaatggctatattaatattggacacagtagatctcaaagtgaagaaacctgccagtgatacaaaggacatcatataatgttgaagagttaattagccagtaatatataataagtctaaatctgtatgccctaacaacagagcttcaaaatacatgaagacataaaaactgacagaactgaaaggtgaaatggaaaaatctacaattatatttggagatatcaacacccttctctcagtaatagactaatatataattagtaaaaacagaactgaaaaaattagcttcataagagagagcatatgatcattcagaaacttaacagcatttaagagattatattccttaccaaatttttaggttaacatgagtaaggttttttgatatagccaactacagttttcgtaagagtaatggttacttcttcagagataagtcatatcagcagaggcagaaagctgagaatgggggaggtcaaatctttgtaagatgtaaactgaaaagaaagttttatagaaatgaatttctgctgatctcactgtgaaagtgcagttttcatacttttatgaaacaggcttgttactttgtttaaatatttgtgtaatccaaatagttttgacttcagttaagctgaatatttgctttaaatatttgtttttaaaccccatttatcaattctttagaatcttatataaaaggtacgtggtacttgcttaggaaaataatcaaaaatcagaaagtggcccttttaataatgtgaaatgattcaacaaacagaaaaccaatattttcttataaaatcagtaaggtggtaggtaggtagctataaaaatatttagatttttactacatattaatccttaaaagaaatcaggtaatgagtctgaaataagtttaatgtgtccttcttatttctattttagttacacacacacacatatacacacacactcttacagatagcaaaatatgctaaataggaagtaaacatggtactatggtatggattagtaagaaagtcctaccttagatagcattatctgagaaagtgttttttactttaagaaggattcgactaagcagtgtgagtttaagtgtcagggccagtgccagcatgcttcaatgagaacactgagaataagtgaaagttgaattgtcactggtttcttctaagctaagataaggtttggggcacctaaagtgcactcaactgcaaatactgttagaggccactcatcttccaagggaagtatcaggggaacataaaacttcattgagttctggctagaacaacatcttatgaagctaggtagattccatgtttctcttgctgataccaaggaacaaaggtaaacaaaggtgtcttcacttgcagctgccattgctgctgacaaagcttatctgcccacagagtggtgaatagtaattctaaaggaaacttcttgtctgccaagtagaactttgaagttctgtgtcatcccatgcaactaccccacaaagagcaggtgaatcctgaggtgaagggcactactgcccctatggtgccctgaaagttggagatcaagctttgagcccttcaccaactcaggataaaccagcacaattagacctcctataaatatgaaagaattctgataactccagctccagagattcttggacaagttactaaatggcagtagacagagacagcatagctgcaccttctgctgtatacctgaacactctagctaaaagtcagatatatctatccatgcactaagtggttgaggatcaatataaacaaaacacagttgcctgagttctgtttacagagcacatacgaaattgtctttttctctccacattgtttgcatcattcctaacccctgaattgaattcacttgttagctgcactgttgtgcaggtcttctgatcttgctttactgacttaatgacaaccactctctaaagactgacaaaaatcacactgtttcttttcacactgcccaactgaagtgggccaagttctcatcatcttagctctagtactcaaccttgaaatcatccacagagatgtcttccatgcaagatatttctcactgtaagggaagatgatggtaagtcatcatcttcaaatagaaatgatagctccaaagaggaaaaggaaaaacaactgccactccatcacctctctgactttggctttctagggaatcagttcttctgggtaaggttaaaccaacaaacaaacaaacaaaaaaatggaggtggggggtgtactttattctgttttgtttttaaagaaatggccacttttcatagatagagcaatataagtggaaaataaccaggaggttttagtgaaaatggaaaaggaaaaggcaaattttgtgacatactaggtctaacaattgtttaaatctaaagtttggtgccaaatagtgatggttttaattaatagatggatctgaaacacccatatatcatgctaaagatttagtattaaatatgttctactactgaaaataataccaaggtctctaacgacaagataaacacatgctatattgacaaaagtatgcaaaaaaatgctaatcaaactcagctcataggagcaggagctgaattgaatgatcttgttcccccaaaataaacttccaattcactactcaggttattttccaattgtcactgggacaacacaacaaaagcaggggacaaagttaaaacctggccttttcagtcaagcaagtggacaaatactcaagacaataacccacaaacaaggaagatgacagcggaaaatcccccacattcagttcacccctttgtgaccaaaccctgttctgcaggtcttctgatgacttagactttaagacagcaaggtagacatcctggaaataggccaataataatcttcaactaggaagacatactgaaatcactagggaagcttttttcaacataacctttccctccctcagctgggaatcatagattagatttaatttgtataatcacttcagtttgaagtaggtggatgacctgaagaaaattaaggtataatggcaggcttgccatcagcaagtacgcatttacaaacattttgacaagctatatctggaaatatcctgaggatccaagaatcttggttaactttatacaactacgataaattgggcactacaccaaaacatgcaggctatttgactctgcattttcctcaatcaacaacatgtaacggagaggcctaatataccaaatcattatcgaacagcttagggatgactcactttgacaggaagagcaaagtgtttcactctcatctcagtgaacctgttcatactgacataatgccacatggttcctaatacgcaacaatgtacactgttccagcaacatagaggcagctttgagcctttggatccaaattctgtgagtgagctgggctagagttttctgtttcccttccctcattatcatggcaacagagggcaaaggtggcagttaggctttatgcctggactgctggcatacaggtccacacctcttccaaaacaaaatttggacaatagttacacatgaaaatgttgtgttctgcttaggttataaggaaactaaatcatactgcaggcaactctttagttattttctcttttatcctatcttcaccagaaaatttaaagagctctaaaacagtgtttctcaaactgtaggtcacactgtcagtgctcttgaaattaagatagtgggctgtagactttaaaggaaagttaggataagataaaataggataagataaagtaggataggatgggatgggatgagatactagaggatagaatggaaaatgcaacacataggaagggtaaatactgtcttatgaaattttgttttaattatatgactgcatgtagactgtgtcatgatttaaatgcatttatctctgtggattattaggaaaatgtatgaaaaccactgccgtaaagaacatctatcttatggccctaacagcatttctctacagaaacactattggctttgtgactgggcaaatctcttttctaagtaatttcagctattcatggcaggatttaacatcatatctttcccctatccactgaattccagtagtgcttccttttcatcgtgacaaccacacattttaaatgctacctaggaggagttatcaccatctagagataaatatgaatccatagacaaaaggttgctagctcaactcatatctgatgagaagcaagtgtttctaagtatccttttgtatctagagtttgtcctccaggatgaatggaggtcagctttgatagctcttatctgggacgtgtacactgttccagctacttattctgcaaattaagtcttcctttcctagcacccatcaatctaatactaaattcattagcaaaatgaaatgaaaagaacacaacatacattgctattaatggaattccatgcatgtcactccccacacattgtactaaaaatgaactcatctccatttgagtgtctctacacaaatatctgtgtttattaatacacagcatttcagaagtgagattttccttaaagctgtaaagccatttgctttgtcaagctcccttttcagggaaaaacttcaggaattttcactatcaatttatgttgattatttactcttttgtggatctgctattctccaggcaaaatccaataaggagaaatcatgattactgtctaaagaatttattttgtaatattttttcttacttcctgtaacttactttgtgtgacagtaataaacagttcataatgctccatctactatcctcatccataaaatctagtaacagttcaacatttaaaaattttttaatgaagacaaaaatcagctggtgacttcctactggagcacaaaattaacacttgcactggagtgggtgagattttcttattcagagcagaatacagtctttttcttacggatttaaaaatcttagttacctttccctagcttgaaataataggcattttgggctgggcgcagtggctgatgtctgtaatcccagcactttgggaggccaaggcgagcagatcacttgaggtccggagtttgagaccagcctggccaacatggtgaaaccccatttctactaaaaatacaaaaaattagccagggtggtggcacacacctgtaatcctagttactcaggaggctgaggcaggagaatcacttgaaactaggaagcggaagaagttgccatgagccgagattgcaccactgcactccagcctggccaatagagtgagagtctgtctcagaaaaaaaaaaaaagaaagaaaaagaaagtaataataggcattttgaagacttcaggagaaatagctagaattcataaattacccagaagtgataacactgtacttagattttcacacataaattttcctattcctggatagtgtgggaccaaactatatataaccaagttttaaggtgaccaaaaattaaaattcacaaatactctgaatgtctcaactactttccttccagaaacccaagaaaaactgaagtgatttctcacttcccctaatgagcactaatgacaattagagatgaacagctaacctcaaacacactaaagagtgtttttaaaacagaataccacacaggttgtataaggcttatcttcaaacattttcctcaataaaatgttaataaacaaaaaaaattgacatgagggaaaagagaattggaatgaagaatatcctcctttacttttaaatgacaaaattaacaaacatgagagaaaacaccatttttaaaatgaaaagatcactcatatgagagaaggcagatcacatagtggaatgtctaaggggaaatccaggtggattgcccactggagtatacagttaaaaaatatccaaaggaagaaagaaaagacattagatatttggaaaggtaagtaactaagtaaataaataaataagaaaaatgatgacaaatttgcaagggacaccaacaccaaatgcggtttttgttttttgttgttttgtttgtatgccaaagagaatcagtcagctagtaacaagtaaggaaattcaaacagtagttgttctaggtcaaaaacaaaagatatatatgtacacacacaccacacacacacacatctatatttatatacatacacacacacacacacacacacacacacacacttggagactctcatgcctcaaatatattttgaagcatacaaatttagagagtctagatttaaaacagtggcaaatacaaaagtctttcttaattaaaaagctagctgcagataagtcactagcatcaaataggtaccaatcaaaagtaaaactgtgctcagaaaaactaacttgttcttaaaatggccattttcacaaagtactgaaagattggcaatgtggccaaattcccccaaaaaaggggtttagaagcagcctttgtaaccaaaggcaaacagtgggaatatgtataaaacaggaagatacacgaaaagcttttgcccacttggtgaattgagcctctctatctaggcttcttgtggcattaaagaagcatctgcaaatgcagtaactagaatatataatctattcagattttcaaaaggcttttgagaaagtttcatagcaataactgtgcaaataaattttgggtaaacatggaattagaaatacatattttcacaagcacaaaactatgttagatataggaagaaaatgtgaagtggaaatgatgagagaatgcttttataaattttgactgtggaattcaaagtgtcaactgcacatatttatatttcactatccttttcaaatagtaaaatatcaaaccacagcatcacggaatcctaaagagctgggatgactccctacgtactacagattaagaaactgagctacagaggattaataattgcccaaggttaaaacatatagacatcaggaagatttcataacgtttacaaacttgaacaaaaagtaccacatgagctcccctatggggatgtgttgagtattatatttcactagtgataaagaatacaaaactgttcacataaatgtggcctttaaaatatggtccctaaacaagaaccttaaaagaattataatacattccctgaaaacatttcaatgtgttctggttacaaagatattcaaaattctagacatcatcagaagtgctttggatccagtcttagggagatccaacatttaatagctatcagaaaaaaatgcctgcaaaggacatagtgaggatatcagaaaaaaatgcctgcaaaggacatagtgaggaaatgacaaggagcataggaagaaaatcaagaaagcatgacgccatgaaaaataagggaagaaagcattgcaataaggaaggagtggtcagcaagatcaaatgctcagtgaggtcccagtgagagttaatttggagaagtgatggaggtccctgcagcagacaaggtgaattgctgaatggattggtgaagaaatggaaatagagagtagaaacatttctttgaagaaatgtgagtgtccttctacaggtaaaaaaaaaaaaaatacatgataactggtcaatctctgaaagtgtgggtccagcggttttaagaggagattcagtattacccaccatactcgttttttttttttaaccataattcctagtcaaatatgtcataagcccaggaaaaggatctcaaaagaacttagaactatcctccttcaatacaaaaaataaaaggcatctggtttgcagtagggttgtagaccttgcaagacttctgcattttggtttaatcagagattttccagaagtctaaaaataattattcatctttgaaaaataagggtaccatacagctatctagctctgtaatccaaggaaaaatcaattatcttaaaagatgccttatgaggtcattgtttcacatgataaaacaagaacattaggaggacaagtctcggttggaagtctcagatcactctaattgttctaattgatgaatcttcttcaaggaaaaaagtgggctccatttctgtttttaaaaatccagagtatctgtagtagtgcaactaatgacaaccttcccgttgttcttgcctaagaggaaaccctataataagagcttcccaaaatgtcaaataatacttgtctcataacagggcttctttgttcattcaccatgtctcttttgatatgcacagataataaaagttcatataaaactaaaggtaatatagagcagaagccaacactaattctgtataaatatgtctgattaataagaatgctattgttatggttatttcataatgtcacgattgttacaagaacagaggatagaagtactcttactcttactgttttcgttcatcctctgtcatccaaccagtttgcaaatttctgttcaacgggaaaaatgaaggatagatttttgtccattaattactgctgttgcataagttagtctcataaattgtgaaatgagcattaaattcagggaaaaattaggggttttattttaaaattgaactccacttccactacaaaaatgaatacatgctccaggcttactttctaagctcccttttccacatgcacagttgctatattcttctggtgctcatgaacacatgaaagatagaatttagcatgatagcactaaaatctaggtaagagcctagtatattaaacctaaactgtggtttaatacaacaaccatacacaaaattgtatatgggatttggttccaaaaattagaaccccaccctggtgaagtaataagtaaccccacccagatgtgagtatctggtcccttactggaaaggaaataaaaacaagtaataagataacagtctacactcactgcagacagacagcccgatagattttgaaggaaattctaaggctggtagataagtttgtattgtcattattttgcttttctctttaaattcttatctcctagatcctggtattcccccttggggcagcagtataatataaaagcttaacagtcgatcttaaatttagctgacatttttatatccttcaaaacataccttttagattgcacccaagaaggagattattaaatagtagcaggagaccagttagtggaccattttgactgaacaaaaaacagcactgtgccttcttgttgacaaaccaaaaaacatttatatagtcattataatcaatttcataaataaaaggctattaatgactgagaaaaaaagggaaaaactgtatttctcccaagtcccttcatcctctcttaaactccatattagtttaagaaagtggaggaagctatgcatgaaaaatagtgtacttagttgagctggagtctcttgtgaaacaggttctgtcagtcagaaggcaagggtacatttctataattatttaagcctagtttttttgtagtaattagccagagctccattttgctgaagctggcatcactcacagctcacttttttttttcaatttagacttttcattcctttttataaaataaatttacatattttcagtctctcaatccctcctatgttttatttatgaatatagcccttcttgatggtaactctaatgtgaaagaggtagtaattaatgtcccaatctgctaggttaatccctttccacactctctatagagaagtttaaggtaagtaacagtttacagtcaatattaggtttaattatgcttaatgagagttggtgtctctgtttactaactgcatttaggtgtgtggatcctagatgaattttcccttggcctcattctgatttgttaatagtgccactgtgtactgtatactcagtgcttaaatctataaagctgcttctggagaacaaagcaagtaaggcacctgtttcagttgaaacattattaaacaaatgagtgaagttttaccgcaaccacatctttctttgggaaggtgctgttattttataatgctttccaaacaggtccatgtaaaaggctaattgctgcctaaattcaagatcctaggttaagtctatacatattaaaaaatgtttcaaactaagtacaataatcaatggtgagtattttaaaactatggagtattaaacacttctaagactttctgtattaatctttcaatgttttcattccaagtactataattgaaaactactttgacaagtagtttttttgccttgaaaatgtcttttgtcttaaaattatattcaactttgttgctgtgtataagacaaaacttttgtttccttactgaaactataaaaataagcatcaaaacaaacaccttggcctcaaggaaatcagatagtaagccgagggaaatttagtaaacaaatttttaaagaacccctttttcctatatttttgttatggataaattatgtatacaactgaccatgtagtttctttaagtccattcatagtctaatcaatttagtaaacatttattgagtaaatactttgagctaagcacaaaaatgaacatgacatactcccttctctcaagaagcttaccatctagaaaggagccaggcatgagttaaaaactttaataggctgggtgcagaggcttacacctgtaatctcagcactttgggaggccaaggtgggtggatcacctgaggtcgggagttcaaaaccagcctggtcaacatggtgaaaccccgtctctaccaaaaatacaaaaattagccaggtgtggtggagcacgcctgtaattccagctacttgggaacctgaggcatgagaaatgcttgaatccgggaggcagaagttgcaatgagccaagattgggccactgcactccagcctgggcaacagagtgcgagtctgtctcaaaaagcaaacaaacaaacaaaacccaaaaaacactatgctacaatatggtaaatcatactcatgcattaagaagacacagaaaagatcagttgatctgtagaggataaataaggcctctgctggtgaaatagcaagttttttctgggtcatgtgcagactatagcaggctaaatgaacagtaagagcaaaggcagaaagcatggcatccacagtgtatttaaaagacagcaaacagtgaagtgtgtgttgaaagaactatgtgcctgggtggaggaggcggggggtgatgggaagagatatgggagtttggaagttaggggctcaaagagtggactgagaccgaattaagaattttcaatgtcatcttgtgttagcttttatgtaatatgagggataggaaaaggtaaagagataacactactaaacaaggataaggtctgaataaattccttcaaattaaactgaattcttctaagcctactgatctttgaaaaacattttcaaatttcaaacctcccataatgttatttggaagcccttgcatttagatcaaagaatttgtgccatgtggaaaaaaattcctaaaatatgtctatctgaaagatgggatgataacatattaatggaagccagtagaaagagaagctgttaggtttataccccagggaatcctgagaaatctgcaaataattaaatgtactttgtgatataaaaatctgtttataattaatttcagaaattttctgccttttgaaaattctcccttagttaatatatcatgatgttgtttttgttttttaaattttaattggcaactaaaagttgtatatacttatgatatacaacatgctatttttaacgcatgccttactccacatatttttgtagtgagaagacttaaggtatactctcatagcaatttttaagtatagagtatatttttatttacacaatgtacaacatatctcttcaacttattcctcctgtctaagtgaaattttgtaccccttgaccagcagctccccagtctctcatcccagcctctggtaaccaacattatactctccgtttctatgagcttgacttttttagattccacatataagtgagatcatgcagcatttgtctttctgtacctggcttatttcacttaaaaatcctccaggtctatccatgttgtcacaaataacagcattttcttttttaaagatgacttacattgcatcatgtttatgtatattattatctattcctccattgatggtcacatgataacatccattctgacaggtgtgaggtggtactcactgtggttttaatttgcatttctccgatgattagtgatgttgagcattttttcatatacccattaaccatttgtatgtcttcttttgagatacgtctattcaggtcctttgcctatttttcagttgggttatttgttttcttactattgagttgtttgagttccttatatattttggatattaaccccttatcaggtgtacattttgaaaacatattcttccattccttaggttgtgtctttactgttaagtgtttgcttttagaaaaataaaaaaagaggcaaacatttccttaaaatccataaactaatgagttttaaaagaaaagaatgccatccaaactacctaatcagaaaaagactttctacagcttagatcctgtttttatagtattttagaaatgtctaaacacatggcctatgacaaatacttgcctctttttggaacatcaattacttctttgtaacggtatactgatttccttttaaggaataatctctttcccttccagtatagtattggtgagacggtaactccaggttcaaagataaacttggggaaattaggtagataaaaacagagaacatgcaaaaaaataaagaagcacacgaggtgaatgaagaaaaatgtagcaaatttatcagaaagatggaaattgtttaaaaaagttttaatattttctaaatatggtgaacatttctccaatttaaataatcatcagttatttaacactttctatgtgctaggtattcaattcatcaatttattaataatatctccaatcctaattataaccccaagagatagatgttattttttccattttattttatcggtgtgtaggcttaaacccagagaactaaagtaatttgcccaactgttagtgaatagttcagtcaagactgaatctcaaatccagtggaaaataaaatggtatgtccagtataggaagtacaaaacatacaggttaaataaacaaacgttcacatatacctatcaataaagaactccaaaattacatcagtctgttaaaaacaagccactcaaagctctagagttaactaaggtagtaacataattctgaaattaaaatgaaaatatttacataaagttaaatatttttttaaaaaatctttaaaaagtacactcaaacatactgggaaaacatttttcatgggaaacattttaggataatactatctattctataagaaaagagtcaccttcctgaagagttctttgctttcagtgctgttgcctaaattaactttctgttatgaaacacatcacgctagttttaacctagagaataatttgaacaaaaccaagttaaccatttctaaaatacttaaaatacaaagaggtggttgtgtaaccttgaagataattattcagatgtttttaagtattcatctctccatagtattttagatttaattttgtgaatttagcaacaaagaacacagtttagcacaaaatgagaaaacctgttcagaagtgaagaaatcatctaaatattaatagattttattaaatagcagcagaaaacgttatacttggtgttattttcagctatataaatatcttatttttatccaataaaaaacatactaaattcctccatttcaaatactgatgatatcagcaaagtgttcacacatctggatatctttctgtgtttacctaaactgacctttctggtatgtactgtactttctatctcagtatcttcagtgtacatttgcaaaaactacttgaacagtttacattctcccacaccatgctacttcaaatggtcttcaagactttcaaattactgtcagacactgggcattttgtaggcatatacttttgcattcctcctcaagggaaaaaaaaggggggaaagcctagattcaaatggtaataaagtctctttcaccctgataaatacatttaaaaagttgatctcggctggtcgcagtggctcacgcctgtaatctcaacactttgggaggccgaagcgggtggatcacccgaggtcaggagttcaagaccagcctggccaatgtggtgaaaccccatctctactaaaaatacaaaaattagccaggcgtggtggcgggcacctataatcccagctactcaggaggctgaggcacgagaattgcttgaacccaggaggcggaggttgcagtgagccaagatcaccccattgcactccaacctaggtgacacagcgagactctgtctcaaaaaaaaaaaaaagagttgatctcatcctgatgctagagttgtataaaagaagatcttagtgttaactcacaagctattatataaaaatatttgtatatatgtataccaatgtactatgcataaacacatttgaatatagcatgcgtatatatgcaatctatttagtatatttgaatgtatatattatatatagatacatatgcatttacatttccacatttattccaaaaacttagagagaaaatacttaaactgttttcaaaatacaaattctaaatgaaataaaatgttctttaaaaactgtaattaatggctgttatgtcaaactgtgaaccaaaaaggtcaaaccttataatttacagtttgagaggtcatacctcaaattataaccttaaaaaactgattatttgtgagtaatttgacaaatgcatctaatataaactgaatgcatatgaaatatttttgcgagtaaaaagaatgtatgtccaagtggacagctgatggaggaaatagccttttactgaacaaggctgaagtccaacataatgacttggaatgcctttgaataagcatgcaggttggaaggccaaacagtacacacatccaaaagggagcataatgaactatctgatcagaagacaaaaatactccacatatacacccaatgagaaaaaagaaaacacacttcggtcacctcctcttttttcatcattactataccccaattcacgaatgaactctgggctattgataaataatcatcaaaagaaatgatttttataatttaaaaatactagaaattcctataatattccaatctgagattttcaaatgtctatggagatcttctatatcatataaagtaagccaggtttacaaaactgtttacgactcatcttggatgcaaatattaccacacctagcttcatctcaaagccacctgctccttaaaacataatctgaaatactttggcctctccacaatttttaatctacaagtcatccaccattaagaaggcagatcattgaagataattttctccaccgtagactcaattccctaacccaagctagaattgagaaggttagcaaaatagtcatttattaatatatctatgtctctaatatttatttatgtgcttattatatctccctgttagactataagctcaacaaggataaagactaagtctcttttgttcaacagttatctataacatctacaaagtttctggcacagagctagcattccataaatattcgctagaaaatggaaagaaggggttgacagaagaaaggagggaggattgagttagctagtctcctctagtattatttgtgcaattgtggagagaaaaatccctaaaaatgtacactgtatttaatcaatttacccatccaacaattcactgatacatcgatccttgaaaccaaaaagatttaaaatggcttccaaaagtacacaattatacaataaaataaattaaaacagatgaaaaatgaaagggatacaaaatatagttgggaacaggatatttctatacgtatactggtaaagtcagttaaatcacaggaaagagaaggaatttgctttttaatttctccaatttaaccttattgtaactactattataatagtgttataaacactaagcaaatatttactcgttccttatctaaccattactatggcaaatactctataaccaggtaccttatattatgagccaggcaatctattggatgagacaaatattcagttataagaaagtataatatgtatgttataacagtaaaattatagatttttgtaggagagaaaagtaggattctctgaaccaacaaaaatgcttacatggtaactgctgaactatgaacccaatacttcatgtaccaagagatttttctgatacatgtaaatatgcatagttcttgatacacagggaaatatgtggtctcaaatgttaccagtacaaatgagacttgcacatgtaaatcacaatatgataagaaaacacatttgaaaagcattatctttcttgtaagtgaaagcttaaatctgattccacttagcctggtaagtgtttttgtcattccgttgggccagcccacacatactgggctcttgataggtcctgggctcaaccagctggccctttgtgtacttaattctttttttaatactgacgagtgtattagtaacacttccttgatcactggtaaatatacagctaccacacaactaagattttccttaattctgaaattcactaattagttgtgggtacgggttagtattacaaaggtatgttgagtggtactacaatgagtaatgtaattcccaaaaagaactgtgttaatttacttcccacttcattagaggaataaaaaacatcttattatcactaaaggatacagaaagagacctgggtattttagggaatggtagacagggagaaagcatgaatgcagcattgaggcaagaaacacaaatcacctatacatcttggacaatgttcgtgcttcttcttaatactttctgcttgcttcatttattagtgtgtttcatgaaaacattttattcaattaataaacaggtttccaaagaaagcaaataaggtaaatgattcctattttcaaaaacttatcattctactggtacgtaagttatgcattagtcaactctggaagctgcattaatcttttcaagccaataaggtcacaatcaattacttgagatagcagaataaaatacaggcttaaaagaaataatgcagccgggggcggtggctcacgcctgtaatcccagcactttgggaggccgaggcgggcagatcacgaggtcagcagatcgagaccatcctggctaacgcggtgaaacctcgtgtctactaaaaatacaaaaaattagccaggcatggtagtgggcgcctgtagtcccagctacttgggaggctaaggcaggagaatagcaagaacccgggaggtggagcttgcagtgagcccagatcatgccactgcactccagcctgggcaacagagcgagactccgtcaaaaaaaaaaaaaagataatgcaatttccaaaggtgctaccaagtcatttagagagaacatatggtacaattatgagtatcaaaactgggaatttatatattttaagcctaccataaaacatatttactttttttcttttgttggatgagagatattctaacgctgtttattttttcggaagattcagattattcaaagtgtatcagctgattgttatgtgtgttaattcaagcactgagtttaaataatcataactcaactccctaaaactgaagattctgtgtaaggttgggccagtgccctcattcctaggatcaaaccatgtaagaccagacaaaggtctcagagattttggggggttccagtctttctcctttgtccatagacgtgttagggaaaggatgacattttcttatagtacttaccccaaataactaaaatctcaacaaaaaatagataaaagtgcggattgtaaaataggtgttaataattccttaatcaaatcttgtaactaatgaaaaaacactagtttatatgcagaagtaaactgacgaaaggatgaacagaataaacaaggaggaaaagacacatttttaaatatgtaatttagaaactgtcaaaaaaagtgggacatgtcttatttaactggtgtatgagaagaatggatggttttacaggcacataaatgcaggtacagaaaggtaataggagctttgtattacaatggaacttaaactcctctgggcagtgatcagctaagatggaacagagacagttacaatgcaatgattaactagtggacaaagctattatttatggcaggtatgtaagcaattggggcagcaatgttggaggcccctcctcatcaagcagctttgccagtacagactggatgcctggaaccaggaaagacacaaaaacaataaaacctagagccagctaagggagattcaatgcaatccatctccaaattttaaatattactggaaatctacactgaagaatgttttcccttgggattggcatacactgtggttatagaatgttgaccaacacttacctttatttatctcactatgcagagcaatatgcctaaaatacctacttagaaattctcattatattacagaaaaaggagattctaacattagttggcaaaaatttttgttgataggcatgaacatcatgtcattacatgaacagatcattaaagtgagtccatttcattgacagtatatattgtgggtctttttattctgaacaaccaaacaaaacaaacacacaagaggtcattgtgccttccctcatttggttggcagctttatctgtaaaatatgaaaataaaaaactaacatggactacaatcctgcatgtaccattggtacctgcatagtaccatttctgcataagatttaatcaaatattttattcatgttctgaaatcctgatatttgtgaagatggaaaaatacacgggatatttttaactttcaacttcatgatctccagtaaaagtagaaaaataatcatatttcatattatttggttttttgagctagccaaaaaattattagtatacaagaaaaaaggaagttaccactcttcacttgtcttcaggtcttttaatgtaatctcaggaaaaaaacatatttaacaaaaatggaaattatcatgttaaaatctattccactttgaaaagcgatattctttctccctctcagataattttaaatataaacctgaaatgttcataaccaaataaatcgtctagcagataaccaatcaccaaacattaattttacacaatgaggtttctttaatttctctctgtctctctcacagacacacacacacacacacattcacacagacaggttgctaacttgattcttagtatggtaacttaaactcataaccactccaaaatatactttaccttgattttgtgaataaaaataaataatcttatggggcaaggcagggataaaaattagaagtatatttctaactttaatagctaataataaaaagaacagcagaaattactgaaaattatattgctaaaatgtatctgtacatgtggctgtgaaaacttacgtgcaaagagaattctcgttaactaccttcagaaagaggtaatgaaatatgaggtttaagagtacatctttagtacttctgtaccttaaaatattgccgagtattaatttttcatcaagttgtcattttctctgacatttggttttattaatcaaggcatttatcattaatttgtagaaaatatcgtaattaagccaaataaaataaaatccttaaaaggttaaaattagaaagcaggtgaattagaactttgacattaccctgttgacatacaggagctttctggaagtatgagaatgaagtttttttcagtgagtttggtgcctcgatcttggggctggctggtttttaaaaaatgttataaagatttgatttaaacctctctgacagttttgacattcaggtgaaagtactgctgctgcatttggaacaatttgcatatcccactgctaaacggaatgtttgaggtgtgcactggtgtaaagaaattaaaaacaagctatcacacatgcttaagtgtatgtattcacaaaactgatggttggatcgcaccaccccatccccctccaatgtaatctgtgatttactcttctataataaattaccctaccatgttagtctcactggaaaatctaaccatgcatgtaagaagaaaagtaattacagccccctcttgtctaagaagcctccttcaatccctgtgagctctttatacacaatgcagccacacgagtctattgtaaacttcttgcctgaaattctggacttctgactatcagtagccactaaatctcatctgaagagtttcaatgtccccaacaaatacaattttatttcttatagttaattgtaaagctcttcctcaggagaaattgttactgacattctgactttaagccaatatgtctgtttaacaaaagaacacagtttaaaatcatgagttccaaaccagttaaaaaaaaaaaaaaaaaggaggacagagggacataatacataatgaaatagaaggaacaagagttagagcaacacctaattaagctgaaatattcagaaagagtataaaatttctactttttaacttacaatttcatattatttttaggtatacatagaaaaagatatttaatgtgtttaaggacaataaaagaaaaataataaaataaaagaaaagttgaggtagcaaatccaagaccttaaatattataagacaattcaagaagataaagcccattcaggaaaataccactggacattaccttcagccttcagagtcccaaaggcaattcttaacacttctttttatttgtctgtaaaaaaaggaatacttaaaattagaaatctgccaaggaaaacatttgcatttctataatatctttatgacccaggtagctgagtttgtgtatgccaactaatatctatagttttaaaaagaaaactgaaagctaacacattcatatgtgtacaagtactcagtaaaacgtggcccaaatatacaatctaaaccactgcatatacatttttgaggaggcatagcacggtgtttgctatagtatcataagaagttatcttaactcataaggatatttgcatttttatttcatgttttcttttaagaaaagcaaatcccaaattgcttttaacctatttacttgctcattcttattaacagagagttcgcaaagttctatgatgtataatgtactggtcatcactggtgagtttaaaagtatgcaaagataaaacacaagccctattctcaaaatagtaggtaaggttagagatatttgcataaactcagataaaccaaagaaaataaaaagaaaatgggtggaaagaaataaagatgcaaagggtaacatgttcagtacagcttagtacctaaggcattgacattaaaacatggcttaatatttcctgttttagcagaaaggctaatagtagggtcctacccatatttagatgcaaggatgccaaacaaatggatgggttgcttttaaatttctttagtaaagaattgaagctggatgggaacaggcaggatgttgagtttactttaaagccaatttggtgattttgactatagaaagatttaactaaaaacagctctcctattaaaaattgaatttgatgttgtgttcccattagaaaatgatctctctaaatttgctatgaaatctcaatgatgaccttgatgccacatttactaataatctccacagagatttaggcattcaaagtttcaaaagcagttttaataatggaaatgcaatacctaaacatatgcttgattatataatctagtacatctacagtaaaatgcccattaaaattttaaaaatctgaggattttaattgactatatcattaatatgcatgcacagtatttttgcaaacaacaaaccacactagtaaaccaaaacaaacctaaggattggttgcactaatagacaaatagggtccagaaaaggaatctgacactcctgttatatttggggtgcatcagcattattacagttattctgcatcagcaaactaggagggatgctaaaagttagtaactgctaggaggagtgagaccagaacaattaatgatgaagaaataggatgattaggaacagaaaagaaaaaatgttctgatcatagagataaagtggaggacacctttgagaaaattaatttggtaactacatgatatattacaaaagttacttttattaatttattacctgtctcttcctctagaatggaagtaacataagggcaggcactttctctttttcactgtaaccccattttcttgaatagtgcctgccatatactaggatatcaatgaatatgtactcagtgaatgaatgaacagcctaaccaataaaacaggcactaaatctgtatctatttacagatgagaaatttaggcttaaagaaattaaatcatgtacaccaaattaaattgtcattctgcaactacaaacttctacaatgcattctttattcttccattcaatattcattctagcaacaggagaaacagacaataaacaaataaactgttagacttataatgtcatataattagtactatgaagtcagataaaacaagataatgacactgagagttacctggcctgatattttagatagatttggacagggaaacttctcaaaggacgtaagaataataagaaacctgaatcaagtaaagaagacagtcaaaacaaaaaaatctgaaggactggctgggtgaggtggctcacacctgtaatcccagcagttcgggaggccgaggcaggcggatcacctgaggtcagaagttcaagaccagcctgctcaacatggcgaaaccccatctctactaaaatacaaaaaattagccgggcgtggtggcgggcacctgtaatcccagctactcaggaggctgaagcaggagaattgcttgatcctaagaggtggaggttgcagtgagccaagatcgcgccactgcccttcagcctgggtgataagagcaaaactccgcctcaaaaaaaaaaaaaaatctgaaggaccgtttgaattgttttaggattaaataatacatatttccttgcctagtataatggccagcatataccaaacagtgtactcaatactttttattatattgctaatatttttataaattatgtttccccactagattacattgtcaaaggcatttactgttattttccttaaggttccttaaatagtgcctagcaagagctcaataaacacttagagaacaaaaatagaaagacacaattttcagttcattaattagaaaataaacagactacatgaatatgaaaaagtcaccatctttcgtatacctgaatcaatcaaactctgttaaatcaatttcacataatatttcacctttcctaaattaaaaaaaaaagaaaaaggggaaaatatattaaatggctagggccaagaagtcatagataacaaaagaataagaaagaatcagaagaaaattaagttattaacatgaggccactctctttactatttacatgctgtctgactccatcagattaacacatttttccagtgaagggacattgctacacagatatctgattcatttatgtattcctaatgcaagcacaagccttgctatgtaacaaataatcaaaaaaatctttgttgtcctgaaatgaactaaaatgatgtttagtagttttgatgctttaaagctagctcaaaacaataacaacaaaccaggggactgacaaacttaaaaaacaaatttaaatgagaaaacatcaagcattaggtttgagtcctatagcaaagaagcagagaacaaggtaggttctttccaaagagttaaatataagtgacagtgtgatattggcattggaagagatagatcagtagaagaggccaggggaacttaggtatggggtaaatgttacaagtaacatttccatgaacaatgttgagatagctgactgattacctgtggcaaaataaattctgttctctaattcttatcagtactaaaatataaatcaggtcaataaaactcaatataatatataaaacaatcaaggacctctaagaaaatacatatgtataattttctgaactccaatgtgggaaggacttttaaagtacatacacagtggtatataatataagcataaagatttatgatgtttactacttaaaattaaaaattttagcctgggcaacatggtgaaaccctgtctccacaaaaaatacaaaaattagttggacatggtggtgcacaactgtagtcccagctactcaggaggctgaggtgggaggatcacctgagcctggagaggtcaaggctacagtgaaccatgatcctgccactgtactccagtatgggcaagagaacaagacccagtctcaaaaaaaaaaaaaaaaaaagtgtaaggcagaaaacatctttaacaaaattcaaacttaagaggccaataaaaaataaatatttttaaagtgtataatgttcattgggttaagagtctttataaataaataaacatattattctactttttaaaatgagcaaaatacatgaataggcaattcacaatagaattgtgagttctcttctaaaatatggaatgcatttataaatatatttaaacatatataaaatatattttaaactatatataaaatagtaatacttattactatttattattaaataatattattaattctaatacctataagtaataaggtgaaataagaagctaaaatacatatgaaataatattaatctgcaatagcaatgaaagaaatgcaaattaaataaactaaaatattttagaatagtgaactggttagataaattatatgtaataggatattaagtgttcattagacatggcaagtgaaaatatataatacatcattaagcttagaaaacaggttataaaatggtaataatgataacataccataccaatatttaataatttttctctatataatataaatacagactatgcacaacttttggttatgtgcatatgtaagtatagatctgtatgtaccaggtgtgtgtgtgtgtgtgtgcttgtgtgtgcattagaaaaagtatgtatgtgactgtaaaaaacttaaactacattattctttgaatttatcttaagattatgacagtttttttcttcttagaatttgtttccaaattttctgtaataaaaacaaattactttttataaacataaaaagcactaaagaaggcacctagtttatgtttcaggaaagaaaaatttaatttatattattagaattcctgaatgttaagaaagacatttgaaaatgtctatctgtcatttttggtgaaacctttttaactgcatagatttttttagagaaaaaaaaatgtaaggaaggaaaggagaaagggcaggtatcgtgaggaagggaagagaacaacaaagaaagaaaaataggatttataaagataacagcaactactcagaatggtatctattaggttcctagcaaccaaattttaactggtaacatctccaattaaactttcaaagaaaagcacagcctggaatgtagaaaacttaagttggaggttacatttatactgtgaacatacttttacaagagaaaatagatgaaatgttcatcgatttcaatgataggactactgtataaagagagacaaaatacaccatgagaacataagatgctccaaatcagttttggaaataggagtagtataaatttcaattaagtaaaagtttaaagtaagcaaattttaagtagctataaaatcatgctgttcattcccatataagaaattttcaatccatagtccttaacatgtcattcaaaacatatgaccctacaacatatgaactatgacttctggttaattgtttcaatggacattattttgtataaggccttcccaatgagtacaaaatgaatagaaactgttaaagaccattatctattaataattatagcaaacaagtcttcattaaataaaaatttaaacataaggtttaattgtattttattttaaaaggcaaatgaaagccaattgatcatcctgaaagatcataaagaacctgtacagttccatcgtcaagaagacaaggatacattccttcaaagactggaaaagctttaatttcagttcatccataatcatgcatcctaaggtggaggtattcattttggatttggatatattattagagtttttaaaacaccagggaaatctggtaagttctatggtatattctcaaagaacatttcataagattggtctggctaaaccccatactaaagccatctgaaataaagtcaaattccatggagctggagctcgagagcaacaacaaaagaccattcactgactcagttatacttgctcttaggtatttcaggttcgcttctaaatagggggaaaaagtacagaaagattaggtactaaatactgtttttaactctaaaatacaatcaatttttttctttacttgtctgtttaaaagtaacccgagcccttccttttattatgtgaagcttcattctgtttatttttatttcccaagagcagaatgccttaaataaattcttaaaaaccaacacatcaacaaataaataaattaaaactcagtgactataaaaagtacacaatctaacctgcttaattattaacaggtaaacacaatgaacttctaaattatttacttaatccccttcaactaaaaactttaaagtttttgggcttgaaatgtatatcctttctaagggtccataaaacaattatttaaaaatctatttagccattttagtaaaagcaattttaaaataccaaggtaaatatgcacttaaacatttacataagttcataaaaaatagaagactttttttaaatttcacaggtcagtaaaattatttttcttccagctttccctagtcttctgtcagatatttcactccaccatgagcagaaatattcagtactaaattatattagattgatataatagttttgaagtaagcatttatagaatactcttattcctgagtataccataagaaatgtataattatgaaactataaaaatattaataattttgaaacttcaagaaaaaaagaatgaataaattaaaaaatcaccattttctccagataagactggactattttcaccagcgtagctaatcactgaagaaagattgctgcttgatgcaagtaaccattgattacctgaaatgttggttagttaaatgttctggttagctaagggttctagggggaaaggtgtttttgtttttagatcattttaactaaaaatataagatgttctactagatttctctgctttagtaaatagggaattataattttatctttcacttaaaatgaaaaaattatgttgccttagaggatggctcttgaacttttgggaagtcagaagggcctctgggacgatgaaaaaaaaccaagaatcttttttctctagaaaagtgcatatgatcacgaaattttgtatgaaatttccagggatccagagacccaataaaaaccccttgctttctaattttacagaattctaaataactagacataggagattgcactcatacagtaacccccaggacaaaaggagaatgtttgaagttccttcagaagacaggcctaataatgagctattttgttatgatttgtaacctttcttctaaaaggggtgtgtaaaaacaattcttgttaatttagtcttggttaaaggttaaatatgtttcctttaaggacaattgcattacaaggtatttgagctttgaaacaaaatagtgctgctttaaaatcattccacattttagaagtgacagcaattttcttcctatatttttgtaacaatagaaggcagagtcaaagagaaatctatttaattttcatctttacttctaaagattaacagataatagcaaatacatgagcagtccccatattcaggttctgttcaaagcgcttttatttgtatttacttatttaaacctaacaaaaactctaggaggtaggtaatatcatcatacccactttatcaatgtgtaaactaaggaacagagggagtaagtaatttgccaaaggacacccttttactgagcggcagaaccaggatttatgcccccgtcaatctggttgcagagttcggattcctacagaccatgttccatttccagctttaatctttcatgagttcttcaatctttcatgagttgatggtttttcttgtgtgttattatatttaacacaagtctacttcttcactaccatgcaaggaactttcatactggttttcccagaaaaattcatttggtgaattgttcataagatgctgacaaaactggccccacctttgtgcagctggcagttttataccatagtaaatttcccagagtcaatgccaaaaattaaaaaactaaggtaccaccagctagtaagtgtggaattatacaatcaaagctgacctctcatttcctttttggaaatagttttcatgggataaatatgtgaatgattatattccaaaggcaaccaagacaacagtataaatgggcaatattatcataataacttctcaaaggcaggattgtctgctattcctaattcatctgatgagaggtacaccagtcgatacaacttttaatttctagtcctaaatcatttctatgaaataacatgtcaaagtaaaatgcatacttaatgagggccagcaaggggccaaatttgcagtatgactattttcttgaaatatcctcttggcagattgctaccaaagacagcaaccaatttgtaatgcaggatttgcttttagtgtaccaatctttacacattgagtaattccatgaagagaaaaggctgacttaaaaaataaataaaataaataaatcccatccttatggtttgcacagaacaggttttagttataaattcattccatttaatttttattgaattactccctaaaataaatgcaaacaggcaggtaccagtgagacacaagtataaaagggcacaataaagcagaatgttcaaagtcctgtgggtacatgtgcacaacacgcagtttagttacatatgtatacatgtgccttgttagtgtgctgcacccagtaactcgtcattttttaaaaatctttgtccttttctcaaatcctccctccaaagtccaaagtttttttttacattagacctatagacttttatgaagaaattcatttcaatgcagccaagctaggctgggaatgagaacctggtttaatataaaagtatgcctggaataaaatatcatcctttgcctctatctatctctatatcatcctacacaccataataaaacaaatatttggaaataatctagttatttcctataataattcctaatgatttacagtatcaagtcctatatacttggttttcaaattcctccataatctagttccattatatatcctaattccaaataatgcagaaattatactgtctcacccaatgaaataagattttaaataaatatacattgtttcagcaaacaattattgggtttacaatgtgtcatgcaatgttcatgtagctgaaatattttcacatatatatcaggcttttcctatgccctcaacatgtccttcacgatgtccttcctatatagttcagcatgaggtattcgtctctactctgtcaatttctgttaaattcatagtgaactcaaattaattttaactcgagaaatgccagttagagaaattaaagcatgatatataattacaccgaggaaccagatttagaaccggagaagcattgtttctcaaggccgttcttgtcttcatatttcatggtcaaaggtcaatgttgaaaaagctgatgaaagctaatagtaaaactctcaagtctgtacccaagcaaagcacctgatcagtatctgatccaagcaagtcaaaaaaggaaagaagtttgtgtgtaacttttggcttcagactgatatgaaaggcttcatcctttcaattaaggcatagacttttgcctatctgtgatataaaatatattaacagctatagactaggaatttttacatttaagccaaaatacagccaacagagtttaaattttaagtaatttgttaaactaaattaactgaattttcaattataggttttaaatgcttagaaattttccatacgtttgttatagacctcttgttattttctagtttcaaaaatgtgtctttgcataaactcacggttttcaggtttttcacaactgcttcaataagcattacagtaatgctttttaaaacgaaacgatttcctttgctatattattgcccagttgacgttcttatccaaagccagttttgctctctgaatttacttttttctttcttctccccaaaggtgtattgatatgatacacactccttccatttcctggtttaatttgaacatgtcatcctcccacatcataatccagtccatctaccaacaacttatttttcttctgtgagactggcattgatgatggagatcacagggtttaggatgtctcttttcagttattgagcctggcccattcccagtcctaatctttttcttgttaaaaatcaattatacatatatatatttttattatactttaagttttagggtacatgtgcacaatgcgcagtttagttacatatgtatacatgtgccttgttggtgtgctggacccagtaactagtcattttttaaaaatctttgtccttttctcaaatcctccctccaacaacaggagacagctttctttaaatgtccctgctccgtcaccattttctgtgaacaagtctctgctccatcaggatgcacaacaactacccagacccatgtagtgacattccaaataagcttctctttggtcttggagccaaagaaccaagtcctaattcccaatttctcccaaactttcactatctcagtgtattctctcttctcactcttatttctatcaagacacctatgaatggccttctctttcattgaacaacagttgattcagatacaatcaattcaataactctcattttagatcagaaacatacatttatgtttagaaaagactaatcaattgagtacctaagaaaacaaacaaggagctaatttaatgtcctgttcccaagagcactctcacacagacacagaaacaaacatacactcacacatccctacacaccaactgttttactaaaatccagccacactaccttttttgtcttccttcatcaggccatgcttgtttggggcttttgaacacgcttttctacaaggctcttctcccagatcatttcatgatggcttccccttctcatcattcagtcctcaactcaaatggcacgtggttactctttatcccactatccaccctatctgacccaagtcacttttgatcccactgcccagatttcttttcttcacaggatatcactatctgcaactattttacttatttataaactgactcattgtcgattttcctacattaaggaggctatctgtcttattctctgccaaatcacttgcccctaggtgtcatgcctggcacatagtaagcactgatagatctgagtaacgaataaatgaatttacagaaatcgttagccataaatagttttcaagtgcttacaatgtgcaaggtagttcttttttcagttgaatcctaggatgaaaaatgctctgtctctcagcattaatggggcacagtaagtccatttaagagataggtccaagatcaagtggatgaagcttattttgaaaaagttctaaacaaaatatattcctaccacattagacctaaaatgtattaatacataagattaacaacattgttcttctcagctattgtttccttcacacttccccattaaacttttgatatgtcattatgtccttttatgatgtcaaaaacaattgaatggaactgaatgaaagtagttacaacgacacatacccaatttgggacctttactgccaaaatagatgggtcaaaatgatgaaacatggtaagattcggggtgagaccaaaccctgaatctttacatgttcactccctcccacattcatacaatgtacaaatatcctgactatacctagccttgacaagcgttctaatgcctctacaggtgaaaacatccattcatttaaaccaggacctttatctataaagtgccaaataataaatattttagcctttgcaggtcataaagtttctgtttcaactactcaattctgctactatagtctgaaagcagccataagcaataaacatataaacaaatgaccatggctgtactccaataaaactttgtttacagaagggggtgggatgcatttggcaaaccctgatctaacccatcagtgaagcctccaaagtttatatatggggagatttagaaagaaaatttgatcagaaagtgtgttaggaggacttgtgttagaatctgcttttctgtgatacacattttgcttttatatgaaatatatgtgtatgggggggttggaaaagattacgggaaaactgaacccctcaggtcactcttatcactgccgcctaatcctgcaatccatttgagggtgttcttggcattacattttggccttctatagattcatcagctttctctgcatattttatccatcagattatttatatcgtaattctacaattatttttgaaaagctacaacaaacactcggttgaagttcaaaatatacattccccttaaccatgctaattctgcattctatttcaaacattattaattttgtcaggcaagatttgtttataataaactcatttttttcatcgctcatgattcctttgtcttcaagatgtttactgatttctcttacaatgttttatgagaatgttgtcagataccctgtaagccattcaacattacatttacatctattataacaattctttctccctcaaaatcttttaggtcttccaaatttcccaattggaatatacctttatccaaagtataataaatacacctttacctgtttctggttgatagctactttcaaaaggtattttaaacgcattatatgtttttcaaaattgtgttttaacaccaaaacagccacacaattaaactaaaatttagtaaagattctaaatgataacacactgtcataagatacattacatattaattagcaatgttatcattttctattctccatcttatagtttctgtaataaatcctactgccaatcagctttcattatcagcccgtctaatcatgataaccaataaattgtactctatgcttctgacatccaattctgctttatctattctagctatagtgtcaaaatatttttgtagcttcaactagggtttgacaaaaatgctaaaactataaaatctaaatgtaaagtttaccattaaattatatcagcatgtcatacaaccatgatttttaaaataaaatgagaaaatacataaagtaagattttagataacatgataaagtctgcttcagtttgattcagtattcaataaataaaaccacttgagaatcccagtaaaagtaaaccttgagatggttgaaatatccattttaaataacgggaacttttaggtaattgtctctatgaaacaagaatcaggcttttgaggtcataaaatgcttgaccttcccaggtacaatgaatgcagaaagcttactactaagttacacaataggggtaagactgttgaatctatctgaaaaattacattttcaaaagctccacaaagtaactgattcattaaagaaataattggaaagattctttctctttcctcatatgaaggagaaatcacaaaacgttgcaatattttcaaaagaggatgaagtgctcacatttcacttgtgaggtttcaatagctttattacctatgctcttgctgtttgttcagcatgctgaagaaaagtatttccaaaataacataggtttgctaatccttggttcctgataatatcacatgataggataggagctttcaaacacagtcaagctgacagtcacttgctctgtactcagagggaccaatttctccctgtagacatgaatacagcacaaataataaagtgccaaaagttgagtgtaagtgcaaacccttcaacatcactcaggtatcagcaaaaagtacctgtttagctacatgtagaagtcaggtacaacatgttgaaagggagggaagattagaattgaaataatttatctgcctctgctagtttatctgcatcactgaaaagaattaaaccaaccttgccaaaggtaagtcttgtctaggtacaaactgtcttatcaatgccatctcatctattccctatcgtcttctttttttttctttttttgaaagaaactttttatttattgtttttttcacattgcaagtgatggtatccagtttctttttttttttttttttaattatgctttaagttctagggtacatgtgcacaatgtgcaggtttgctacatatgtatacatgtaccatgttggtgtgctgcacccattaactcgtcatttacattaggtatatctcctaatgctacccctccctcccccctcccccaaccccatgacaggccccggggtgtgatgttccccttccggtgtccacgtgttctcattgttcaattccccacctaagagtgagaacatgcggtgtttggttttttgtccttgtgatagtttgctgagaatgatggtttccagcttcatccatgtccctacaaaggacatgaactcatcttttttatggctgcatagtattccatggtgtatatgtgccacattttcttaatccagtctatcattgatggacatttgggttgattccaagtctttgctattgtgaatagtgccgcaataagcatacgtgtgcatgtgtctttacagcagcatgatttataatcctttgggtatatactcagtaatgagatggctgggtcaaatggtatttctagttctagatccttgaggaattgccagactgtcttccacaatggttgaactagtttacagtcccaccaacagtgtaaaagtgttcctatttctccacatcctctccagcacctgttgtttcctgactttttaatgatcgccattctaactggtgtgagatggtgtctcattgtggttttgatttgcatttctctgatggccagtgatgatgagcattttttcatgtctctgttggctgcataaatgtcttcttttgagaagtgtctgttcacatccttcgcccagtttttgatggagttgtttgttttcttcttgtaaatttgtttgagttctttgtagattctggatattagccctttgtcagaagagtagattgtaaaaattttctcccattctgtaggttgcctgttcactctgatggtagtttcttttgctgtgcagaagctctttagtttaattagatcccatttgttaattttggcttttgttgccattgcttttggtgttttagacatgaagtccttgcccatgcctatgtcctgaatggtattgcctaggttttcttctaggatttttatggttttaggtctaacatttaagtctttaatccatcttgaattaatttttgtataaggcgtaaggaagggatccagtttcagctttctacagatggctagccagttttcccagcaccatttattaaatagggaatcctttccctatttcttgtttttgtcaggtttgtcaaatatcagatggttgtagatgtgtggtattatttctgagggctctgttctgttccattgctctatctctctgttttggtagcagcaccatgctgtttggttactgtagccttgtagtatagtttgaagtcagttagtgtgatgcctccagctttgttcttttggcttaagattgtcttggcaatgtgggctcttttttggttccatatgaattttaaactagttttttcccaattctgtgaagaaagtcattggtaacttgagggggatggcattgaatatataaattacgcaggacagtatggccattttcatgatattgattcttcctatccatgagcatggaatgttcttccatttgtttgtgtcctcttttatttcgttgagcagtggtttgtagttgtccttgaagaggtccttcacatcccttgtaagttggattcctaggtattttactctctttgaagcaattgtgaatgggagttcactcatgatctggctttctgtttgtctgttattggtgtataagaatgttcgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctgtatttatttctcctgcctgattgccctggccagaacttccaacactatgttgaataggagtggtgagagagggcatccctgtcttgtgcccgttttcaaagggaatgcttccagtttttgcccattcagtatgatattggctgtgggtttatcataaatagctctcattattttgagatacatcccatcaatacctaatttattgagagtttttagcatgaagggttgttgaattttgtcaaaggccttttctgcatctattgagataatcatgtggtttttgtctttggttctgtttatatgctggattacgtttattgatttgtgtatgttgaaccagccttgcatctcagggatgaagcccacttgatcatggtggataagctttttgatgtgctgctggattcggtttgccagtattttattgaggatttttgcatcgatgttttcatcagggatattggtctaaaattctctttttttgtggtgtctctgccaggctttggtatcaggatgatgctggcctcataaaatgagttagggaggattccctctttttctattgattggaatagtttcaggaggaatggtaccagctcctccttgtacctctggtagaattcggctgtggatccgtctggtcctggactttttttggttggtaggctattaattattgcctcaatttcagagcgtgttattggtctattcacggatttaacttcttcctagtttagtcttgggagagtgtgtgtgttcaggaatttatccatttctgctagattttctagtttatttgcatagaggtgtttatagtattctctgatggtagtttgtatttctgtggaatcgatggtgatatcccctttatcattttttattgcgtctatttgattcttttctcttttcttctttattactcttgctagcagtctaccaattttgttgatcttttcaaaaaaccagctcctggattcattgattttttgaagggttttttgtgtctctatctccttcagttctgctctgatcttagtgatttcttgccttctgctagcttttgaacgcttttgctcttgcttctctagttcttttaattgtgatgttcgggtgtcaattttggatctttcctgctttctcttgtgggcatttggtgctataaatttccctctacacacttctttgaatgtgtcccagagattctagtatgctgtgtctttgttctcattggtttcaaagaacatctttatttctgccttcatttcgttaggtacccagtagtcactcaggagcaggttattcagtttccgtagttgagtggttttgagtgagtttcttaatcccgagttctagtttgattgcactgtggtctgagagaaagtttgttataatttctgttcttttacatttgctgaggagtgctttacttccaactatgtggtcaattttggaataagtgcgatgtggtgctgagaagaatgtatattctgttgatttggggtggagagttctgtagatgtctattaggtctgcttggtgcagagctgagttcaaatcctggatatcctttttaactttctgtctcgttgatctgtctaatgttaacagtggggtgttaaagtctcccattattattatgtgggagtctaagtctctttgtaggtctctaaggacttgctttatgaatctgggtgctcctgtattgggtgcatatatatttaggatagttagctcttctttttgaattgatccctttaccatcatgtaatggccttctttgtctcttttgatctttgttggtttaaagtctgttttatcagagactaggattgcaaccactgcctttttttgttttccatttgctccgtagatcttcctccatccctttattttgagcctatgtgtctatgcacgttcttatctctctttctctcctaaactttttttttgtaataatctctctctccacctaaacttttcaacttctctctctttctgtcttttttactccctccactagacatacccactctctctcacaaataaatactcactgtatgatgctaactgctaacttaaaggagatgtaattttatcactcacatatgattattgatgtgaaagtgcaagagtaaatatgtcagcaactgaaaaattagggcaacatgatccaaatcaagtgctaaatatattaatcatatacatactatgcacttctatagaaaaattattaggctataagcaatcataaagattagcataaataacctaaaaaaactattaaaagtcaagacagggagattcagctgacagagttgtatctctctttcttttcatataaagagatattcagtatgatgttgctaattaagaagtgaaacaagttagaatgaaagctataaagggaaatctctgggtgtcagacaaaaagaaagaactcaaagccagagcagaaggtggggctgaactcttggtgtccccctagagcaccatagccacatatatccatatatttgtccgcagtgtggggaaacagacaaagcctgaagccaatgagaggagtggaacagaagctgagactcccacttattaatggatgtcccctcacgcatctgtaagatttagactagaaaagtctataggtctatagactagcccagagacagagtaataaaactagaaatcttcttagggttctgggggaaaaaaaaacatagaaaatgaaacccagatacgtgccatgagtgccttaggaatcagcattgcattatttgggacagaaaactcaaagctaaaaattaacacaaaaccaattaggttttctgtagaccagtacaggcacagatcatgggtcacagaatagaaggaaatactaaattactttggaaggacccaaggcactcacagagaaaacaactttcttcacctgagaatgagctaaccataggatcaaaaactgatactcttttgttcaattcaacatctacctattaaatgcttttttaggcagataatattttagaccctgaagatatattagtgaataaaacataattcctgtttatactctcatgaggaagacaatgaatacagaaatataaaatataatgttcagtactaacaaatgccacaagagaaaagcagtacaaaagaaaatagaagaagagatggagaaacagatatgtagaaaaaatatttatagaaagactctaagaaggtgatatttgagcagaaccctgaacaaagtaaaggagtgagtcatgaggcagaagatacatcaacaggaaagaatacaattagtaaagatatagaagatttaaattacatcattttgaactaactgatgtgtaaaaacttcaccttttgaaaattgcacattctttccaactaatgtgtaatatttataaaattcaaccattatgatctaaaaagaggtgttaacaaataccaaagaattggtattacaaaataaggtatctgaccacaatggaataaaataagaaattaagatgaaaagatagattaaaaagccctatatatttagaaactaaaaaaacattcataaatattccatgagtcaaagaagaaatcataattgaaatattaattatttaaaatgaacacaataaaggcactacatatcaaaacctgtgggatgcagctaaagtggttcttagtggaaaatttatggctttaaatgcatatattagattttttaaatacgtaaaattaattagtttaggatctcacttagcaagttaaaaaataatagcagaataatccatgtaaaagagaaggaaagaataatgattagaacaaaaattaataacatgaaacaaatgtacaatagagagtatcagcaaaaccaaaatttgttctttaagaagaggtgtaatatattaggctaaaccatattattttttcagtattcaacccatagtaaaacttatgctgatcaaaaaatattaatcattaaatatttaagaaagaaaatagaggcactgattagaaactttaggaataaagagaatgtatctcaaacaatataggaaagatttaaaataacctgagaatatactaaacaactaaatggcaatcaatttacaaactcaaatgaaataagcagtttcctagaaacatgaaatgtaagaaaaatatgtaattagaaatagaaaacctgaataaatttatgatcaataattgagagaaaaaataatctcctgacaagttacatctcacatggtttaacagttgaatcctgccaagcctttaaggaatggataatcgtagcctgatataaactattacagaaagaaaaataaatatccaaacttcactgtcttcttacttttttctcagagcacttagtgtcttagtaatattttcacaacaaacttagcttaaaagtatgtaacagatccattaatttagtacttaggtctaaacaattaaataagtatttttgtcccagcaatacagccatatagaaataataaacacaaatttttaaaaattatttttacttcattcttatatagccatctttaagtttattattattgggatgtgtgtgcctgtcaggcactgcacaacttttcaaaccttgaaatctgattggacactgccacacttatttcctgttctatattgattttcatgcagtacctgctttctatgacagcaaccacaaaaaccaagcttcacgaagacatgacaccatcaggatgaatttactgaaatcccacgctaaaactgaactattcagggtagtgtctgacctggtgtctgacagatgttgaatattgctacgtttctcttaaaaattttaaatagctcatggcccacctgtgagttcactgtggccctacaggagtgccttggaacatagattgcaaaccatggcattatggtgagaaatgacttatgtaaatttttaagtaaacaaaactgcaccgaatgttcatggataagtgtgtgcgcatgtgctgcatgaaatgaaatgaaaatataaaaatagtaaaaatatgaactgaaagcatatgcattaacttcagaagagtggttacctctagggacaaaaggtggaactgtaaacacaagggaacttcaactatttctgcaatgactaatttctgtaaaaacaaaattcaagcaaatatggcaaatgctaatgtttttaaaatatgggtgatgggtatttggtatttattacattaatttcgtgccttattatacttttgaaatagttcataaaagaaaataagaaatgacaagcattgtgagttttcaaaagcttcatataggttgctacttttagcatgccattctaaatcccaggacatctggttactgttagacctgcttttctagtttccatttagaatcattaaactatccattcagagtagtcttaacatttaaagacaaaaaatcatataaagacccctatttcataagcttcaccctaagtcacaaatgctgcttttatttagtaactttgaaaaaatctcagcagaaatcagatataagtgctttctattcacttcttcaaaatatacttattttctcatttcagttattgaaaataataccatagtatgatagaacataacatgtattcatttagtgctatcccaaaccccacaaatctctggtctattgcaagaaatatactcattttcaaacttagtattaatatatttattttgtaggatactaaccaagtcaaaaatgaaactacattgaattaactgatgattatgccagatgtacattaagtttgtgttagtcacgtatgccagttcctcacatccatctcccctttaccttctcccaaccccaacttttcaaaataaaattaatattattcattagaagcaggaaactatagagggaatgtcagcaaatgtcagaagttccatgtatcagtcaaggatcaaagaagttccacaataataacatgagctacaataataaagtaaataagatagcaattatcccaccttactctgaactggccagatcatggcacatgtcttttattatgaggacactgccttatcaaaaagcctaaagagaaaaacatgtagaatggtgagaaatcttatttttttcttttcttttttttattattatgctttaagctccggggtacatgtgtagaacatgcaggtttgttacataggtatacatatgccatggtggcttgctgcacccatcaacctgtcatctacatgaggtatttctcctaatgctatccctcccctagcctcccaccccccaaaaggccctggtgtgtgatgttcccctccctgtgtccatgtgttctcattgttcaaatcccacttatgagtgagaacacgtggtgtctggttttctgttcttgtgttagtttgctgagaatgatggtttccagcttcatccatgtccctgcaaagaacatgaactcatccatttttatggctgcatagtattccatggtgtatatgtgccacattttctttatccagtctatcattgatgggcatttgggttggttccaagtctttgttattgtgaacagtgccacaataaacatacgtgtattttttataacatacacatatgtctttatagtagaatgatttataatcctttgggtatatacccagtaatgggattcctagatcatgtggtatttctagttctagatacaagataaaaacaaacaaccccatcagagagtgggtgaaggatatgaacagacatttctcaaaagaagacatttatgcagccaataaacatggaaaaaaaagctcatcatcactggtcattagagaaatgcaaatcaaaaccacagtaagataccatctcatgccagttagaatggtgatcattaaaaagtcaggaaacaacagatgctgaagaggatgtggagaaataggaacgcttttaccctgttggtgggagtgtaaattagttcaaccattgtggaagacagtgtggcaattcctcaagaatggtgagaaatcttaaacagtaggggcagttgaggcaactagagaggtttaacttggaaaacagaagacaaagagagaaatctccagtatcaccatgtttttggtagagtattatgtggagagataatcaggtagttacaaatcactggaagacaagagcatggatctccaggaatgactgctagatccacagtgtagaacctttggggtgattaaaacgttctggaattagatagtggtgatgtttgtacaaccttgcgaatatgctaaactctattcttgaaatgtgtgaaattttatggtatgtgtaaaacaaatttttaagtgtccattagattcagtaacatgattagtataatccaaataatacatgaaaagtcaaaaagcaaacaataaaaacaatggtttccaaagaaataaagtaatttttcaagacagattgaaatgttaggaaagagttttctttttcttttctttaaaaaaaaaatagtgaagggcttgaacaagttcgaatgttgataacaaaggagtttacaaagagacaaagcatgaagacatagaaaagataaaattaatcaatactgcaaaatttctaaaaaagtagaattagtgttcaaaacataggtaaacagattagtctttttaagtggtaggttaatttctttttacaaaacttcatgaaaagaggataccactagctagtcccacccagctgacccaggatatttacagattttatcttgggatgttaagcatgtacttagatggatgtgtctacttttttttgactagatgataatgtagtctgctggggagaagaaggagcaaaggtagaaagggtaaataatttgttcaacattagccagctagaaatggatagatttcatttttgaaatcatttatttttttaggatatatttaaggtgctcagcatgttttgatataactataaatagtgaaatgattactacagtcaagcaaattaacttctttttattttgaagtgattatatacacacatgaagttgcaaattagtatagataggtcaaatttacccgttacccagctttccacattggtaccatcttacataaccatgtacattatgaaaatgaggaagttgacctagtacaataaaataaacaacaaattttatttggatttcatcaatttgtgcatgcactcattttttgtacgtctttgtatcacatgtattgatataaccaccaaaaaaatcaagatacaaagctgttgtgccatcacaaaagaatttgtgacctctttatatgcctgaccttctgaaacctctgaaaataactagacttaatcataagagtaatgggaaactactgaagagtattaagtgataaagtcacatggcagactgtttcatgtttccctttatctcaaataaaaacaggggtgcataactgaagaaagaagaggcattagaatattatttcaataactaaggtaaagcatgatgatgtagaatagaatagtgactctagatatgcagcagagtggataatttcaaagatgtagattcaaaagaatatggtagttaactgaatgtggtagtcaggaagggatcaagctgagcttacctgacttggatatctgggttggtggtaatatcattcacagagatgtgaatcatgagagaagtggcttggatgtgctaagtttatttctttatatgtcaagttacttatgggttattcaaatgaagatgtctagaaggtaatttggtattggagtctgaggttcaggaagaggatcttgtttaagataaagatgtggctgtaattgatccatatatagtaactgaagccagaaaattgggtaagatcaatcagaatatggtatcatcgaagtcaagagaaaagaatgaggatagtggagggaaaaggaggggaaaggaggggaggttggggaggggaggggagggaaaaggaggggaaaggagaggagaggagagcagaggagaggagaggagcagggaaatgaaaggaggaaggaaagggaagggaaggggaagaggaagggggaaagggagagggagagagaaagggaaagggagagggaaaggaaaggaggaaggaaaggaaaggaggagggaaatgaaaggaaaggaaagggggagggaaatgaaagcaggaaggaaaggaaaggaggagggaaatgaaaggaaaggaaagggggagggaaatgaaagggggagggaaattttcagggcaaaacagaaagaatggaaggacagaaagatggaagagaggaaggaaggaacttgcacaaattgagggcacatgtaaaaacttcaaatatcatgtactcattacatataatttgtgctatataaaacttaatgcaaacttatcagcttttctttctttaaacctactttttttttacttactgtttttccctcgaaaagttctttattcttagaaggaatttcctcaaatatttatattcgataccaatattttttctaaaatgaaacatctctattttcttggcccaagaactgtggtaactagcttgaaaacagtgctatatatttgttatgtcaggaaaaatatagttgaatgaagtgttctctttcccataaagaaaaaagagtttcaagctacatttaagttttctttatactaccacctctccaagcgtttcagctatcattgttttttaactgcctctataatatacaatatgcagccaaatatttggagatattttggtcaaaaggtatgttagcaacaacaatagaaataataaaacaattctcaatgataactgaagctattgcataatttaaataaaatggaaaaagtcagcatcaactttgaattcattggcctttgtcaatttatgttgcaatgttatatttgtttaaggcataactctgaattcatttaatgacctagactatttagtgttggactttcatttaaaaaaaaaatagcaaaataaaatgccatctcgtagagtgctatttaccatatgagatccatctggcaataccatctaatatttaactttgaaggcactgttatcaaatagttgctctaaagtgcttataagaggcaaattcttctggtttttcttctaaggcatattatattactgataattttaggataacagatctgaatgtagatgattttaaatgttgattacagcacattatttaatattttaaatattgactaattcatttttaaattatttgtaaattagcagactatttcttttataaaattaaatattttgtattctcccaccccaccgctagaagtctttaaggggaatattataattttaaaataaaggatttaaagtaacagtttcctgttagttttgtggactgttttcttttccagtaatattttgagtccagttcaccataacttaccaataccctttcacattgcccaacccctagaaacacttaacagatttttctctccataggttggctatattcaaaagaaacattggcctatcaggacctctcagtatccatgttgtggacaagaccaaagagaacttaacactttgaaaacagctactttaccttatgtgcgactcataaacatttaactcagtgttactcagtgatgtgctgccaaaagtaatttaccaggttccaaatgctatatatctggataaactggtctccaaaagcaaacaaacaaaaaacctcattatatatttttaaagaaaaatgtggcccccactactaggtcagcagagaattctgagaatatataacaagtcctatgacttcagtcccaaaagctctggcacaggaaaacactataaacttcttgcaacaagagaataccatcaatactagcagggacatgcttatgtctacatttaggtgaactagcaaaatctttcatctgatatgtactaaattcttgaccattacgaggaaaaaaattatatctgaagtggcatattctaaacctgatgaatttcccacaaatcaaaaaaaaaaaaaaacaaatttctcacaagttaaaaaaaggagcctatatttcaaactattacttgtattgtaggcttctgaacaattttattatactcttcagtgttttccaggtttgttaaaataagcactttaaaaacaggaaaaaataagtttgaaaagataaattctagcactctattcctacaagataaagaagtcagattactcttttatatccaatggaatacatgaattagacttataagatggttggaaacacaccacaccacatttaatacacattccagaataaacttcaaataaaaatatgagctgttgaccaatagcagtattataaatttaaaatggggagctttttttaaatcacatattaaaaaagaagaattgggaaccatgtggaagcaaagagcaatttaatatacatacacaagtttagggattttttttttaaagagaaattgagagtcaggcattaaaggtatacaaaatttgtgtctcaatatattaccaattaaatattgaaatgtaaaattgaaagcacaacacctacactaaaaccaaaaaattaaataaattcttcatataaaatctaacaaaatatgtataagatctattatgaagaaaactacaaaactctgatcaaaggtatcaaaaaagaactaaataaactgagagatattccatgttcatggatagtaagactcaatactatcaaaatattacttcttcccaatttaatttttagattcaacataatcccaatcaaaatcccacaaagttattttgtggatattcacaaactgattctaaagtttatatggagaggcaaaagatctagaataggaaacacaatattgaagaaagagtcagaatgctgacactacccaaccccaaggcttactatatagctacatgagtcaaggtactgtggtatttgcaaacatacaacttagatcaatggaacagaagagagaggccagaaattgacccacataagtacagtcaactgttctttgacaaagaagtaaaggcaatacaatagagcaaaagtcttttcaacaaatagtccaataactgaacatccacatgaaaaaaaatctagacactgacattaaattcacaaaatttaactcaaaataaatcatagacctaaatgtacaatgcaaaactgtaaaacttttagaagataaataggagaacatctagttgatcttgggtttggcaataaggtcttagatataacaccacaagccagatttatgaaagaaataattgacgttagagtttattaaaattaaaacttccatatttgtgaaagacaaatcacagactagaagaaaatatttgctaaacacatttctgatattcgaccgtcatccaaaatacaccaaaaactattaaaactcaagaagaaaaacaacttgattaaaatgtgagcaaaagatctgaacagacatctcaccaaagaaatgcagatgaaaaacctgcatagaaaatgatcaacataatatgccattagagaattgcaaattaaaacaatgagatatcactaaacatctattggaacggctaaaactcaaaatactggcaacaacaattgccgtcaaggatgtggagaaatacaaactctcactcattgctggtgggaatgcaaaatgctatttggcactttcttaaaaaattaaacatacacttaccatatgatctagcaatcatactcattggtatttcattgaaaattatgttccacaaaatcctacacataaatgtttatagcagcccaatttataattgcaaaaaaattggaggcaacgacgatgtctttaagtaggtgaatgcatgaacaaatttctacatccatacaatggaagattattcagcactaaagagaagtgagctattaatcatgaaactatacagggaaaccttaagtgcatactgctaaatgaaataaaccagtctaaacagctatatcccgtatgattccaactatatgacattctggaaatggcaaaactatagataccgtaaaaaagatgccagggtttggaaatggggagggataaacaggtagagtacagaggatttctatggcagtgaaagtaatttgtatgatattatgatggtgggcacataacatcatgcatttgtcaaaatccattaaatgtacacccagtgaaccctaatgtactatagttataataatgcatcaatattggttcattagttgtaacaaatgtaccaccatagttaataatggggaaaagtggggaggagaagggtgaatgggcatacaggaactctactttctccccaggttttttttttgtttgttttttgtttgtttgttttttgtaaacttaaaactgctacaataattaaaggctattgttttagttaaatccatttatttctaaaatttaaaacaggaaacataaaacaactaagtttaagaagctgagtgtggtgatatgagcctataatcccagcaacttgggaggctgaggtgggaaaattgcttgagctcagaagtttaaggttagcctgggaaacatagtgagcacgcccctactaaaaaacaaaacaaaacaaaacaacaacaaaaacactaagtttaacaaatattatgtttgcaagtgtcaggtgacaggcatgtttcatttttttcaatattacctgtctagtgaaatcaaagataaatatgtagctgaattttacttactgtgaacaatcaggtggtttgaatttctcttttcagcagtagaaacaaacgttttggaaatcaatatggatttttaaaaactccaaaaaacattaatttgtatttattaatattatgtcttcattattatattgtcagaacaaaaggattcaggttatttataaaatttttaaaatgtgtgtttttatctaggaatatagtcattttaaaattaatgctactgtcaggatgaaggcagggagctctgatacttttcaaaccacctattctagcacttgagatctctgcagaatttgggcctatactgtcatgagaacttgggatttcaatagatctgctcgtggtttcaatctctagttggtctgcaaagaaattaactctgtgctactgcccaaaactatcccccaactttcaaggtttcctgccttgaaaacatgcacattttgtcctcaaaagagtacagaaaggtacctataaaacctgcactgctatggtctaaaatgaccaaaaagatgccttgcctataatctccgtatatgcaagactgaacattacattacatggaagtattctgtaaccaagagtctttgcctttaaaacaaaatatttttttttccttagaggatagctatttggggacttagcaaaactggacaactctcagaaacaagtttttcttcagtagaacacacactagggtttgtgcctcttttctttgttcagttttatacatgtataaaggaaagacaaaaaacaagagggtctttcatttttccacagttccctttcttgggtgccattcctctcattgttcatagatgaatattcagcgtattcttctcacacagaacacttggccagttttttcttttgctctatattaaagggcataatatttctttaactgaggaagacatatttataatataattttggattaagatttttatttacaaatcatttcatagaaagtttctctaaatttttagcaagagatatttggctataattggtcagatttatctgtcttcatttcaaggatctctatggtactgaaatttctgtttaaagaattttaagtaagttcatttatatacagttcatgcaacttatttacttatcccccttcaacatgccagccatttctttccaaatgttaaacagagttactaaaagttatgtgtgtgtatgagtgtgtgtatgtgtgtgtgtgggcctgtttatgaaggagaagcagagacagagggaaagtgggtagtcattgtattcaagccaacaaccccatttcaaaggagagggattcttaccctgaaaatttgttttcaattcttcacttttaaattaatacatttagaaaaggtttaatagaatgtggctgaacctcaattaaataaaaatttccacctcttgattttatttttttgttgtaattaattggtcattgggtttatctgtatacattttatctgtatttgtatttattgtatgtgtatttgtatttatttgtataaatttatctgtataaatttttaatgaccccaaatatatcatgaaaacatttaaatgttttcctttatctaggaaattatacacatgtttgaaaaccaaacagtttatatctgactagatgtttagttgctattactattttgaacttggaatggacattattttaaaataagttatttgtaaagaactgagatttactgcatcctaccttatgtcaggtactcatgtcttgtctcaaatcatgttctgaacatctctttgcattaatataattaatcccagtttacagaagacaaaattaagaaccaaagagagagagtaggtaacaatcaaggtgattcaggacttaactgacaaatctatcaacttctctctacctctactgctgccttcttagttgaggtcactgtgatttccatcctggaccactgaaccactgtattcaccttctaactggattcctcactaactgccttgataattccaatccattctgcaccagaagcaggtttattatgggactgtgtcatacttccctggcttcccatttcatttagggcaaaattctatgaggtctgtctctccatttctctttaacttcatttcaatctactctctttttagctcacagcattctacccacgttaatgtcctttttgttcctagacattgccaaatgttttttttttcttttttcttttttgttattgctttctgatctactataaaatgcttttcttctatggaggcttcaaacatcctattccttgccctggatttctgcatcactggatccttcttatcatttgagtctcaacagaaacaccacctcttaaaatggtcaccctctgattcttgcccagacctttgttagttactgtcagaaaaaaataacttctttatgtacaatgaactagtttgcttgtttgtttgtttgtttatcatctattcctccactccctctccattccccctccatagtaggacaggaatattctattttatttactaccctcatatagtttctagcacttcgggtactgaataaatatttgctggatgaatgaagtctttgttttctccactctaaaatgtgctcatattaattaaatatagtcataaaatttatccagttggatatatatatatatatatataaccatttgtccttagtaaagcttgaaatatgtgaaatcatggcacttcttttttttcccctgaatattatttcttggtcagaacattatcttcctccttggcaaaaatatattgtgcctttatgttttagcaaagtatctcaaagaatcatataaccgtagcaaaatggagctgaagggcaccttagagcccacctacccctatcatgcacctggcacctgagcctcttctacagcatcaagtggccactgagacataccaggctggaggaactaagtaccttttaaggcaacacatctaattcttagtgttttaatagcctaatatttgtttagcgttttggtactaatacattccaagtttctgctgtctactgacttttcactatttgttcccttagatattcatttgaaatctttttagtttaacctgatttagctgtttctttttattaaaaaaaactcgaggtaacttcttttctgatttaatgtagcaataccagaaaatcccttttgagtttagtctttcagattgttagtaaacttaatgatgagaataggagtatttgttatttttctgcaaaatagttctatctatatttctttctacttctcattgtgcaaagtctgttctttcattaagacactgtaattacattatagtcagtatgttttaagtaaaattctgagattcctttactttttcttgagtcgtctaaaaaaatatgttttgataaaatcaagtgaaatatcctttatgacttcaacttcttctggaaatacttgtcctctatatattttatcacttaatttgccaattatgtctactccttttgaataaggaggaaataccattttctgaaataaaaaaaagagaaagagaaaaaacagaaattagagaatattttaaacaatgtgttttatgtgttttttaaatgtcatcaaactcattcttcaggactttactcataataagctgttcaatgaatacttatttaacaatcgctctgtgttctattacttatccctttttctcacttatatgctcaactttttattctttataagttctttcttcttagcatataaacatgcatgattatctcccatcaaatatacataaaaataagcatacaatagaaaagaaagaaaatccttttttgaagatttgctctgttaccactttcttctctattatttctagtcaaatctttgaagagagtttttacttctttacccctcatcctgtttacagtccactgaaaactgacttctgcccttataacataatttaattattcccaccaagatcgcaaatcacaagacggtcaaatccaattgaatatattttgacttgaccttactttatatctcagatgttttgacattcttgacaactcctttctttcaaaaacactgtcctctcactggcttcatactttttggctcttctcctgcccttttctcttcctttgcaggctcttctgcttcttcttgaccctatatatgggttcttcttctgctttccaacagtctcttgctctcacatcatccttttccttgagtgattatattcacatcttcaacttcaaacatcacctttattttgatgactctcaagtctgtagctcctgcccttatcacagctcttctatatctctccagttgtatacatactgctgactatggaatatctttagctgaatgccccatagatacttcaacttatgacatatcaaactgcagtttttaaatcttcactccaaaatgatatttttctgttattcccgtctcttttaatggcactgtcatccaccaaggggatttggaagaaccttgagttcaagccctttcctttgtttccctacagttgccctgtaatctgtatgctgagggttaaaggcagggctaggagaaaatatgtttctattagatgagatgtatcatcaatattcaactggtattagaaaaataaccataaaaatgctcctgataataagcagctaaaacataaagaacatctttttgtaagtaatcgtgaacaatgtttgagagatagaaggatcattcaataatctaaaaattctaaacataattttacatatgaaaaaacagtcctagagaggaaagataaatgtctaatataaaagtaacttaatgaaaaagtgtggactaaaatctagatccacttctgtaagttttgtatttccttggtattagaagtaacttactcctccctgtccctgatctatgtaatggcaaacattttttcttggtaggagataaatcaggtcattacaagcatagaaagcaagatttaaacaaagtatatctgtaatacaaatttctgctagtagaatgtacctacattttaaaaagtgagagttctttctcagctgctttctaagtaatttacactatttatgctcccaccaatcctgtatatttcctatatgctcacaaaccatgaatattatctaatttgtaaaaccttgtcaatctgataaggaaacttagtatgtgtgtatgtaagattgaatatttttatacgttattggacacatatttttatgaattatgtttttagatcctttgaacattatctactgggttatttatatttcttgttcttgaattttcttctgtttcttggataatgttttcttctggaatgtattcttcaaatttttttaatgctatatatttttgttctgtattatttttacagttatgtcatctcatttgaatgtacaatcactatatagcccttaatctatatggttaaaaattgtgtgagtaaaaactctttgccactctccccaccccatctgaattcagattgacttatcctgtaagcttttattccaggactaaaattttgctttaacaaagccaataagcccaggtgcttagtttctcctacatacctattctcccaacaatgctttctcatcccctttcaggcagtgagaataaatccagtaaaataattacgttctatcacattattagtccagagctggcaagtagaggttacatatgtgcatgttcatgtgcctctacaccagcttcctcttcctgagatgactaggtatttactgtgatttgaatgtatccctcaaagttcatgtgttggaaactcaatctccaatgcaacagtgttgaaaggtgggacttttgagagatgattaggtcatgagggctccacactcttgaatggattaatgttatcacagcagtagctttgttataaaagcaagtttggctctttcttgctccccatttgatgagctctttcaccatgtgatgccttctaccacgttgggatacagaaaaaaggccctcactagatgcccaacacccttttatagggcttcacagcctcgagaacagtgagcaataaatttttctttatacattacccagtctgtggtattctgttatggcaacacaaaataaactaagacagtattatgtattttttcttttgttttacattttactaagtgccgacttattcgaaaaggtaattagctttggttaattatcaaagttttgtctttcctttcctacttttgtcccactaagcaaaaaacaaaacaatgagcattgacctttacctttctctggtaagggagtatggaaggttttctactactttgtaaaaatactgctacagatggtacttctggacccatgtggaacctgggggtccttgctgtcctgaagagaagtacacaggcctggctggcttttccacttactgattgtagaatctcaggcattgagcaaatataggcagtagccagggagcagttacatcaggccttaggtgaaacccactgctgtgctggcttcaggtctgacccaacacagtcatagtggtgatggccacaagggagcttgggttactccaccctgcaaaggagcttgggtcactctgagctttgcatagcttagagcagagaaagaaggactctgtattcttgggagaaaacaaggaaagagaacaagagtctctgcctggtaatcaagagaattctcccagatcttagccaagaccataaagcttatacctctataaatcagcaagaaccacagtgttattaggcttgggatgcccctaaagtagatatttcttagatcacaacattcaggtcttttcaaatatctggaacatctttccaagaagggcggctacaaataaacccagaaggtgaagactacaataaacacataactcttcaatgcctggacaaacatctataagcatcaacaccatccagggaaatgacatgacatccccgtatgaactaaataaggcaccagggaccaatgctggagaagcagagatatgtgtgacctttcagacagagaattcaaaatacctgtgttgaggaaactcaattaatttcaagataacacagagaaggaattcagaattttatcagataaatttaacaaagagaataaagtaattaaaaagaggcaggcagaaattctggagctttaacatacaattggcctactaaagaatgtctcagagtcctttaacagcagaatggatcaagcggaagaaagaatcagtgagcttgaagacaggctatttgaaaatatacaatcagatgagacaaaagaaaaaagaataaaaaacaatgaagcacacctacaggatctaaaaaatagcttcaaacaggaaacctgattattggccttaaagaggaggaagagaaagagacaggggtagaaagtttatccgaaggaataataacagagaacttcccaaccctagagaaatatatcaatattccaagtacgagaaggttatagaatgccaagcagatttaacccaaagaagactacctcagggcatttaataatcaaactcccaaagatcaaggataaaaaaggatcctaaaagcaccaaaagaaatgtaacaaataacatacaatggatctccaacacatctggcagcagacttttcactggaaactttataggccagcagagagtggcaggtaatatttaaagtactgaaggaaaaaatcttttaccctagaatagcatatctggtgaaaatatccttcaaacatgaaggagaaatgaagactttcccagacaaacaaaagctgagggatttcatcaacaccagacctgttctacaagaaatgctaaagggagtacttcaatcaaataaaaaaggatgttaatgagcaataaaaaaatcatctaacagtacaaaactcactggtaatagtaaatacacagaacaacacagaacattttaatactgtaactgcagtgtataaactgctatctcttaagtacaaagagtaaatgatgaaccgataaaaaaaataaatacaactttttgagacatagtacagtaagatacaagtacaaataataaaaagtttaaaagctagtggacaaggttaatgtgtagagtttttcttagttttctatttgcctgtttgtttgttcatgcaaacagtgttaagttgttgtcaccttaaaataattgcttataagatagtagatgcaagctttgtggtaacttaaactttaaaaaaatacaatggatacacaaaaagtaaaaagcaagaaattaatcatatcaccagagaaaatcatcttcacgaaaagaaaagaggaagaaaggaaagaaggaagagaagaccacaaaacaaccaggaaacaaaaaacaaaatggcgggagtaagttcttacttatcaagaatacattgaatgtaaatgaactaaactctccaatcaaaagacacaaagtggatgaatgaacaaacaaacaaaaaagatccaatgatctgttgcctataagaacacacaatacctataaagacacatacagactgaaaataaaaggatgggaaaagatattccatgccaatggaaactaaaaaagagcaggagttgctacacttagaccaggcaaaatagattccaaggatgaaaactataagaagagacaaagaaggtcaccacataatgataaaggggttgattgagcacaaggatataacaattgtaatataggtacccaacactagagtatccagatttacaaagcaaacatttttatagctaaagatagagatagaccccaatactataatagttggagactttaacaccccactttcagcattggacagatcttccagacagaaaatccataaagaaacttcagatttaatctgtgctatagaccaaatggatctaatagatatttacagaacatttcatccaacagctgcagaataaacattcttttcctcagcacatagttcatactcaaggatagaccatacgtcgggtcacaaaacaagtcttaagacattcaaaaaattgaaatattatcaagcaccttttctgaccacaatggaataaagccagaaatgaataccaagaggaattctggaaactatacaaacacatggaaattaaacaatatgttccagaatgacaagtggtaaatgagtaaattaagaaggaaacttaaagatttattggaacaaatgatagtaaaaacacaacatgccaaaatctatgggatacagcaaaagcagtactaagagggaagtttatagctttaagtacttacatgaaaaaatagaaaaacttcaaataaacaacccagtgatgcatattaaagaacttcaaaagcaagagcaaatcaaacacaaaattagtggaagaaaataaataataaagattagagataaatgagtagaaaatgaagaaaataatacaaaagatcgctaaacaaaaagttgttttttaaaaaaaggtaaacaaaattgacaaacttttagacccaaataagtaaaatcagagatgtaaaaggagacatcacaactgataccgcagaatttaaaggatcgttagtggctgctataaatagctatatagaaagaaatagaaaaatttggaagaaatggataaattgctagacacatgcaagctactaaaattgaaccaggaacatatccaaaacctgagcagaccaataacaagtaatgagatcaaaaccataataggaagtctcttagcaaataaaagcccactacctgatggcttccctgctgaattttaccaaacctttaaagaacacccaatcctactcaaatactctgaaaaacagaggaggaggaaatacattctaactcattctatatttgacagtattaccctaatgttcaaatcagaaaaaggcacaacaaagacacatttcggatcaaatggctttgatccaaaagacagtaacaaatgctggcaaggacatggagaaaagggaacccttgtacactattggtggaaatgtatattagtacaaccactatggagaacagtttggaagttcctcaaaaaactaaaaacatctaccataagatccagcaatccctatatgtgtgtgtgtgtgtgtgtgtgtgtacactaaaaagaaaggaaatgagtatattgaagatatatctgcactcctatgtttattgcagtgatatttataatagcaacctaagtatccatcaacagatggataaagaaaatgcagtatttaaacagaatgcagtactattcagccataaacagaatgagatcctgtcatttaaaacaacattgataaactggaaattattaggttaagtgaaataagctaggcacagaaagacaaacttgatatgtttgaacttatttgtggaagctaaaattaaaataattgaaccatagagataaagagaaggatggctatcagaggttgggaaagatagttgtttggggtagggggagaagtggggatggttaatgggttaaaaatagttagaaagattaaataatacctagtatttgctagcacaatggaatggctatagtcaaaaataatttaattgtacattttaaaaaaactaaaagtgtacaattggattgtttgtactacaaaggataaatgcttgaagtggtggatactcgatactccatttactcttatgtgattattactcattgcatgcctctatcaaaatacctcatgtaccccataaatatatatacctactaagtatccacaaaaattaaaaataaaaataataaataaatatttttattgagtttttttctgtgaattatacaatctcctaggctcttagtctgctaggagatgtagcgatgaaccaaaaagtgctcttatggatcttagggtatactagttaacgtagaagggttgctctaaatttcaaagtgtctgtttatcaaagcatctatgattatcggtgtcttttttgttttttgtttccttattgtttgtttttcatttgagtacttttctcattaaaacactagcttaagcaacatgtcaaggagaaagacaagacaatacaaaagacaacaaaacaagctcttcactgcattgcctcacccataaacttataaagtggctgtcactttataaaaggctaagaaaagctatttcgctgaaaaccttattgactgttttaatgacatcacatttgtagttctgttatgaggaaataaatcatggaaggagtgaggagaagtttagcaatagttgtggtcttacttgctgtgtggtgggtctcagatgccctatatgctatgcaagtagaaatcattgcttatcattttaatgtaagtttgattggaatgtgactaattacataatagttatacaaaaaaacatattctagatcagctaattaagcaatataaaatatgttttgtgcacaaataaagaaacatattgtttcattcctataagatacataaataaagttattttggactgataaatatttttttcaactttcaaaagttccagggtacatgtgcaggatgtgcaagtttgttacgtgggtaaatgtgtgccatggtggtttgctgcacagatcaacccatcacctaggtattaaacccagcatccattaactattcttcctgatgctctcacttcccccaacccaaacccctgagaggccccagtatgtgttgtccccctccccatgtgtccatgtgttctcattgttcagctcccacttataagtgagaatatgtgttgtttggttctctgttcctctatcagtttgctgaggataatggcttccagctccatccatgtccctgaaaaggacatgatctcatttctttttatggctgcatagtattccatgatatatatttactacattttctttatccagtttatcactgatgggcttttgggttgattccatgtctctgttattgtgaatactgctgcaattggcataaacgtgcatgtatctttataataaaatgatttatattcctttgggtatatacccagtaatgggattgctgggtcaaatggtatttctgcctctagatctctgaagaatctccacactgtcttccacaatggttgaactaatttacactccccccaacagtgcaaaagcattcctttttctccgcaacctcaccagcatctgttgtttctggactgtttaataattgccattctgactggcatgagatggtatctcactgtggttctgatttgcatttctctaatgatcattgatgttgagcttttttcacgtttgttggctgcataaatgtcttccttgagaagtgtctgttcatgtgctctgcccactttttaatgggattgtttgttttttcttgtaaatttgtttaagttccttgtagactctggatattagacctttgtcagatgggtagaatgcaaaaattttctctcattctgtaggttgtctgttcactctgatgatagtttcttttgctgagcagaagctctttagtttaattagatcccatttgtcattttgcttttgttgcaattgcttttagcgtttttgtcatgaaatccttccccatggctacatcctgactggtattgtcagattttcttctagggtttttatagtttggggttttacatttaagtccttaatccatcttgggttaatttttgtataaggtgtaaagaaggggttcagtttcaattttctgcatatggctagccagttctcccagtaccatttattagagggaatcctttccccattgcttgtttttgtcaggtttgtcgaagatcagatggttgtaggcatgtggtctcatttctgagttctctattctgttccatgggtctatgtgtctgtttttgtaccagtgccatgctgttttggttactgtagccttgtagtgtagtttgaagtccagtagtatgatgcctgcagctttgttatttttgcttaggattgtctttgctttttgggtgctttttgggttccatatgaattttaaaattcaacatcccttcacgttaaaaactctcaataaactaggtattgaaagaacatacctcaaaatagtaagagccatatatgacaaacccacagccaatatcatacagaatggacaaaagctgggagcattcccctttaaaaccagcacaagacaaggatgccctctctcaccactcctactcaacatagtattggaagttctggccagggcaatcaagcaagagaaagaaataaacatattcaaatagggagagaggaagttaaattatctttgtttgcagataacaggatcctatgtctagaaaagcacatcatctcagcccaaaaccttcttaagctgataagcaacttcagcagtctcaggatacataatcaatgtgcaaaagtcgctagcgttcctatacaccaacaacaggcaagcagaaagccaaatcatgaatgaactcccattcacaactgctacaaaaacaatgagatacctaggaatacagctgacaagggaagtgaaggacctcttcaaggacagctacaaaccactcctcatggaaaactagaaaggacacaaacaaaaggaaaaacattccatgttcatggatagaaagaattcatatcacaaaaatgaccatagtgcccaaagtaatttatagattcaatgctatttccattaaactatcattggtaaatctttttaagaaaaatttatagtataaattaatagtttaaagatggcaatttttatttagatagatcaaaaaaaatgctgtcacagagagatgtgaattgaactacctattgaggaagtatgttatcattaatgctttctcacaatttctttcatattaaggattttaaaaagttaaattatatacaatttcatttgtatcatcactatagtttctttatcaaatatgtgttgagtaaatgctgtgtttcagacattgtgctggaattggagatataatggtaatgaaatgaaggatgcctcatggatcttacagtctaattgaggtagaaatacaaatacacatacatatatacaacacatatgcacatactaaataatcacacaaatatatgaatatttactttcagataatgttactaaattgtggttatttctgtgctggcaagaaacacccagtttcttgaaatttacttttcaatgacttcttccaaatttaatcctgtttatgcctaaggatttttgttgttgtttttttaatctcttaaagttgcacattgaatcactgctgatttgtatgcatgaagttaccaggacttctaattttgtaccaagtttatatgtgctaatattttccattagtaaagaagactgaaagatgcctcagttgcctggaatttatgccaccaaggaaaaacagtgattagtgtgtttaaagagttagatcattgggttaatcatgctttgccatagtatcattgctatcctttaaataaaaaaaaaaggtttagttagaaaattttttaacaagataaaattaaccacagactataacgaaaagtaatttcagcaggattatttattctcccaaagttgaaaaaacaacaaaccaaaaaaggtgtatatgtgacatctacttaattttttaaatatgattatttccatcttttgttctttgatctccacatgagcagagacacataaagtggcaatggggccaagggtgctagatggcttggcattcattaactatggcaattagcaccatttagattgatatgttcccaagatgaaagtaagaattggactagacaaaaaaaatgatgatcgcatttgtgaaagtggaacaacactgaccaacaagaaacaaagaaacagagctcaccttaaaagacttggaatatttgaaaaattgattatgagataagataatttcaacataactacaattccttgaagagttattaatgcttcggtagcattaaagtaaaatgaaaagacaccagggcagtctgctttaatagcttgctggcttgaaccctaatacataatgttcttgtaatagtttatgggtgactgcagtaaattggtagtgaatgtttttcatttttttggctcttcatatcagatctgctcttggagaacattttgttctgagaatattatgaaggcagttcatctactttagaagttgcttgacaattttaatacagtgttaacttttctcccctccagattgtgtgatttttttgtcctttgtacccgacatcaatttatggtttgaaattcagcaatttgctcagttatactttacctaccctgactaaatattttaagtgctgccacaagaaaagaaaaaatctaatttttcccaatgttgttgttacccctctctgtttatatagcagtttaaatctgcccttcatcttgacagagaaaaaattttagatggattaattttgaacctaaataatttgttgacaaataatttatgatcatattcaggggttgttttgaggtaaaaagaaaactgcattgaatgaattataccaagtgaaatcatggtattttaaacaaaatgaggtttataattacctgggatttagtgaacaaaagtatgtgatgcagggctccctgaagaatttagtgcatgtcctatgttttagtgcttcaagcagcaaatattatgtatatacaataaaaaaggaagttgcagacttaatacatactgaaatggtctcaatgttaacattagactcatgaaaaattagcggacatctaagtactttattcgttcttttagtctttgctgtacctaggaacatttgtttcatataaaagttatattacaaaattaatggactgagggtggaaagagaatttgaaagaatgtgaaataaagtctggatatatactgaatgcaggtggaagatgtctgaggaacattaatgacaataaagagaagtctcttcctaagttacagacatccaaaaccaaaataagagccaatgtggttacataaaactgcaaagaaaatcttggttggacagagaactccgaagaggtagtaaaaggaaaaactgagcaaactagggaagacaaatgcagagaaaagttagaaataattagagaagaaataaaatgcttccacaaaaataagaacaacaaaaattcaggagataaatgcagaacagtccagctaacagaaaaggatttttgaactgtgtatgcaagaagcagacagcatgattggaaatgaagtatttgctctttcctctaagagtggaagaacaagacattcctgggcagcacaactctgcgtaggattagttgcacttcctcaaatgtattttcaagcaaaaagctgaaacccaaatgtcttgagccaccagaagtacccaggctcttatgtaatacaggctttagtgttttattgcttattcaaaaagacaaattatattttaaaattgatatatgtgtgagcatggttatgctacacctataaattaccaaacgtaataccaatagcagccaaccaacagtttagcctcagtattttcacaacagttcaaaatgttttgttaaatcccatgaaagtagcttcagtgacaaaggtttcagatctttgcaaatgataattaattcagaggcatataatgggaaacactacagtcaggtctagacaggtttagataaactaatggcccaactagttatggcagctacagtttttaacttcaagtaaaggaatcttaaagcagttcaaggaagaaacattttctttcttttcctttttaaaacatttaattgtcttttttgaggatgataaaagataaaatctagagactttattgtactgtactcattatagtctctcccctgcctcatatgtaaatctagtttgcttcttcatgtttattcatctctactttaaataaacatattgtacatatactctatacacacacacatataatacctattctcttccatttatgcttacattgtaagtcttttaaacatttattgaaacatttttgttggattgactctacattgaatagctttattataaatgaaagacttcccttctattaaacagaaatttcttttaataccactatgaggcagaacattattgctatggtataactttgtacgatcgaatgtcctactggttagatctgtgagttaatttaaatttttacaggctgttagatggagtaaaaggcaggatacagccatggactgtaggttttttatcctttagttacttctttaacttttaatttacattaatggacaagtttcatctagtctaattttatgtattacttgagtctttcctcatatttttggaatgccatttttaatttagagtgttttctaagttaaagtcttaattgttcttttcctgaataatagcttgcatgaatacaaagaactttatgtttgaattttggatttagtcagcttgatttttcactgaaatcaggcctaaacatatgaagttcagcagcaaaaacaaaagcaagcttacttactgaaaacgcattgtctttctataacaagcttactgtaaagactggggtagtatgtatatttccatagatacatatatatagtatctgtgtgtacacatatacacgtaaagttaagaaagtttgtaaaaaaactacacatacgcaacattagaaatactgttaaatatttatgtgtaatgaagctgttcttttcaatgatgtcctacattgtaaaggttttatttaaaaatttttatataatgaatgcaaacttgagtcactgttcaaacatgaatattttctcaaatgaacatatttgcatgtgttatgctatataaactgagttctgtaaaaaggatcctttttcttctgctaccaagaaattctacttttataattcaaacaatctactctctcccacactcaaaataagtcatcattacttaaaatatgtgtagtgtaacaatggaaatgtttgtatatttgtcaaactaaatattatgttaaaatattttatacatttccactgagaatgctcttcttagttaaaaataaataaaatttaaaaaaatttgaatggagacattttgaaagtggctattccaggtaggataaatatttaatttactccatagcataataattttaggaatcacttcattttgaaaaattattctgaatactagcaacattttggcctttaagacactttattaacagttttgaagaaaaagttgagacatttgttcaaaagatttgaatctattcacataatagttcagacaatctccatttttaaattcctaaattttgaaaatttaggatacgtaaaaaagataaattaaggaatgatggtttaccacatggaaaaagtattatttataaaaattttaaaagtataatttatttacaaaatttagttatttaataacatatataaaaagactcaagttgatattctaaaacatacttttaaacaaaaggaactgtctattacataatgaaaatttatgcaaccaaaatgagtattattctttgcaaagtagttgccttgggagacagttctttaaacagtatagctattgctctaaatattgcacaatgtgcgaacaatgttgaccttcagtgccaacaacatatcattttgaatattttcactgacaactgctctttaattttcgttgctttttagaaatagtcaagagtaacttagagccatgtttacctgacagagccaagtttattgccatagcaaaacctggcctgtatagttatagaaatcccttatcttcatttcttcacctccaactctacaatctactccaatttgttgtcctttgcctcctctactcccttcaaactaatctttctaaggctgtaactatctgttttcagtcaccaaatgggcaatcatttaaaaaatattatggaaatgataaaagccatttatcttgggtggttttgtgcagtttctaaaggcagtttcaaaagaggtaagtaactttgatagtgatagaatcattggaataaatatattaccttcactatgacaaggatatttggatgtttaacttttggatatctgatatgtattttccattcagtgcagtatttattgagcacctatattatgcaaaacactgtgcgagatgctgagacaaaatatgaagatgaagaaacaatgagaccagccctgactcatgaacaaatagtgaggtaaggagataaccttcaatgactctactgtgagacagatttaagtgttctcttggagttagaatgcactatataaatagagagggaagaattcattttaactgaagcatgacagttaaattgtgcctagaaggacagagattgaaaccttaacaggtagaaatggaagaaagaactaggaagaggaagtaagttgttcaatgtagaatagggtttctatctttttttaaaaaatggacagtttactttctattcatagcttacacagtaaaactgtgcttgtttcaactttgctggcactacacaatatgcctagattcaattctgttgaatcccataaactctctttttttgttttgtttttcattccatctttctatgcctgtgccccatgtgttctttctcagctctcatgtctgtgtctttttcagttctgcatcaccttcttttcttctacatctgtttctcacctttccctgtctctgctatcccctctcgtagtcatctttccgtcttgattgccataaggaattgaaatatgctatacttctctttgacaaatccaaacttgaataaactcttacactatggagttttcaacaaatccttactctttgtacttttttccttttttaaattgttccttcccttcacttaattccttgtaatctgtccaaattttatattctcctcccccacttttctcccttttctttctctcctttttgattcttacactacactactggtgtactcagaggaaaaaatgatgctaaaataaagaaaatgttctttacaatcagaatattattaaccagtacttccaagcataactagttcaatcataaaagttcatttaagatttcaatgattccaacttatatctctttatctctttttgagtcaagtattaaatgactagtacttcaaagttaaatgtattttactgtataatttttgagactgatcatttatatttgatatctatatctcatttcataactatactacatggtctaatgtatagcatatggaaagtttttgtagcttacctcttcttgcaagactaaatgagaggactactgttggcagaaagcaaagttggtcaaggccaaaaataggactgactgttttctttagaccctccctttttcttccttgtaataatcttgaactcctagattccagtttttcctttatttagccaataaatatttactgaatcctaactattttccaggaactatggtaagtgctattgatagatgtattaggccttctttgacacggaagagcttacaacctaggtggagagggagaaacataactgcaatataaattgataaggcccataatgggacgaagaacaggctactatcctcattatacatctggtactcagagacctctacgttattccttggattttccccatacttgcaacccacctttttatcctcctcattaaaacttacctgttattgaatcccattttcccttaaggcaccccttttggataggtgctttgggaaaacaatcccacaaattaactcacactggatattaaaagagtaaagcatatacctcacatccctcttgcattttaacaagtcagtccatttgaaaagaactggttgctagtgatgggaatttcaagaactgtacagtaggccattagaaaagtaaaactttcctcatacacttcaatcacaacagagaggggttgaccgtacaacataaaacttccttttagatgccctaacactattattatttaaacaacatagcagctacatattcactaagaaaatacaattgaatttaattgttgttagtagtagtagttaccgctagtaactactgttactaaaatagaaattatatatcgatttaaaattataaaatttgccttattctttctttaacttttattttaagttcaggggtacaagtacatgtttgttacataggtaaatttgtgtcatgggggtctgttgtacagattatttcatcaaccaggtattaagccaagtatccattagttatttttcctgatcctttccctcctcccaccttccatcctctgatgggcccagtgtgtgttgttcccctctatgtgttcatgtgttctcatcatttagctcccacttataaatgagaacatatggtatttggttttttgttcctttgttagttcgctaaggctaacggcttacagccctatccatccatgtccctgagaagaacacgatcgcattctttttatggctgcctagtattccatggtgtatatgtactacattttctttaaccagtctatcattgatgggcatttaggttgaatccatgactttgctattgtgaatagtgctgcaatgaacatacacatgcatgtgtctttataatagaatgatttatattcctttaggtatattctttgatattattatgaagattcacatgaaatagcaaggaatggttttctagttggaaaagtatgattcccacaataaaagtaataaaatataataagaaatatttacatatatcaagaaaaaatgattcatgggatcacaaaataaaaattatacaaattgaggaaagccttatttaatataatgtctttaggaaaaaaattagtatctgtggacctgggattcctcccctgtaaaatgaagggtttaaataagaaaaactccactttcttgcttccaggcttaacacatatgtgaatcatttgcataaatatttctcaattttcctactacatgaaattttagttgctacaatatcacaattaggcagtctgcataaataaaggagtttctcttatatttctaaatataagagaaatatataaaatatactaaaatactaaatatataaaatatttaaaaatactaaatatactaaaatacagtactaaaataatgcctaacacaaagtaactgccttagcataatttaggtggctgattggatggattaaagcttggattaatagaaaaacacaatgatgcaaatgtgaagtcaggtatatgtctacacatctaacaacatttaatgagagacactgaagacccagaaatgagtatttttacaggcttacaaataaccgatgttcaatttgggggtcaaaacaagaaatagagaaaactgaagtaagttaggtaaggtccattttgactaggattatttctggcaatttcccctcatctactttctgcaaattcatgcatgttcactgtactgtgcttactgacaatctgtaccaaataactcctggcagtttgaaatcatttcatctataacatataaataccttatttgcttcaactgtacaaatgctggaccccatctcaccaaagttttctagaatttaattgttcttcacctaacatctttaaaactcaatttattggtctgtaaaacagtaagacctacattatagagttattgtgacaatcagacggactcaaagcatgtcatagtttcacttacgtatctaccaacccactatcattagccttctacttgagaccaacccctttacctaagtactaaatgtggtaatccttgaagtctctgggacttttctatacaattatcatttttctctgcttgacttcaatgtcttctctgctggctctttatttttcaaaacatgtaaatcatttgtattctaacattaccttgactctgtgcctctttttaccaacaattctccctcctttcatcacctgtgtatattgattaaataaacaaaaaacaattcaaagtaattttatatgaaaaacattgcgggaggaaaatagaataaaaagcaacagtaacaatataaaaaaaaaatcacctgttgtcaaccacaggcatttcttcccaggtgtaatatagttatataaaataaacttgtcatcagaagttttgaatctcagtatttttgcttaatattaaattttatatagcattaccttttctaaaaaaagtgttaaaatagtattttaatgactgcataatatcctatagtaagaatgaaatataattcatttattcattcctacatttagacatttaggtactgtcaaaaatttttgctactataaatggttctgataaacatgcttgcagataaatctttgcatacgtctctgaatatttctacaaaataatcttcaagattggaaattattgactaaagtaaaataaacaatgtgaatagcttttacctttctgacacaagcttaaagtctttgttctttcattaagggaaatttttccatttaaatttatactaaaaatattgtgttattgacaaggcaagtaaagaaaagaaatcaatgctactgaatcaggcactctgatggatattctgtctcttcctattcaacacattttcctttggcaatctcttttcatgagcttatcaactaccaatgtattgatggcttccaaatttctcttcaggtatgaattctcctttgagcttgaaactcccatgtccaaaggcttcttgactatatcctatggtgtgtcatgcagtcctttggattctgcattaataaaagtaaagtattcttacttcacaaaatattctgtaaataattacccaattttgttaatcaagtcatatggaagacaatgcataaatatacaaaataaagaataagaaatgtactacaaatattcagaaagcattaaaatatgtcaaaatactgttacagatatatactaataaaattgaaaatctcaggacataatcttctaagaaaatatacattttcaaaattgactctataaatggaaaattttaacaggccaataaatttaaaaattaattaagaaaggttccagaaacaggtggttcaagagcaaattctatttaatttcctttttcaaaaattgatagataaaattctatgtattttccatgtataacatgtttttaagtatacataccttgtagaacaactaaatttagctaattaacacatgtattacctcacagttatttctgagtaaacatccattcattatttttcaagaatacatgtattattaactatagtcatcatgttgtacaacagatctcttaaacttattccacctaattgaaatgtcatatcatttgaccaatatctccttaaaccccagttttaatagaaaattgaatttcattaagttttcaaggatcaaaataaacccataacatagtaacaaaaacaaaatatttccaaattcattttctgaagctagcaaaagcctaaaacagtacagcaaaggaggctactgagcactgttacttcactccattgaattaggactggatgcaagtgtaaagcatcagatttatagaacttactataaaaaactctaaaatatctcattaacattttcatattacatattaaaatggtaatatcttggctatattgttttaaataaaatacattattaaaattaacttcatctgtttctttttactttttaaaaatgtagtcacaagaaaattttaaattgcatatatggctcacattgtattcctattagtattaatatagataattttgcttataaggatacaaaacttctcagcgagttaaatataacaatatattaaaaataatttgtgatgaccaagaaagttgaaagttttccattagaatatctactaatatatatgataaatttatataagtatgattttaaaaacaataattttgatagtgctgaaaatgcatgcaataaaaatcaaccacaattcttaattttaaaactcttaataaactatgatgaaactctttaatgtaatgaagaatatctacctataaaatggttgacactacacctaatggtgaaaacattagtggtattcccagtgaagccaagagaaaaacaaactcttgctagcacttattattataatttggaagctccagcaataccacctaacatgaactataaacatgagaaaggagtagaataaaaaaattaagaaataattagaacttataaatcagtaacctgcttgtttactatacacacacacatacacacacacacacaccaaaaacagccatttaaaaatgcaaaggaaagaacaatctcttattaccaatgataaaaaataaaaactacatagaaactaacactacaagaaaaatgtcagacttatatggaaaaaatgtttttctaagtaatgttaaaaaattttgaataaattaagacatcttccagatgagaaacctctatgtcaattctccctaaaacagttcataaatttaatgcaaccactctcagaagtccaataaaattgaagggggggggcagtggtagagagaccttgattaaataattctaaatctcttataaaaaattggttaagaatagccagtaaccttttaaaatgaaaaatactaaaaagaaacttttattagcaggtttaaactgtattgtaaaagccacaataaatagtgtagtcctagtaaaccatatagaaactgatagaactgaagagaaaaaataggctggaaatcaaatagaaagacaagaaacaagcctatttgtaaattaagtatttagcatatgataaataatgcattttaaatcagtgggaaaaacatagattttttttcaattgatggtgctgagacaactggttaaatatttagaacagagtaaatttagagcctatctcacactgtatatcaaaataaaattccagatggtttgaagagttatatgtaaacaataaaaccataaaagaaatagaagcaaatacagaagaatttttaatcttatcttgggttggagaaggtcttcctaagcataaaagcaaaggcagaagccataaaaaatgtaatatggtttttaaaaatagaatatttgaacacataaaaatgaaaggtcagtatagcaaaaacaaatgaaactaaaaggcaaacaataaatttagaaaaaactatttgcaacatatgacagagtatcatatagcagctgaaaacaatgtcctatgaaaaataattaaggacctgggaaaaacaactagcacatagtgttaaacggagaaattgttataaaacagtacatacattattataggaactttgtaaaatacacttacatttgggtataatggtttcccacatataccatgtttataatttccatgcttttatacatatagtcccctttgactgaagagatcctccttccttccctgtctatacatctcctattcatctttcaagcatcatttctgacatccctttagacaacaagaagtcttctttgaattatcaggctggaatatgtgcccttcctttgtttgcccatagtacattgttgtacaccatcaaattaatgctatttaatattatctgtttacatgtattactccacccctatgattaaagttccttaagagaaagggtaatattttacctctttctgcatgctcatttcctagtattatatctgtcaattagtacacattcgaaaatattggtttgaattattgctaaaatgtcttctaattaagattattccaaaatgaagctaacatcaatagggagacaaacaacacaagaggcatcaaactgtataagaagtctgaaagaaaaaaaagacttaacgtcatgagagatgattctgtcctcattttcacgttaaaccagaagcttccttcagggtacagctcaatgagtcaccctagagtattctaggtatatattgatattcctaaaaatctaaacatatgtaccatatacaaaccgtgtcccacaatttatcacttaaagtttattgtttttaaatgatttctcatttatgagtcttttctctcattagacgttaatctctgttatgtgaagaggtcatgccttatctaggcagatatcctacaaagtgtttggctaagtaccctagtactttaataaaaattcaatatgcacaaattttctatacagctttaagtaattttctgtttttatttacatacatcccttcataattttctaagaaaatcaggatctactccaatttcctcattacccatcatcatccagaatgatgaagagatgtatagattattaagaaaatatttgcgtttgctgagtaaacccgatattatctaatcaaaagaacagcttcggctgtgctgctcctagctgtgctagtccacacagctttcccagttttcatgaattagtggaggtaatgttaaaccacttttctagtaagagtgcataaggatatttaagtgagctcatccctctaacaaaggaaagaataattttcattaatcattattcaacagtacatcttcttgaactaaatcatgagaggaggaacttatgatgttttttattagtcaaaacattttctatatatagcttagtatatgcaacgtgccaaattacagaattctatttactgctaatgtcaatttaccaccacattgcttgatataattcaaagttttccaaggagctatttgacctcctatagactgaaaataaaatcatgagatttaaattacttaatgccaaaaaggaaagtcatctttttctccttcttatgtctttgtttcataaaactattatcagacagtccatgcaaacaactaaaaacaaaaaattatatggtgtagttaattgaaaaaatgcttttgctacacacagaaattgacactaagtgctgtattagaaggaaatcagtgattttcaattgacattgcacaggaaatcatttagtgtcaattgatattaaatgggtaaaattgtactgaattagtacaaaatgatttggtggaaaaaaatgtgcttccattaggtgacttgatattaagtgggcttaaatgtaataagttttagaggtcactagtcaacaaaaattggggcatgctattcaaccctgagtacatcagactgcttgctcttaataccctcatcaaaagataagttagtgtcatactatcatgacaaaattgtcttcctttgggctttcaagggaagtgggaaaattcaaattgtttaaatgagctaaattagccagtggtaaggaccatgacttcttagatttatctggtggtcctaatcctttaaaaatatttttttttctagaatttttggcatgaaatgaaaggcaacataacagcacgtattttatgtaatatggtccagattgcgctttctttataaaatggctttgacagtaagcacacaataaattatattgtgttagggagtgatatgattatatataatgaagtaaccactttattgatcttttaagaaacctatgtttttaaacctgagtaatgaggaaagagaagtgtgtggctgcaggagacacaaggaaggagaagaaacaggaaaagttacattacacagtcactacaagaacaaattgaataaaatattatagatattttctgggaagagaaatgggggtttgtgaggtacagaaaattgtaaaactcatttgttacttagtaatacaagaaacaataacaataaaacagacatactgggaacactccacccaacaaaaacagaatacgcaatcttctcaagtgtatgtaaggcaattaccagtgtccaggatagaccacatattaggccacaaattaagtctccatagatttaaatagacaaatatcatacaaagtatcctttctgaccacaaagggataaagttagaaatcagtaacaaaatgaaaacagttaggcaacatactcttaaacaaaggatcaaaaaagaaatcacaagagaaattagaaaacacccagagatgaatgaaaaagtattatcccaaatcaaaacttaagaaacacagcaaaaggagtgctaaggggaaagtttataattataaatgcttacattaaacaacaaaaaagacctcaaatcagaacctaactttacaacctaaggaactaaaaaaaaaaaaaaaaaaacaaactaaacccacagctagcagaaggaaagaaatacgtattagagcagatgtaaaatacagaatagaaaaataagataaaaccaataaaaccaaaagttggttcttcaaaaatattaataagattgacaaacctttggatatatatactaagaaaaaaagagaagactcaaattacaaaaatcagaagtgagagaggaaacactactactattctacagaaataaaaatgattataaaagagtacgatgagcaattgctaggccaacgaattggataacctagttgaaatgtagaaattcctagaaaaacaaaacctaccataactaaaccacaaaggaatagaaaatctgaatagacctatataacttgtaaggagattgaatcaatattcaaaaatctcccaataaagaaaagtcctggacctgatgacttcactggtgagttctaccaattatttttaaaaagaataatatcaactaaagtttcctcaaaaaacaaaaaattgagctaccacatgatccagcaatcccactgctgggtatgtatatacccaaaagaaaggaaatcagtatatcaaagaggtatctgcactcttatatttgttgcagcactgtttacaatagctaagatttggaagtgtccatcaacagatgaatagataaagaagatgtggcatatatacataatgaagtactattcagcaataaaaaagaatccctctcaaacttttccaaaaaaatcagagaaggaaacactccctgattgattacatgaggcctgtattaccctgatgccaaaaccagacaaaaacacaataaataaaaacaacagaccaatatctcttatgagcattgacaaggattgaaaatccttaacaaattatagcaaaccaaattcagtagcatattaaaaggattttaccctatgaccaagtaggatttgtcgttgaaatgcaaggatttttaacagatgtaaacccatcaacataatacaccacattaacaaaataaagggaaaaaacaataatcttgattaatgcagaaaaactacttgacaaaatctgacatccttttataataaaaatcctcaaaaactaagaataaaagtaaaaaaccctaacataataaaatccatgtattaaaaactcacagctaaaataatactcaagggtaaaatactgaaagctcttcctctgagatcagcaacaaggcaagtactattccacataatactgaaagtcctagtcagagcagttaattaggaaaaaaagaaatgaaaggcacccaaatcagaaagaaataagtaaaattatctctgttcacatatcatatgatctcatatgtaaaaaacatattccacaatttccaccaaaaaaaaaccctgttagaactaataaataaatacaacaaagcagcaggataaaaaaaatcatcacgcaaaaatcagtcacattgctacacactaacactgaacaatctaaaaagaaaactaagaaaacaattccatatacagtagtatcacaaagaataatactatttagaaattaaccaaagaaataaaatttttaccaataaaatctataaaacttttctgaaagaaattaaagaagacataaatgaaaagaattgtgttcacgaattggaaggcttaacattgtcaagatatcagttctgcccaaagtaagatataatgtattccctataaaaatccaaattatgttttcacagaaatagaaaaactcatcccaaaattcacacgaagtatcagagaacccccaaacagccaaaacaaaactaaaaatgaagaataaaaccaaagcactcaaacttcctggtttcaaaacgtactacaaagctacagtaatcaaaacagcacggtactggcgtaaagacaaactaagaaataaaatagagtccagaaataaaccctcaccagtgtggttaaatgatccttgaaaagggtgctaaaattattcaatggggaacagacagtcttttcaataaatagtgattgggaaaagtgggtatccacatgcaaaagaataaacttcaatccttacctaacaccatatataaaattaattcaaaatagattctaaatataagctttaaatataagatctaaaactataaaactcttggaagaaagcatgaggcaaaagcttcatcatactggatttggcaattatttgagtatgacaacaggccataggcaatgacaacaaaaaagacaaattgagcttcataaaaattaaaaattaaatgcacctcaaaagtcaccatcaacagagtaaaaagccaaaccactgaataagggaacatgtttgcaagtctcatattggataaggggttaacatccaaaatatacagagaactcctaaaaacacaacaacaaaaatctgaatcaaaactgtgcaaagaacttgaatagacatatttccaagaaagatatacagatggcaaacaagcacatgaaaagatgttcaacatgactaatcatttgggaaatgtaaatcaaagctacaatgaaatggaatctcacaccaattagaattgctactatcaaacacacacacacacacacacacacacaaaacaagttttagtgaggatatggagaagttggaaccattttacacctttgatagaaatgtgaaaaacagcatggcagtttctcaaaaagttaaaaaatagaactaccatatgacagagcaattccacctctgggtatatattcaaaagaactgacagcagggtcttgaagagatatttgttaatatgttcatagcagccatattcacaacacccatattcacaattactaaaatatggaagcaattcaagtgtctattggatggataaatggatacacaaattgtgatatatatacacaatggaatattattcagtcttaaaaagtaaggaaattgtgacatatgctacaacatcagtgaactttgaggacactatgctaaatgaaataaagccaaacacaaaaagacaaatattgtatgatccaatttatatgaagtacttagggaaattaaatcataaagacagaaagtacaacggtggttgccaggttgctggtgggaaggaaaaatgaggagttgttcttttatgtgtataggctttaagtttgcaagatgaaaataattctggagatacttggtggtaatgggttcacaataatatgaatgtacttaatgccaccaaactgtacagttaaaattgaataaggtggtgtattttatgttatgtgtattttactacaataaaaaagttgaaaaaaaaatgaaagaaaagctttgtgatttttttttctttcttttttttttccgagacggagtctcgctctgtcgccaggctgaagtgtagtgtcgcgatctcggctcactgtaacctccgcttcccgggttcaagtgattctcctgcatcagcctcccgactagctgggactacagtcttgctctgtcaccaggctggagtgcagtggtgcgatctcggctcactgcaacctccgcctcccaggttcgagcgattctcctgcctcagcctcccgagtagctgggactacaggtgcgtgccatcacgcccagctaacttttgtatttttagtagagacggcgtttcaccatgttggccaggatggtctcgatctcttgacctcatgatctgcctgcctcggcctcccaaagtgctgggattacaggtgtgcaccgcagcgcccggccactttgtgattttttaaatgtgacctgccccaccccaaaaatacatagatagggaactcttcatggtaatcactgggcttgaagagatagcattaaccttttttctaatttggccctgagactgaaaaatatatatatccataggaacccatacagaacttacgatgaatgtccacgaagtaaaccaagaacattccccctagcattagcagagagcattctaaaatataatttagtttcatcacagaggaagcttacaatgaaactggagctacattcaggacagtctttaaggttcaggagaatgatttgctgattcaaatggacaacagagaaatctgattaaataataatatatttatgatcattactgtttattaagcttttactaatagtgaggataatcttcagcattcttcattaactatcaatcgttttgcttaacaatctgataaggtccacctatttcagaaacaaagatcatgagattaagaaaactgaccaaagtaacaagcacagtaaggtgttaaacccacatctatctgaatccaaagtaaagaaatttttggggggggcggagtgaggaggtggaaacagagtctcactccgtcacccaagctagagtgcagtggtgcaatctcagctcactgcaacctccgtctcccaggttcaagcaattctcctgcctcagcctcctgagcagctgggattacaggcttgcacaccatgcccagctcaatttttggatttttagtagaggcagggtttcaaaacgttggccaggctggtctcaaactcctgacctcaaatgatccgccagcctcgacctcccaaagtgctgggattacaggcgtggccaccatggtgggccccaagtaaagaatttttaactaggtaatttggactttcaaaactgggacatagttggtgatttaaaataaaaatcctcttgcaagaatctgaagctaaaatgttccaaagcacaacaggagctgtgaacaagttagtagtctataaggagaagtataaatacattggaagaattaatctagggggaggaatgtggtttaagcagtaattgataggtgaagatgagcacaaaaatcagaaaacacataactgtacctgtaagttgctattcctttaaatcttgccttatttttaaataaataaatatgctagaaaacatttattctttgtggttttagtacatagaataatattttaatttccaaataccacaaatgaggtctaaaacatgattaaataattaactccattatccttacaatagaaaacttagctattcaaacaatgaagtttcacatgggtgatgccacctcctacattgtcacacattaaaaagttatagtcacaggtttttaaagaaataacagcttttccgggttaaacttccaatctcaagcctattcatgatgataaatgtcacagggtcaaagacctacagggaaaatctacgttagctctaaggtgggttaaccagtacacactgattaatccaaaatccatttgttaggaacaaggcaagtactacacacccttcattttgaagatactcataaacccaattaacaattttcaatgacaaagcttgtccctttgtatgtatgtataataacatcatagaactctatacaagcacatacaaaacaaggtgaaaactgacttggccatacaggtttgcaatctaactagaaagcataaatatcacaaataaatagatgtaaatacaattagtacattgataaacatacttcatactcttatgcagtaaatactcaaaaaaataagcaatgaaaataacatagaatacttgttgaactgactaaactcatcccagtgaagtttcctgaatacattttccttgaatttttattataaaactgcagctaaattttgcctaaacaagtttatccctaaatgtaaacaatgcatccaacattatagaaatcatcaatttttaaaaatctgttgttggtaaactattaacgtcattatattcaaaggaaatgttaaaattattaaaattttaatattttaattctaaaaactatatactactatcaacatttgcttcacacatctgcaatatgaaagtggtaacgtctaaaggtttaacattttaaaataatattttcaccttttagccattgcattatatcaaagttatgcaattttttacctttttattattattttttgcattctctccctttactggagattattgccttcttctctgacatcataactagataatatctcaatgacctgttactgtatccttggataagaggagatagcatctccagtaaggtcaaatatgagtcaaccatgtgatatgggtactgaaaaattccaattaaatcttaaactgacctgacagaataacagtatctagaatgagggagatgacattcccactctcatcagcaatggtcagatggcatgatcaatactgtgatacatgacccagaagcacaataatatcctaagaagggggaagaggaagggtgaaagactagaatcataacatatttggaatggtagaaagaatcaagggtattacatgttgactatgcgattaggaaaacaatcgggatagaaaacgtttcaaatgtttgaaaacttcaaatgagattactctgtatgttcccaaggcatatactattaataaaatgatgggttgagaatactagatacaggtttcaactcaaagtaaataagaacctcttaacatcagaattgctcacagatgacgtgttgcttgaaatattagtgaacatatttcaagcagagactggaggtgtttaaagcagttttacaatatgattctattagtcttctcaaagctcagaattaaaatatttaataatgctgagtggtggatgtttttacagtgtggcctggaatctgcagttatcaacctacaagtgtctgatttttattagcaaagtattaaaaagttgttcattttcccaatttaagaagaagtttatgcactggacattgcttttcaaaagttattttttgaatagtggtaaccaaaggttggggcttgcgtagtggggagaatggggacatgttggtcaaagggtacaaaatttcagttaggagatataaattatggccatctattttacagcatgaaaacacatagttggtaacaaataatgcactacacacctgaaaattgctgaggatagattttaaatgttatcaccatacacacacatatacatacacacaaatgataagtatgtgagatgatagatatgttaagtagcttgatttattatttcacactgagtatatatatgttaaaacatcctttgctcaccataaatatatacaatttcatttgtcaattaaaaataataacaaagttacatatataattttttttatttcaagtggtatggctttatataatgctgaatgactcactgactgattgaatcactgtcattcattcaacagacatttattcagagcctggtatgtgccaaagactgcaaagtggcatacaaaaagaaagaataagacaaagcctatgcttataatatgtcagggtaagtagacacccaaaaataatcattttcaaagtttaagatcttattctagaagcctgtgctctgggagcacactggaatggcatttaactttccagaagaatcaaggaagacttcactgaggaggtgatatttgagctgggctttaaaagattaataggatttaactagatagcaagggaatggaatgatatttcaggcagaagaagcattatgtactcagaggcatgaaagtacatggtgtggttagtgaaaaaggcaagaaatttggtaaagctgaaatgtgaggtataaagtatggaaagagtgaaaataagactgacaaagtagatcatgactaaatatttggggtcaatataagccatgctaaggtgtttgggtttaatcttgggcacaaagaaatgttttcaagtagaaaggtaacatggttacatttgcattttagacaatatatgtgcatcatgtgtgagaaactcatttctataaatactagtttttgccttgaaacatttcagggggagtggaatcctcgagttactggcaccagcaagggtaaattaatgggcactagatggcggcatagagtgcccaattcttcataatatcagttactatttctgagcctgtatttttgacttaaataattcctttattcaaaaatcccattaaatgaatatgcactatttagactgattggcatgaagtaatagactactgtaaggggaacacgcattttttaaaagaggtaaagcccatgttggtgcatgatggaaaaggcagttgaggattataaaaatatttggataaaattaaaaatacaactttgagttcaatggaatcttaaatttctcttgcagaagttgccattcgtctttaaataataatacatatatgtgtaaaacacctaaacttcataaagtcatgttatattcaccatctgtcctcttcttcaattaccaccattaccacatggacaaacattacaattcacattttacaaggaacgaaactgaggctcatgtaaatgtttttcccagtttatatggtacagttaataaataatagtaccaaaaccaaaactctagtttttttattacaaatccagtctttggttcactttgtcatgtttcacaactgaaaaacaattgggaactaggacaagattaagacaaggaaatgatagaaccaaatgattctaatgccattctgtgataaacagagagcaaatactgtaaattggattgtatattcattaagcccatggtttctgacaattattttggaagaatttacatgtcaaagaaaattatgaccaatatttagttataccaaggaatttacattggagaagctctatatatttttaatgtttggttgataatatgttaacaagatgattagtaagaaacacaaaaatagtttgtaacttaagatgtaaaagattccaaataactataaattccctatggagaagccatctctgccccatgtcatcatgcctttaaaattagacgcaaaagtttgaatactcaacagtagaattgtttatttagtagtgtggaaggtctacctctgtctatttcctgagggaaagcggctataatgagcctgcctgaattatgagaataaagttttccttttttaaagagtttattctaacagataggaggtaacttttatttctgccttcctctcttgccactccatccccagctaagaatccaatccctcaagagctgtcatcgtttttgttgttgttgatactctccaccaagacaaactaaaccagactgagaccatgccattttagcattatgaaacaagaaagaaagcaaaagtcaccaacagagcaatacaggaatttgagatgtacagaggaactgaaaaaagaggagctgataggagcattctctttcaaagctcaatttagtgttccaactacttaaaaccctatcacaatatactctatgccatcagggaagaaaaatgccaattttaaaacattattttcacttttttataaaaggtaaaacatgttaaggtccatacgtaaaatctttccaacacatcagttcatctgcaaattagtagctgaagtctgctcaaacgcagaggaaacttccatttaggtcttgaaaaagaatagagctcattttaaaacatctttatttatttgtgcaacagtgagtttagaaacaaagtatccagtgtattttcctagagttaaaaaaagaaatatttttattgagtacattccaaaacaattaaatattctcttaccccacccttttcaccaactgaatagttttcgtttgactttgaattaccacccacttactgatttacaaactggtcaaattcagcatatatacccacactcatacaaaatgcatttcaggtttccctttttggattaaaaactaaaattttattttacagtgagagctaatttgttaggtaagacacaattaaaccaagaaagataaatctaaacttacttacttcttccaaatttgaaaattgtccatgagatcttcaccaataagctacatcttttccatgctttatgatcataccccattttttgtatgcaaagaagaaaggggactaatatctttgatcataagtgttgagatcctaaattaaatctaagatttggggccttattaatacaaagggagaaaatagttaactgaagatgtcattagtaaaaattttcattaacttctatctctataatttctggcctttccagttttcggttgcatctttctagaaatgcatgtccttttcctagccttagctctgaaaatattgcttctacccataaaatgtcatgttgataatgctttaaatattgaactataaaatttctatatcagaattaatgagcctatttcatgttttaacactgaaaatacattctaagagtttagaacttctttaataatttgtttaaaaagtagttgaaggccaggcatggtggctcacacctgtaatcccagcactctgggaggccaaggtgggcggatcacttgaggtcaggagtttgaaaccagcctggccaacatggtgaaaccccatctctactaaaaactaaaaaaaaaaaaaaaattagccaggtgtggtggcagccgcctgtaatcccagctactcgggaggctgaggcaagagactcgcttgaaaccaggaggcagaggttgcactgagccgagattgtaccactacactccagcctgggcaacactcagcaagactctggtctcaaaaagaaataaaataaaataaaataaaataaaataaaataaaataaaataaaataaaataataaaataaataaaagtagttgaaaccagaaaaaaagagatcatctaacatataggagtagaattttgagatataaagttttactccacattttctttgtcactaatatttccccactattccttgcactcataagcccttattttcagaatttattgtctattatggttttaatatgtgtcccctccaaatctcatgatgaaatgtggtctccggtgttggaggagggcctggtgggaggtgtttggatcatgggggttgatacctaatgaatggcttggcaccatctccttggtaataagtgagctctcactctaagttcacatgagatctggttgcttaaatgcatgtggcacctcctcacctccttgctcctgcttttgccatgtgaagtacctgctcctcctttgccttctgccattactgtaagattccttaggcctccccagaaaccaagcagattccagcaccatgcttcctgtacagcctgcagaactatgagccaattaaacctcttttctttataaattaacttgcttcaggtatttctttatagcaatacaagaatggcctactacactctccaggaagtttcaaatcacgtaagactaaatgttagtattcttactgcaagccaaccagcgtaggttcaccctcttttattttgcagcgagaaaaacaaaacaaaacaaaactaaatccatagagctgattttgatttacagatacattcattttatttataggtatcaggcatacttttttccaagcttcagacctccaatgagaaggcaaagcctaatgtggttcagtcttattacctggctaatttgaaaggcaaaataaatgacagtgaagaaataaaagacagctaaaccagatgatgttggtttgtaaactttaatgactacttattaaaattttgcaaaaaatgaaattggttattatctatatcagtgatttccaatggtggctaccagaagaattgcttgggaaccttttaaaacataccaatgccagagccctgccttacaccaattaaatcatatttggcagtgccaagtttaaaacatacctgaggtagcattttgttaagactgtttaacaaagttatcgagaacacaagctactttcaatctgaacttcatttgcctcatccccaaaatgggcagaataactacactatgtggatattgtgagaattaaatgaaataatgcttaagaagaatccagaacaatgactggctcacagtatgtactcatttgtaggtggtattgctattagagctcctgttgatctgcactggtaaaacctgtaggtgttacagaaaggaaatggtatgcctatgaataaggaaaaggaagaacactctttaaacatcaatcgcagccagcaatgtgctatacccatgagacataggaaatacagcagcaaatcatacttagcattcctgtgatagatgttagccttaatgaagtatcttcatgccatacacaggaccacaaaagcctctgtgggacccaacatacaatttcctataataactcgtgaatcccattcattaaattagtcatattgaacattcttattcaatttctctatatctaatgccaataaactaaaaaacatgtagtatatgttcctatttatatctgcatataaacataaatacatatttttacatatatatgaaacattaaaaaacagaggtaatttttttgtctatataattttcccgtagtggccgaatttcctaaaataagcatacatcatttttataagtaagatgctgatttcattttaattaaacaaataaaaagtcatatatatttaaaaatacaaagaaactacacctttctacaattaatttattagaagtttgtttactggtattgttattgtctgcactgaccttaagcctccttaaagaaaaaaaaaaggcaaacaactaaaatgcaatcaatccagtcaaattcatggtgttataaagttcttcagaacagcactaacatggaagacttttataataggaaaggaaaaaccaaataagagagaaagagaatataaataaattattcagccctccctttcaaaaagtaaagaaaatattttcagaatagattatttctttcattatactactgacatattctttccctaaattctaattctgatcctaatctttttctctacttcttttttctcctcatattttaagattctaagattgttctcaaactgttggcaactgctagatcacttgatgagggttcaacaagcatgtggaccaccagttttagttggaagaatgccattgtttacaatctttcatcaaggtatctcttactggctcaatgataaattgtgtgagccatagatcaggtgaaatttttatccagaaaaataattttaaaacatcttcatttgtactgaatcagaaaatcatgacatacttagaggtcactgggattaatactgaattcgagatggctctgtcaggtagttctagataatttgcaataagcatcaacccagaggttacgaaaaggtttctcactgaagactaccttcaatatgtaacagatgctaagtcaaaaattatattacacacaaacctaaaacgttgaaggttttaactcggaagatggagaaaaaaggattcttaatccatcttttgacagcactcagtcctataaagttgttagaaaaaaaaagtcttcatgttttgcacctggaaattatttttaaatgggcttaataatgtggcatcaattcctttcccccaaaatgagtaaacacatcaaatgttgggtaaaagtcatgttctcagtgatcgttgagccatatgtaccaaaattaatattctaaagaaattctgctatcttgtcctcaactaaaaatcttgttgaccttaaattaataggtcaaggctacttaagaattgatatgtatgacttaataagactacttgaaattataggaatagtttttataggatttacaagtattatgaagaaatagtttttcattttttcattcatagttgcaaaatgtaggttatgaaataactttaaaaaacaacatttccattcatgtaaaaacctccctctccttgctatgggcaagtctggttctccataccgtcacaatgacactttcgcagtcaacatcacagctcaggaaataattattaaaaacaaacaaacaaacacaaatatctattatagagtatgggtttttagtgataagaaaaacaaaagtcatcaagcatttcttcacatattcacagaacaaatgccaagagctgatttagaccttccaacttaaaatttaattatctgctaccacatacgttagatggtatctgtttttccacagtacagtaatatgttgatataatgcagaatccaacaatttggtatgataaaggaattttatcaatactttcttctgctttctctctgaacatatttgtcatcatctttgaggctgatttaccagttttgaagcaatcctgcgcattacttgtaactgtttttgctatgaggagtacaattctgaatgaagtctttgtagttttgatcttttcacctttagtaataaaagtcatctattttgtaccagaaaacagtaaaatggcaaaaacaaaaagtttcaatagcttcctttgattatttgacaaagtttgagaaaagacaacatacttggaaccagaggaatcaggaagaaaaaggactgctggtatttgtcagtgggctttctatttgtgcttcttaagctgattgtacgaaatcctcacacctccatgttcactttacccagcacttattaaatgtacattttattgctccagaaaactattcactatttatacttataatcattattgtacattattgttagaattttcatatttttatattttaatgaatctcctttaaactactgatgtatttttgtgaattggaaatacaacagaaaagtaacaatgaataatgcaaaatttaataaatgtaaacaatctgcaagttatgtaaaacatattaacccggacatattatatactgtatcctgttaaatgcctgttggttgagataaacacaagcaaatcagtttcaggatctaattggtggtgaacagctttcactatagtaaagttaactttatgtataacgaaattgtttacaaggcctgcattccacacaatgacctggaattgtgacagttcctcagtcccagagatgctatattcatgattttgcaataaacaaaactaatacttattaagagctaagaaaattttctggccgggcgcggtggctcacgtctgtaatcccagcactttgggaggctgaggcaggcagaacacgaggtcaggagatcgagaccatcctggctaacacggtgaaaccccagtctctactaaaaatacaaaaaaaaaattggccgggcgtggtggcgggcgcctgtggtcccagctacttgggaggctgaggcaggagaatggcgtgaacccgggaggcggagcttgcagtgagctgagttcgcgccactgcactccagcctgggcgacagagcgagactctgtctcaaaaaataaaaataaaaaaagagctagcaaaattttctaaattaaatcctaaatcttttcttaattgtatcacatcttcacatacacacaaatctactatttctatctcaattcagttagctttatattcctgaattggtttgactcagatagaaaagttcccacaacaactcattttgagaccatttcaaggtctgcctatttaatgtagtttaaatcctatgtcaaagtcagggccttgggtttatataatttatactgataaatcataatgataatcataataatatctcaacagaaatgtctgtcatttcaggtaagataaataatcttgactaaattaaaacaaatgttgaggtaattattactatgtacatttgaaagcaaccataagcttcacaaaatgaatcaaattcacaatcgctactctcacaaagtttatgtattaaggactattgcaaaagtcatccattagtcttttcttacacaaataggaagtgaaaccaatgatttaccctttgtttacaaagatgtgactatttttaaattgttatttacatttaaattgagcatttatttagcacttgtcttaaaacagtaatttttggatgatatataaaagagtatttattaaagacttctatctaaaaaaaaggatttataccaatccatgcacatattagcttacttctacaacctcacctttcacaggtacacatacttgaacctccaaacttactccattcatactgaactatgtgaactatatgcaaacccatgaacgggtcatatactttttttttaatgctaaactttttaataagctgtttctcttcttataaaacccttaatacttgtaactggctaattcctactcaccttttcagtgctctcttagccatcatgtcctgtaggaagtcttccctgacttgggttaagtgccccttcttgtgactctatacctctctggtatatagagagaggaattatcactcaacagcaattattataagatattgaaaatgtccagtgcccagcctgtctctcccactataccatacattctcaaagaaaaggagtatctggtggttacttttttatttctagcatctagacaaataacaagtattgactaaataaagtatatttcagaatacaagttgggtattccttgtccaaagtgtttcgtatttcagattttttcagattttagaatatttgcatacacataatgaaatattcttacaatagaacccaagtctaaacacaaaatttatgtttcacatataccttatatacgtagccttaaggtaattttgtacaatattttataataattttgtgcacctctcaagtgaagttaggtgtgaaattttccacttctggcatcatggcagtgctcaaaaagttttggactttggaatattttacttcagattttcagattatggatgttcaactggtataaggcaaactgtttagtcaatgttatttctcagaagaaagactctcatattatgggccacacttccaattactttcttataaacaacaaagtagtatttaggaaagatttattagcaaggaattacctcagttggtactggtttgtcatggctttagaggtcaatctgctagaatagttaaaaatagaggcaaaataaaatgtaatacaagtttagtttttatttctggaatttttttcacaattgcaaatgttagctgctgatttaaatatgcctttcaaacatcatataaaacagccaaaagattatatcattacatagtacagatcgtaaatatatgcttaaggaacaagtgttgaaaaaaattcccctagtgttatggaaatggtatttgtgtcttctgatgaaattttaagtgacagtatcaaagatgaatttaaaacatgttataactaaaataacttaggtaaaaccaaaaatgatgtggttcggaaaacattgaaaaggtacgaattttataaatgtatgtgacgaatatgaataaaacgttcataaagttaggattgaaaattaacattagtaaattaaaatattattttatatgactttagttataattatgtatatgctatgaaattataagtaaatatttgtctctcatatctaaagctcccttcaaaagagtttttttatgataaaatataaaattcattagcttagagttatttgggggcatgtatgacatttgataaatacatgattaagtgaatgaattaagctctcttcatcttagaaatcaaaactagaattatattatcaaacacctttatgtttgtttatataaaaataattttaatacattttataaattatgatactttaaagaatgtatgcattcctaggggtcctctgaatctctcaatgatttattaacttttatttcactttctataatccctaccataaatattcagtcacataccatctcacgcatacaggcataactggcatgtaaacttaggtaacttttcaccgaaacttttatgtgcagatgacagttctgattaaaggctatgatcaatatgtcctctgatatggacatatggttaaaatatcactgtgtagttttccctacagaaaagggtaataataaaaggatggtaataagatgaaaggtactctacaactctattagaaacaatagaaaaacaaagtcaatccaaaatcataggaggacaaaattacaaactattgtttttaaaataatgatctatcattttttagcacaatcttcaatttcaggtataagcttcaattcctatactcagaaattccaaaacgctgttatttaaattattaatgatttaacggaaattttataatactaaaacttaaagcttaaggtatcttggctaaatttttttgctaggtacattcattcaataattcattcagacatttaggtaataattaaatgactattaaagtcctactatattttgggtagtatgttagttcctatggtgacaatgagaagaaaaaagcagacacaattccgttttcatattactaatgccttgtgggaaccagacattaatcaataatcataaaattattatataactataaatagattttggagagaaaaatgagattccatgatagcatctgaggaaaaaaaattgacatgcttaagaagatttcactgagaaagtgatgtttaagctgatatgatagatgggtaggagtttagagactagcaaattaaagctaatagggaccaggattaatattaagaggttcttttttaaatgaatacataggtattcataggtagtaagagctgttgattagtaaattgttgggacaggaattaacgttgttacagtaataccttcaaaatagtttgttttcctaaattggcgagaaatcattctagaaatgctggccataggatctttgtgtttgacaaacccgtgttttgtaagacaaatttcagcaagttctttttccaattatcataaatttagaattatattttctgtcttcatccagtttcacactgctctaaagaactacctctgattgggtagtttatgaagaaaagaggattaattgacttaatagttccacaggctgtacaggaagcatgcctggggggcctcagaaaacttaaaggtgaaggggaagcaagcatggcttactatggaggagcaggagagagaaaatgaagagggaagtgctacacacttttaaccaaccagatctcggtgagaactcactcactatcatgagaacagcaagcgggaaatttgcacccatgatctgatcacctcccatcaagtccctcccccaacattggggattaaaatacaacatgagatttgggtggggacacagagcccaaccatatcagtgaaatcctaattgatgagactttagccacaatttaatgatataataaaactttctaaagataaaagtgtggttaggcatggtggctcatgcctgtaatcccagcactttaggaggtggaggcgggcagatcacaaggtcaggagatccagacaatcctggacaacatggtgaaaccctgtctctactaaaaatacaaaaattagctgggcatggtggtgcatgcctgtaatcccagctactcgggaggctgaggcaggagaatcgctagaaccaggtagttggaggttgcagtgagccaaaattgcaccggtgcactccaacctaggtaatggagtgagacgctttctcatggaaaaaaaaaaagtgactagaccacagtactatcttgtatactaaagaaatacagagttaaagagatgagattataattatattgcactaataaatggaaattcgtcatctttcctcctgcaaagtttaactaaaagacaaatatcttgttcaggaagaagcttgtcaagttttcattcctatcactgattatcctacaaacacacacacagacacaaaagtgagctaatttaagaaatcataaatttaaattactgagagttttgttataatgtttgaggtatatctaattttcactataaactgtaaatgctattataggagactcagaaaatgcaaaaagctagaaatttcagaagataaaattattcagaatcccatcactgcaaaatgagcactgtaaaaattttcatgtttgaattgtttttagtaataataattttcattctttaattgaatttttaattaatttcaaaaaacgtttatagctaatcaaactctctggtcattcagttttttgtactcttcagtaaagtccacagtaaaggctaatctgaatgctgacatcactgcctataactctctctgttgtggtttagccattttagctcccctttcaagaacagtaattccccctgaactaaatattgttaaccacagataaagaagtacaaaacaaagcctatgttgttttcctgtgaatccaaatgagaaataacgactttaaagcatttgatctatccctttaaaagatgtaacacattggagactataaatcttctccctataaatccaacagagcttttcttatccttcatcgttggaacagtttcttgtttgtttgttttgctttgttttgtttttatttcagttcagaaccatataaagtaactgaattggttttaggtcaaagctatgtattttttggtgtcatcaaatattagaatcactcagaatggcaagatgctcacatcctgagaagtaaacagggatggaagccaaccataactccaatctcactcagggtggtgagttcactaatcagcaagagcttatttaagtggaatagtgagagtacttgctcaataatttgataaaaatttcttttttaaatgaatgcatatggttaaatttgtgtaaattaagtatgtgtatattaactcacatttattgatgagattctactgtatttcatcccaactttcattagaatacatattctttctataatttaagaatttccatattgaaacctgcaaataatttgttctctgcttatattatccgaatgccctataaacctgtctgatacttaaattctgaatgaaacttctaggagatgtaagatgataatatccagaaaaataaagaggaaaaaggatgaaaacaacagaatgtgtcggtataaggacatgttacaaagtttttactgggtttagtctgtggttggtttatcattatattgcaaaaaactctcccataaactactaatgattgtaattcctattaaattgggctttcatattaaattgtttaaattagttctttactctgtaagcataatcataatccattgtcccccattagtcaatttctgctttgtaaaattaaatattctgaattttaacatgtgaggcattgaaatatacaatgcttttcacatacccaagacagaaagcctatgactaaacttatgaagaaacaaactatagagaaatagctgtgaaaaaatacttcttattgtgataaaaatatcaaatgatctgtttacagggagcaataaaaggcaccatttcaactttcaacataggttgttccttttcatttgtatttccaggaaagcgctgaaataaccaatagtcatccagtttaattattctttaaacttttttaatttaagctcaactatttgaatcatagcaagtttgtaagtttcacaaccaacgtcttaatattaaaaatgaagaacttaggcttagagagattgtatgaattatctcacatttttgcacttactcagtagcagcattagaacccaaactcaaatcttttccccgtcaagtattccattagaacactacagcatgttctattttgagtctctctaggctaagactacatagttcaagtgaaaattaataatgcataattaattatttgccaaacaggaggaatatttaaggttaacctttatcatgcaagcaacaattacttagataatacaaaatcaactgatttgacactttgattattataaatcacaaaacaaataaaaaactaggaatggctcccaggttggcccatagagggattattaagatccctacatgtattcataaaagtaatgcaataattttgatttttcttagctctttatgcttttcacactcaatattttactcttatagtgacttacaggcatcaggaaaatgcagaaattaattataagaagtgttaggacttgcctcaattctcctgctaatccatgtagaaggtcttcaacctcaggtctgagttcttatagaaatcaaaacttttataggagtccatgctttcctgacaacagacaaacattccaggggttccttgagacaaagccatgtacacaatgcaggtcccagtttcttggacttctttctattatcactaatatatatagccatagagtaattttaacttacaaacttttgctccctccaacttacaatcttttgctccctcctggtaatctctctctctctctctctctctctctctctctctctcactgtccactagccttggaagaaaccaactgtcatgtcataaggacactcaagcagccctacagacaggactttgtggtcagaaactgagacttcctaccaagaaccataggattaatccattttggaaacagattattctttagatgaccactgacctggtcaatatcttcactgcaacctacaagaggctctgaactagaagcacccagtaaagcaggtcccaaattcctgacccacagaaatagtgagataaatgtttgttgttttaagctgctaagtctgtggtaatttgttatatgacaatagatagcaaacacccactatgagaaatccaggttaactactgaatctgtttcttcaccgttacaatgagataatagagatataaatatctaacatatcgcattgttgtaaagataaagaatataaaaaacactgtccctagaagacagtaaaagctcaatgaatgtcattttttatttttctattaatattataactatcattatcaatctcagaagtttgccatgtttcataatcttttgctggctcatgtttacttcattagctgagcaagtgaaattcatacactaaaataaatacagataattgaaattaattatagagaacagtacaataaacgtattataagaaaacactaagaatattttcatagctttggggtagaaaaatgttccttggcataatccaaggtaaagaccctcaaaaagttgagagatatgactacataaaaattgaaaacatctttagagtaaataattccatataaaagttagaagtcaaatgccaaaagggtgaaaatattttatatatgtcaaaaagtgagtatctttaaaatacagtcttacaaaataatgagagatacatataagcatgtatgggagtgtgtaaaacattttttacagcagaataaaacaaaaacatgcaagtaagtgaatggaaatttcacagtagttcaaatgactagtaaacatataaagagatgctcaaaaaataaaggaaatacaaaatgaaaaagtcatgggtatcactttttaccttggcttagactgaaaatgtttattatcgatgagagggtagagaaactagcacaaccctgtgagaggtaaagaattcttgaagagtattctggcaatatgtatcataaccttatatgtgctccctcatgcccctgcaacctggcaatgattttatcctaaagaaataatcataaaagtcacacatgatttgcaaagagtcatggacactgatacacataaatacttgaaaaacaagcatctttcatatttttgcattttaacaagttagcttatagaataatatgtattatatgttgccatttttgtattttaaaaagtgtcttctcttcaaaagttattttaaaaataccgaactatactaatgattgcgtgagggtatgtggatagcatcaggaggatcttctgtttatatccagaaaataataaaccataaagctacctagttgtttaatagtcaaatcttaccatctcaattttatggtacaccatttatgtaagtggttatccatatttcattatagggtgtttgggcttaatatgagaaaaggaagagcaaagaagtagaataaggaataatgtactctctttatttaaccagaaaatatggattgagatgtagctacttaacaataacaggtttgtgtctaatgagagcctcaaggagttggagtcattctgttgtagcacatatctattccagaatatatgtgcttgtataaattctgttgagaataaaaataatctacatactctaattacttaaacataattttcaaaattattatagagtcaaaacagttaaccccttttcattatccttctgtcttctctaacacctctggtggatgagctgctattgcaactgtcattgcaattattgattgcaatttttgtcattgcatttattgatataagaaagtttaaatccattaactttaacttcgtatttcttttctgtcccatgtgttctttatttttttttctctttgtctgcctttttttgaaatagttgagtattcaatgttccattttatctctattttggccttactgttatatctctttattttgtaatgattattgtagggtttacaatatgtaacttttaacttatcaaggctaccttgaaataataatataccacttcatatataatatcaaaccatttcaacaacacacttctatttccctgctccaattatttatgtaatttatgtcaaacatcttactactatataacccacaatacattgttaattattttgctgcaaagtgttaccttttaaataaaattttaaaagaaaaaagtgtgttatatttactcatatatttaccatttctggtactcctctttactttgtgttattacaaatttccatcttatttggtatcattttccttcttcctgaagaacctccattaacacatcttgtagtgcttgtctgtgggtgatgatttctctttcagcttttatgtccccaaaagtctttattttatagaattctaggttgactctttttatctttcagcattttaaagatgtctatattagtccgttctcatgctgctaataaagatatactcaagactgggtaatttataaaagaaaaaatttaattgactcacagttcagcacagctggggtggcctcaggaaacttacaatcatgatggaagaggaggcaaacacatccttcttcacatggcagcagcaagaagtgctgagcaaaagggggaaaagccccttataaaaccatcagatcttgtgagaactcactcattatcatgagaacagcatgaggtaaccactcccgtgattaaattacctcccaccgggtccctcccacaacacggggattatgggaactacaattcccgatgagatttgggtggggacatagccaaacatatcaatgaaattctaagtcttctagtttatattgtttctgacaagaagtatttaatatttgtgtcttcctcctgtacataatgcctccatttcctgtctctttctgggattttcttgttatcaattgttttcaacaattttagtatcatgtgtcttgatgccatttccttcatttttctcctcttacttatagttgaaatctctagatctttgtaaatacagttttagtcaaatttgaaatattttcagtggccaggcatggtgggtcatgcctctaatcacagcactttgggaggctgaggcaggcagatcacttgaggtcaggagtttgagaccagcctggccaacatggcaaaaccctgtctctactagaaatacaaaaattagccgggcaaggtgggggttgcttgtagtcccagctactcaggaggttgaggcaggagaatcacttgaacccaggaggcagaggttgcagtaagccacgatgtgccactgcactccagcctgggcaacagagcaagactccatatatatatatttcagcctttgattgtccaagtaatttttcttccttccttccccacctcctttttaggactaacatacaggttaaactgcttcatagtgtcccataaatctctgaggttatatttgtgtgtctgtttcaatcttttttctcagattgtgtgtgtgcttcagattggatagtttctattgctatgtcttcacattcactaatcctttttctgtagtatctaatatcctgttataccataccaatgtagtaaattttttcattccaaatatatttttcatctctaaaagttccatttagttcccttttatgccactcatttctctcctgatcatagtcaagctttcctttaaatccttgatcacatttataataatggttacaaaatatttttcttctaattccgtcatctctgccatttctgaacgttttttcattggtaatttttttcccagttacatgtcacattttccagctttttcatgtaacataaattttattttgatgtcattcatcataaactttttgttgttgactgctgaattttgttgaacttcacaaagtattagacatttttctggcaggctggttaatagcttgcagatcagtttggtccttttgagtcttattcttaagctctattagggcaggcttgttaggccctactgaaaaagaattatcctttttgggatctcatttccctggctattaacaaagtgtctccactttggctgaacaaaactcaaacacttccaatccgcgaaagctccaggagtggttcaccttttcagctctctggttgttctttgccggccttctggaggtttacccaaagtatgcacagtttaatattcagcattcaataggctcaaggcaatccttttgcagatttccaaagttccttgtctgcatatctcccttcctccggtattctacctgcaaattctactgcctcatctccctgaatttcaatttctatctcctaatctcagtgtgatcactgtgctctgtttaggtttcccttctgtacattatgatcaggaaagtacatccaagcataaaattttttctatgcaacagaagaagatattatttttaagtgtatacctctccctattatgtcatacaaatttcagggcttattttcaagaaccatgtcttttatatggtatctggttatgttgttactattttgaaataaaatacaggaattgaatttattcagtgtttcatctttgaataacctgaaaattgtatagtaattccttatcttctcacccaaaccactgatatataaaatactatttaagacgacaagatcaaacaaggtcacttactatcttcctttgggcatacctatattttagccatgcttaactttgtatcattactcaaacaacctcttttaacacccatcttcttgattctatttttaagagaatgagatctatggtaaactgtctaagttcaaatcctgacccaactagtttataaagcaagttatacttaaagcatctttgacttcatattatcatgtccatgtagaaataataatatagtctacctcaaaatgattatgaagaataaaagaaacaatatacagtcaatgaatgtgagctaatgttatcacttgcaaaccttttccctatttctttatatgcaaaccctatccgtaattccatttcagttaaaatgccatctctacaggaaggctttcccgggatccatgctgagaggattctttcttaagatactcatcacagggcatttatgtgatttatatttttcttcttagcttctatactaagcaattaagttcttgaaaggagcttccatgttttactctctcttttttcaaaaagatatcccacagtggacagtaaattgctttgtatttagtaggctattcacaaatacttgcctcagaaaagaaaattaaacatgactatatgggggaagtttttcaaataacttatgaatctccctaaatctactgccatcattttatcaaatcccttgtttacaccaagatacatatgtttgcaaaattttcttagctaacaacccagttaactttatcagaaaaggagaaatgagattagtatgacatgacttgttcttggtaaaataacaccttggtttctacatggtcacaaataatctattcaatatttcagaattttgcaggagataaagttaactctgtaggttagagaattcacctttatttcatctttaatattttatatgtttgcttgtatccattattttatatcttccgattctccaaatatgatcatttctggaagttatgatgttcagtcaaagaaagtttagactttggagcaaaagtccttaggtttggattccagttgttctgatagacagcagtgtggcttgaaaaagatatatttactttcagttaacacatctataaatggagataataaaattttcttggagcatggtgattattaaatgagaataagtgaaaaggtatgacctactgcctactgctaaaaactttttatttgcttccttttggtttcctcacctgcaaaatgcaaatagtcatccctgtttacttttcaggattcccttaaggattcagtgaatacatacattgtgatactttgaaaaacacacattatataaatatgcaagtttttaaaaaaattatggtcattattattcttgaataaaagttaccaaactctgtggacttagattgtaaatttgccaaaatagtctcctattaaccaatttattgatttccattcatttcttctaatttgaagattattcttcttggaaagaaaaatataggcaaaatatttgttcatcatctctgccttctctgtgtcatctctgaaaattatgtcatattctcccaagtaatgcctctatctattcagtctgaggtgacttttcaaatctcttctaaaagtttacgattttacaagagtaaattagagtgttcttgtacacacacacaagagaccaaaaaaaatcagaacacattttcacaaacagctgaaactatttaatatgggtatccttaaaaacaataaaatattatgaacagtaaaagtcaattatttattttatgacagaaatatttcagtgtgattatatctgagtatatcttcaattttttttgttcaggcagcaagcattggtcctttttaccaaccactacaaattatgcaccctaaacattatgcactctatgctataaaatgacaatataaaaatataatccaatctacattaattgaacataaagtacattctgatactcagcttagactaaccataacacagaatttgtcattaaacgttcagttcacacacatacactcaaaactgatccaacaactcctattatgccagttaccagcattgccagcccctttgcccttcactgcctggagaacgtccatcagaaacagggaagcagagcaaactgccacaatgcaccattgatgtttgagcaaggctgcctaagcagctgcaataacagggcaactcttcaaagtgtcagcattgaaacttacaattctctctcccatacactatcaatgaaaacctttataagctacaatcaattataaaataaatctttgagacaaatcatgttctttcttcatttcttctctccttcttttcctcccaaaaccaaatgtccttggttaaaagaaaaattcaaggagaaatatcccccctttctatcttggtctctgcctctgcctctcttatgtctaaaaattctctcaaggaggtttaaggatatctgctaaacacttttgtttacaagacaagttctggggttttttgtttgtttgctgttgggtttttattgttggaatgtttttattttaaaaattcaaaaggcacttgatattttgagcacactcatactagatttttggcaaagcatgtttttgattattaaaagacaatctaaattctgaaatgcatgcaccaaatcacataacctccatatttttgtaaaccacaacaaaagtgcctcatattagctacagatgaatagctaatgagtcagcaaacagttaaaaacattccatgagaatagatgcactagccatgcaaagtttttgagggaaaaatatattaagtatttaaaaactacttagaatgaagggaaactattctttctttaacaaagcaactatgtttaatttgtcttatgattatacctaccaaaccaaatgaaagtttatctgtctttttctatttctccttagccatcaatagttaatgcctttttaaattttgtaacatatatttaaggtctcagaattgtagcaacaacttttagattcttcatcattgtttttatcattcaaacagcatgcgaaaaccccttcaaatataatgtcaaggtataactctaattcctgcagataacaaaaatatatacacttcatcatgagttaatctactacctgaacaatcaaagtccaaaatacttggtatctgagttcagggtgcaataataataaattgccatagacttggttaaacaacagaatttaacaacaaaaatgtatttctcacagttctgagggctgagaagtctgagattagaatgccagcatgaccaggttttgatgaatgcctttgtcctggtttgcatatagtagtcttctcactgcgtcctcacatgatggagggccaagagacagagtggaagcaagcttctataagggcactattcccatcttgagggccccaccttcatggcctaattacctaccaaaggccccatgtacaaatgccatcacattaaagattaggttttcaatatatgaattttgaggtgacacaaacattcagctcatagcatttagaaatctgtaagaatttttagttatcatttctcattattgtcaaagcaacacacacacacacacacacacacacacacaaacacacacacacagtttaccagttaaatagtaccacaaagtttatacaaaatacagcatcccgtatccaaaactttgaccctctgccaaaactcattctagtgtttgcctgatttctaaataatatgcttctattgttatttttatttataaattttagacataatatattaacttcctatcatggcagaagacttagttctttgatactacctcatttccctttcttccatccttccagtaatcagtgaagtaatatttttgaatacatttggtaccttgagtagtaacaatatttccttcctattgttaatattgtcactttgccccccacattcccaaggtttgcaacagaaatgtaaaacctctataaatataatatttcacactcttacacatgaagaatcctattctaattctttcccctgaagacatccctttcgggagttctccatcttctagctcaagtaaagactgcttatttttaagatcaatgcacagaagttatccagtaacttcccttcacctttctcacctcattttaatcacctgtttcctgaaccctctatcttggtcttttctcctcagtttttcctcacttggacgtagcatacccttgaaacaattccggagaaagcaagtgtgggggtacatttggagaaccatgtgtctaaaaataaaaatgttttttctacccttatacgtaattggtagtttgggtgtagaattcaaagttaaaagtaattttctctcataattctttttttttttttttttttttttttgagacggaatttcgctctcgtttcccaggctggagtgcaatggcaaaatcttggctcactgcaacctccgcctcccgggttcaagtgattctcctgcctcagcctcccaagtagctaggattacaggcatgtgccaacacacccagctagttttaaattttttagagatgaggtttcaccatgttggtcaggctggtctcgagctcctgacctcaggtgatccacctgcctcagcctcccaaagtgttgggattacttacaggcgtgagccaccgtgcccggccttctctctgaattttaaagccacatcttctagctttgaatgttgtcattaagaaatcagataccattctggttcttgagccaatgtatgaggcctatatttctctcgggaactttctattatcatctatttattactgttattttgaaattttccaattatgcatcttggtgtggaattgctttcacatttttatgggcactcagaagatccttccaaactggaacctttggggctgaaaaattttaccatatacttttataacagtttcctccctatcattttctttgctctcgcctgccttctgaacttcccattaatcagatgttcagcttgttggatcgtttgtttgatttttatctcttctctcctattttccatttatttgacttttttttgctctattttcaggaaaatttctatcatataaaagcttatttcagttattataaaagtgcttattctctggttatttcttctttttatataatcttgtcatgtttcatagtagcagtatcttctgctatctctctgagtatattaattatactttatttctacttcagctactgttttctacaggacatactgcctctaattcttaaacaggttctggagtatgaactgtcttgtttctcattgacacaacactctccagtcacatgtattcggctttcccatttctgccagttcctcctttacatcttccaaaagttgtgtctctttaatatgttgcttcctcttccttatgcctgtggatttatatattttttagtcttttgctcaaaatttttagtcccttactaggaaggaacatggaaaaacatgtgttcaatcacgaagtttaactggaagtctgctgttaaatttcctgaagatgttaatcctagagctataatcatgctattcacagggtcataaaatcatagggctcttactataaaaaggttatcagagatcatccgattcaaccctcttattttataaaagtgagaaaatggaaacccaaagaggttaagtggtttgtgcaaggttatttaaatagcaatccatacatttggtatttgacttgctttcattaccatagtgcctcctcaaatagatatccccttaaagtagtgactcagaagactcccagacacatcctagggttaacacatttgaataagccaatctagcttttggatataaaatggaggagagctgtcattaaagaaaatctgggaaaaaatgtctccaagaataaatatttgactctggacatcctgttttctactagtagaaattccctaatcaatactctcccatgaaactcattccccttattcagcttcagcataacacacttatcctaacttttactctttcaggttacagaatcacatcatattttctcaaagcaaggtaaatctgtgtttgaaattcaaatgaatcttttatatctttcctaagtttctaccctcaattccttcctgacctctggctggccaccaacctcctactcctaaaatagtccttttttttttctgcaaatggcaccacccaggtactcgagaaaaacatcttgagagtcatcctaaacttctctttttctttaacagcatccaacttccaccccttcaccgatacagtacccaaatcttatcaattctacttcctaaaaatcccttgaatccattcctcttaggttcctcatagcttcacagtcactgtttcagttcatgccctcactatacttcaccctgatttccattaattgtcttctaacagtctcacagactctggtctgctttcttcataccccttcttccacactcaattgctgaagtgctttttctcaatagaactaagaagtcatttcctcacttaaaacccttcagaggatcccacctcatttctgacttcttagtatagcatatataaggcacttcatgataggcacctacttatccctccatcttcatctcctgtggctcttcaccttgcatgttatggaactagaaatcagaaaatcaaaagtctcctctcgggtttctattcacactggattttcaacaccaaatgccaaatgtcccttcccctgtcttctcccaaataaaggaatccaacaaaagagagtgaaaagattaaaaaccagttaaaaccatttaaaattattaaagtgcttttaccataatattttacatttatatttataatattttatctttatcttttagggattatagtctgtttaaatatgttggtagtacattaaattattattcagaacactgaagatgtaaattaaatatgaccataacaataataattagactcttatcatgtgaaataattaaggaattaacacattattatagtaagggccaaatctaagaaatgtactataccataccaccagactgcacacttttagtagacaggactgtgtcttaatcatctttacattccctactatgccaaatactatccccaacataatagatgcacagtgaattagtaaatgattaaataaaattagaaataatatcacacccacaaacccgggaagcaattatttgcctactacttgatgaggccaataattcaatgatatttattattatagttgatcgagttagtcaaatgtcatgagtgcctcttaaaaaatttatatatatacacacatttttctgcagatctttatacggaacatcaatctaatctttatttgggcatataaatcattcaatggataacacagtgaaaattttcaacataacagaaagacatatgctatttgaaaaatcagtaaaaaaaaaaaaaaagatgattctattgttggtattcttatcttcagattgtcctccacagcacatccctctgatacagagaaataaaaactttcttacctagaactctgatcaagttactgccttttataccactataatgatattcaaactggcttctaagcaaaatagaacagaaacattgcacatgcacatgcacttgaattgtacacttcttctatcgtatcaacttcatgtaccatgatatgctcgccattaatatgcactaaagctaacttgctagcctgccgcaattttattgttgcagcaaaacaatagtggtggattaacccatcacctcaagtttagcaatacatcctggaccagttatagatatgcattaatccacaacttaaaatgtaaaatatcaaggagctgggccaatccaggcatatgagtcaagaacacagcacttcaaacatatccaaactgaaactggttcttttctctgcctagaaaggtacttaacaatgggttctgaatatcatgttgactgacaggtatgtcatataaagaaggaaatcctcttaaatcttacctccttaaaaatatcaggtttaacagaagagtatgatgtgtagatccctactagatagaagcctgaatacctaacccattatataaatagtatgtattgtatagtatataaaggctgcgattttctgggctgctgcctactttttatgttttactgttgtcttcatgtaaaataactgtatggaaatggtatacctaaagagacaaaacgggtgaaatttaaatcaaccaactaaagaataaacagtataggttaaaaaggatacatgttaacaaaatgatgacacacagcagaataaagaaaatatatgaagaatacacatctgagggcaaaaggctgaggacagttgaaattgatagaatttgtaatgactgaaataaaagcacaagaaagagtagagaagaaacttgaataatattcatagataggaatgaactgtggaaattccaatgccatgataaggcacgatatagaatgattgtatttcttttatccaaaagcttcacgacaggtaaagatagactataatctgaagaacaaatagacctaatttccattataggccccgaaagtgaccaatagtgatacttataatatttaagaaagcaactgggcacttaactttagattataccatttaaatttttttcaacttgggaaaatgtttcaaattccactttgctacctacttgctttattttttaaaaaattagaaaaatgccatgtaaatcactgtagatagtattgcattgcttgtttgaaaaaaaaaaaagttgacagtttgatagtgcattcattcttatgcctccagcactgaatcaaccactataacattcaaaccaagaggaaactttcagcagtcttgatgctgtctcctactctgaagtgtgagtctcttttctacaaagagcacatgcttagggaggaaaacaggatatgaaattacacaaaaatatgtgccccagcattcagaaagaaagcaggtaaaagcttaattctcctccaaaaaaagcagtttctaaatgtggattcattaatgaaaacttacaacctagcagtcagcagaagcatttaggaatggaaggcatacagtacaatgccaactattagaatcagtgttctactaccacacaactattctagcttagctaacagtcttttttgtcacgacttttgtttctttttcctttgtttcctctgttttcaatcgggagagaactgtgtgaagctgagtgttcgtttaagtcagaaacacgttggctagatctaggttcagtgtgggtgagtactgtgtaagcattccacacacctccactaatatgccacgaactctccatatcccaagctttctgataggattcagttgagactacacatagcgcttttacttatgtcacacatgtgatctcaggtctcagcacgtactgacataggtagttaccatcaaacttgctcttctcataaatcctgagaaaaaaaggtaggttggaggtagaaaatggacagaatgtctctgctaacctaaacagaactagtatgtgttgctgctaaaatattccaatagctggcagcaatgatccataacattatatttgtaatataagtatacataaacactacaacagatgatctcagattgtcattgataatgatgatggctaactttttttagtatgttacttgtaccaagcattgctctatgtactatacatctcatttaatcctcatatacaaaaaaaaaaaaatattcttgggtaaagttattttcattttcattttacacaaaaggacattgagatacagaaagaaactgaataaattgattttaacatatttaacttatttaaagttaaaacatgaaattatttactaaccctttgatgtaggaccaatggctgtcactgactcttgatctgctatataaagtttcatgttttccttcttgcttaaactacaccatgatgtatcacctatgatttcctgttttggtttatttaaactcaatgacagcttaaaggtacttggaaagcaaactgaatgagggatccttccagctttttacattttttcacccctacctcaggcaatctttcacagttgtctagcccacacctttttaaactgcaatttgttttagcaactcacctttaaaaagtctttccaaagcaccaacttaaatttcataaaatcaacaactctttatatttttgaactcatattttatcagtttgcataattaaattacaattgcacattcatttggcataaacaaattcaaaaacaaacacaaatgactgtagataagcatggcagcaggtaaacagatgaacagaaacacaccattttttcagagtattctgttggccagaagcaggaataacctaagagggagtctactgtatacctaccatttcctaattataaacaatactatttaataggtatattagctttctggaagaatggatttaccatggaaaaatacaaacaaatttagcagggaggttcacaatgataccaaaattctacactagaaaagtaatacattccttcttatctttctttaattagaaattgtaggagacttcttcactgacaaaaactaagagcacaaaattccaccccaaactcaattcagcataagaagactcctacccaaagcataaacatatatactcacataaaaaataaaaaaaacttttaaaattaataaagaaattaaggttttaagaaagaaactttctccctactagagaaaaccatcacctcttggtggggaaaactgaatttaaagttcaggttcgggcagttactacttatgtgatggagtaaatcaattcacctcactgagctatagtatccttttctgaaaaaaaaaagataataataatggttctctcctcacaaaactgtagtcagaattatataaaataaaatatataaagacactctgcaaactatcaatcatcttatacatataaattgttattactggaaatcctagcttatattttggacagagaatttcagagtcaagggaagtcatttcacaaatgacaaggctgtgattcaaaagcctaaattactttcctacttacagtggcatggatgacggagcagaaatagagaattcttgattaaccaggagaagaatatcataggcatgggtgtgagatcaactggagattcaaggaagctaaagtgcccagaatgaactaatgttgtaatgtagactgtgagcagagataaaattccagaagccaaggagtgttgtacggtaagtcctggcagtgc

SEQ ID NO: 614 - DNA, 52831 bp, Homo sapiens
gttatcttttactccacgcctctatcagggtgcgtaggggggtggcttctcccccgggggaaagtaggtgggtgcgtagcacggtggagcctggccgggaagcccagagccagagctgcttggagaagggggctgcaggtcctcagacgaagccagggcagaggagggcgcaactgggaagcggctgcagggctgcaataaacagagagggccctgggttagcaggtgagaccaccccgtgccggaccacagggaagcctgacatataccagggccactcacacgctccccacccaccccgccaacccagggccacccgcagactcagggccattcacatgggccccccgcagacccagggctattcacacaggccccctcagacctagggccactcacacagggccccccgcagacccagggctattcacacgggccccccacagacccagggctattcacacgggctcccacagacccagggccactctcacgcccctcccctcccccggagacccagggccactcttacgtccccctcccccaccgcagacccaggacctctctcaccggcccccaccccacagacccaggaccactctcaccggcccccccacaggcccaggcccactctcacgggcccccacagacccaggaccactgtcacgggcccccaccccacagacccaggacctctctcaccggccccccccacagatccaggacctctctcactggcccccaccccacagacccaggaccactctcacgggcccccaccccacagacccagggccaccagaaggagcagccccagcccggggcagaacaggagagggtggccggggcctcactggcacaaccttggcctccacagctgcatggggcagggggtggacgccccaggaagggtgtcctcagaccacatcccacttcctcacagccagcgagcctctgacctgactccaaaaccaacagttagggtccaccaggcctggggcccctgggctcacccaactcttcatatttgggaaaggccccacgtatgaaccccacacgtccacacgtccagcagcgtgtggctggttcagtgtcaccgtggctgactcagcggctcacacacgcatctgggtgttgccgtggaggcatcttcaggtgtgattgacacccttgcgtacagtgcctcagcccctggacacggacggcccctcctctccactgaaggcgttaaggaaagaggctgtggtccccaggagaagtggactctgccccagtggcctaggcactcccggggcagcgtcaccctccctggtctccagcctgccccctccctgtggttgtgcacctgaagcccacagtcatcagccagtcattcagaatcgatggattgatctctctcttcatatgtaggtacctgtattctcccataggctctgcttccctagagagccctgactaacacacatagacccacccaagtaattctgagaccagaaaagcgaagaacggcacagattttaaattgatacattctagtttttctccaactgctaacacacatcttaattcttttctttttttccccttaaattctagggggaacttctaatcaaattttaaataaataaagcaaacaaactccttctaagaaataacacaggaagagtttttcaaactccaagctaccagatgtgctctgtgctcctcttgccccagcctgcagggtcccatgagaagccagctgcctgtctgagcctgcgtgttcagcatccccagagaagccagctgcctgtctgagcctctccctggagagctctgcactgcagacgccctgggagctagcaggacctctggatcctgacagcagaatttctgcacaggtgtaggtaaggctgagaatggggcccttcctcagagggactgcaatgttgaggttgacagcccaggctcatgggatccagtggttcagggacacctgccaacctcatttctttcttcccccgaaactcacacaggtttctggccacaggcgacagagtgagacactagggaacattctctcaagtctgctgggagctcccaacttccaactctgtagcacccactcttcttcacagcagatgagcagttaaggaaactaaggggtaaaccccaggaccacagataaaccccaggaacccatggagtaactccctaggaaccaccgagtgaaccatggagtaaaactcaggaaccacggagtaaacccccaggaaccacggagtaaaactcaggaaccacggagtaaacccccaggaaccatggagtaaactctcaggaaccacggagtaaacccctccccccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacatccaggaaccacagagtaaactcccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacccccaggaccatggagtaaacatccaggaaccacagagtaaactcccaggaaccacagagtaacccctccccccaggaaccacagagttaagcccccgggaaccatggagtaaacccccaggaaccacagagtaaacccccaggaaacacagcataacctccccccaaaaaccacagagtaaaccccgaggaaccatggagtaaagccccaggaaccagagtaatctccccaggaaccacagaggtaaacccccagaaaccacagcataaatccccaagaaccacagagtaaacccccaggaaccatggagcaaacccccaggaaccacagcataaatccccaagaaccaaggagtaaacccccaggaaccacggagtaaacccccaggaaacatggagtaaccccccccccaggaaccacagagttacaccgccagaaaccacagagttaaaccccaaagaaccacggagtaaacccccaggaaccacagaacaaacccctaggagccacgaagtaaacccccagtaaccacagagttaaaccctcaggaatcacagagtaaccacccaggaaccacggaataaatacccctggaaccatggagtaaactcccaggaaccacggagtaaacaccccaggaaccatggagtaaaccccccaggaccacaaagtaaacccccaggaacatggagtaaaccgccaggaaccatggaataaacccccaggaaccacagagtaaaccctgggaccacggggttaaccactgaatgacagggcccccctagggacaagccctgcccacgagtaatctcacaggggaagggagggcatgtttcttagtaacggggcaggaactcatcttctgctgtgatgccacgtcctcccctgcacttcatgcctggcaaagctgctgggtgcaaggaaggtgatctctttaaattgtcctttttattaactgctcaaaacctcccccaccaagtcactgttccccatcccccactgtctcaagtgggagtattttctgctgctaacgacttccatggaacaccctgaatattttctctccatctctgtggaagcagggcccctcctccattgttcttctgaggagcacatgagcctcatctgatttgccatctctgaaatccaattatcagcgtgcgtatattaagctcccacacatgctggcctggcacaaaggctggctgggccatctgagggccccaggcctccccagaggaagaggggaacatccaccctttgcgtaaacccagagccccagggtggatgaggatggagcaccatggggatgaagtggatctgcccctgtgccccccacgtcccgtaagcccgcgtgtgacggggaggaccaccccccacatcccgtaagccctcctgtgatagggaggaccgccccccacatcccgtaagcctgcgtgtgacggggaggactaccccccacatcccataagcccacgtgtgacagggaggaccacccccacatcccgtaagcctgcgtgtgacggggaggaccgccccccacatcccgtaagcctgcgtgtgacagggaggaccaccccccacatcccgtaagcccacgtgtgacagggaggaccacccccacatcccgtaagcctgcgtgtgacggggaggactaccccccacatcccgtaagcctgcgtgtgacagggaggaccaccctccacatcccataagcccgcgtgtgacggggaggaccacccccacatcccgtaagcctgcgtgtgacggggaggaccaccccccacatcccgtaagcccacgtgtgacagggaggaccacccccacatcccgtaagccctcgtgtgacggggaggaccgccccccacatcccgtaagcctgcgtgtgacagggaggaccaccctccacatcccgtaagcctgcgtgtgacgggaaggaccacccccacatcttacacctccgtggggctcacaggcagggaggacacacctgcctgagggagtcaccagcccctccctccacaaagcctcactgtctccaaggtcccaagtcagaatgcaaacttggagaagccgggcccctcacagccagagcttcagacagccgggccccagcaccagggcggcccaaaccagccctggagccagagaagaggaaggggctgatggaaccacgtgttgtctctcctctggggccctgaggggcagcggctgaggttgaggatggaagacagcatgggccaccgaggctatgctctgggctgcacgttcttggcacccatgcgattccaagtctgtgtctgtgtagagccgcttggggagcacctgcaggcccagcgtccctggagatacctctgcccctgcgggcctcctccttctacccctgcgggcctccagttctgggcttggcaaacttcccacgggagaccaggaggccagagagaagcccccaggacagggctgtggccctgggggcacggtccctgccatgatggggacgtccctggggcaggggcaggaggcttggggaaggatgaagctgcctgtggcaccaagcagacgcgcctgcctgcaggagtgaccactgcagggtcgctggcaaaagctcccgccatctgaccctggggaccacatcttcccccgtcacagaaatggaaaagatgtttccaggccagacctccagcaggggccttgtgttcccagggagcagggccccagctttatattcgaagtgagaggggagactgaggtatgaggtgcagggatccctccacgaggagatgttgtcaggccctggtcatctccactgagcccaacagctgctgtgtcccgggcatggctgaaggtggctgacccaagcaggccctgaacgcgagggacccccagcagccccacaggcccctggaccccagggacccccagacgcaccatctccatgagtgctggttcctgctccctcctcggggtccctggtgcaggtccccaggtgagctgagaaggtcgtggctctcgggccccgctcaaacctgagccctctctgtcctggacgtgagggcagagtgtgcacaggcctcccccggatgtccctctaaggaagatcttttcctgacaacgtcatgtgtcgggagagggtcctcttgtggaatatctgaagacctgtgtcatgtgtgacttcaaaactcacgactccccacgttcaccctgcccttccccgcacagaaacacatcacggtgcctgctttaatctgcagcttcatcgggctgggcctgacacagctctctctgcagaggctgctgttaactcacgcaaaaggacctgccagtcagccgggcatgtgggcagtgcctcccacccagaaaggaagcccacgtttatcaggaccagggttctcaactgtgtccccgggggcacacggcacgtccaggcaggagacacgggacacgtccggagagtttgggttgtcacaccggcggctctgatatgccgcaggcagaggccagggcccaccagcaccctcagcacctagggtgccccagcacagcggttggccagccctgaatgcctacagtgccgaggtaagaaacgtggcccggtctgtttcacccatggccacagcacagagcttcatggcacagaaggcggtcatgcccaggagtggaaatcggacaggcaggcaggggccactgtcctgctcgccccccaccatggcctctccctccgtcatctccaaggtcaatagcatcatgtcaggatgaaccctatgatgtctccacgtctgcgggtaaaatggggttggattttggcagatccatatggctccacctaaataacctggccatgcccacaggatgtccaccagcagacaaacgcaggagcctccaccactgcagcggggagctgcccaggcctgtgcggggccagccccggggtcagaagagccagctgccggcagagcatggtggcgggtcaccagggccacctggcgcggtccccggccatacttgcagggaggttgtgccctgacggcagggttgtcactgccccccacctcccatccctaatccagaaggtgaggcggctgcaagacctcatcccctccgaccccagccccatcctgtccatcccactgcctgtgaccagcgcgtccaactccagcaggtgatgctggccctacctgaaggggcagagggtaggacgagcaggtcgggacgggctcgggcgtcaggcggaagcctgcgtaggccaggatctgctgggcggggttgtagagggtctgtggtgggacggctgggccataggccagctgggacagaggcacctgccatggagaggagacgggtggtcggcgtgtaccccctagtggagggaagggctgtccagccttcctagaaagcccagcaccctcgacccccgactctcaggctggaactaaccccggcccggcgtgcgtttatacccaggctggagctaacgccggcccggcgtgcgtttatacccaggctggagctaaccccggcccggcgtgcgtttatacccaggctggagctaaccccggcccggcgtgcgtttatacccaggctggagctaaccccggcccggcgtgcgtttatacccaggctggagctaaccccggcccggcgtagctttacactgaggttctctacatcttggtcccagggccccgccacctgctagtcacactgggtgaccgctcggctcgggctctcttttacttttttgattttttggggggggagaaaaaagcactggtttccttctctccgggccccaaagtctgctttttcggcacagaagggtgcaggtggggagggccctctcagcaccgggctgatggctctcgcttccccaagcctgtgccccaaccagcgtggggtttctggggaatgcgaacaaaaccaaagtctcctgagctcccgtccacactttcactgactcactcaggcagttaaaattctccaaagaaggtgctggctccaactcaggccccggccggcctcatcccctacagagggaggggcccatggctcacacaagcttcagggcttccccgggccagaaacgcggggactgggccgagggcacccgggcttcgcctccctccccaccttcacacaggtgcccctccaccttccccagcccccacccccaggttcagcagcaccctggaggaagccaggggaagatggcaaaggcggggaagccaggccagagccgctgcgaggggctggccacggtgacgacccggggacacggtgacaacccggggacacggtgaaaaccccgggacagggtgatgaccccaggcctgaggtgtcctcagacaacggtgctgcccgcacccctggggctgggagggagccccctgcccagcgggcactggaaggtgggaaggggcagggccttctgggcagctggtccttggtccacatgtgcaggaggccgtgcttctgcctcagaccctgcagagagcaggggggcagccgaggtgggcctgggaggttggatgggcatggagggtcgtgctccgtgagggaggggcaggagatttgcagttctgacaggtagaggggtggggaggcctctgagctggcggtggcctgaggatggggccggggcgagtgcacagaaagcagagaacacgggggccacggagtcacacgcggaggaggcccctgagaggctggctcagccgcccgcccttgccggcacgttaagtgcctcccacgcacccatcacaagtaatttgccctcgtctacgaagggcacgtccagcttggaatgttaaggaatgaaggaagcatcttcattccttaacaaaatgtttaaatggcaaaatcagttaaactcacaagagggcctgcttggtgggtgtgaaggttagcaagtcctctccttgctctgcagccctgagctttgggttcgaggaagacttcctggagccggtgtggctctgcattgcgggctggccctggaggtatcacctgttcctgatcctgcactccagcattttatcacgggctttaatgaacacacgagccccttccggaaaaccctggacaccccgggcctgtgtggcgagcatggcgcctgcaccagacaagcgtttctgtgtcctgtctacaatccggctgcagttcctcctgggacggccgctgagaggagacactgagctgccgaggcagagaagcttgcaccgaggagacgccaaaggcgcccggagcccgcgagatcccggcagagacccttcccgaccccagactcccgctcccaccgcaggggccggccggctgtcaccacagagcaaggacccctgggaggtgcctgtcttgtgttggtgtgcgggcgtctgggggcccagggtggggcttggggggccactgggtggggagccagagggctggacctcgggatgccagggtcactctcagcttcaccagttttgtctggaagcacaaaagtgttgagaaaaggaggagctgagaagcagatggcaggagggttcccagctgagctaatttttagtcatggacagcctctgggacgaatagggcatggagaagccgctcaggagtgttttcgctgcctcgctgggccgggtctggcctgcatgatgtgcgtctgcctggtgctgccaggcctcctcatgtgggtgcaagagggggcgcccctcgtccctgggctgccgtttggatactctgggggttggggctccctcactcctggctgcccatcccttacagcttctctgcaagttcagggggcggggtttgctggccgcacaccacgagaacatctggtttgaaacaggcgccaggagagggcagaggagggagaagagagaggacatccggcccgggccagtgatttccctgtggtttcccgggcgagggccggcctttccaggatgggtccagcccacctcccgcgaggggccccttccctccctcctcctgcccaggccaatcctggctgtatgggtctcgcctctggggtttgctaaggcatcagctcagccccagcccagacctgcccatctgaagccccaggcagttgctaatgatgggagcttagtgcacaagggctgggcctccctcttggagctgaacattgtttcttggggacggctgtgcccacctcagcggggaggcaaggattaaatcaggtgattcttgtgacaggcttgggacaggacggccccgaggtgagtcggtgcacgccagctgtcaccctgacaccctgctgacagacgcatgggcttcagtgccccatctgtaaagtgagggctggaggccccccagcccaccccggggaaatggacccggagccccggctcccagtgagcagcgggggtcccaccaaggggcctcaccatgtccttgaaggcccccaggacggcggcggtgatgatgcccaggaacaggcccaggacgttcagaactgcagaggcccagagcaggcggtacaggtgcagcacgtcctggcagccgctgacgccgatgaactcatagtaggcgggcgagggctctgcgctgcacagagagggcaccatggcgtcaccgcacgaggcaagtgaccacccgcaagttaaacttgtgtcctctggacctgagccctgcagggctgggggaggaaatcagggctggagcccagtcaacgcccatccctgcactgctctgggagatcaaacctatgtctgatgggattggcctgtgaggctccccacctggggcccacagtggcaaagagcggcaactgggcctggcgggcccgcccctccgcctcgatggcctggcaggacgggtgtctgggccccggctgagccatctctgtcttcacgccaggatgggaaggccgtcggggtcacgggcccctgtcccaagagggggccatgcctggggcctcagaggccaggccaggtttaaactctcgcccgacacacacgggctgtgtcctcttgggcagatcaacatttcagagcctctgtcttttcatctgtgaaatggactcaatgtcctttcctcatgtaaacatctaaggagtaaaggagacgatgtaggtgcaggggtgtggggggggtgatgtcaggagcagaaggatggaggcctcacccctgcaggcacatacgggggttcccagcgcccctcacctccctcaggtgtagatataggggtccccagcgcccctcacctcccgcaggtgtagatacgggggtccccagcgcccctcacctcccgcaggtgtagatatgggggtccccggtgcccctcacctcccgcaggcatagaggtcacagcagtaacaggtgttgcttctcaccttcagctggcacttgccgtccagggagtgacaggtgacctggggcagagaggccttgtcaggtcacatgccggtgcccaccacctcacccaccccaccaagggcagggctgcctcatgggagctgggagcggccactgaggcccagccaagcagctgcctcccccgactttcccccgactccagacacagaggcttgggggctcgggggccaggacccttcctgcaggaggggtcaggggcacaggctggtcccagaggccggataatcggggctcagaggagaggccttgcttctccatgatcccaggagcagagggaaatatcagggtgcgtgggcagaaggacagagcccaggaggccttcggcgtggggtgcacagaagcctgagagcccggagggcggcagaacaggccccgtcccagggcgctctccccccaggcttgagcactggcagcctcagaagagacacctgccacctctgtgtgacaaccttgaaagccctggccaggggacaccccccaacacacacacacacacacacacacacacacacacacacacagaggacgcctcccctgacacacacacacaggacacctccacacacacacacacaggatgcctcccccccacatacacacatggcatgcctcccgcctacccccccccacacacacacacaggacacctccacacacacatacacatacacacacaggacacctcccccctaaacacacacgggacgcctcctgcctacccccccccacacacacacacataaacacacacacacacacgatgcctcccggcagctgctggagagtcccagacaagctggcaggtgctggccactgagagggcctccagctcctcctcctctgacacgcgtgctgaggatgagaggctgcgtttagttaaagccaggaatccacacagggcaggtgcgagacacacagagagcgccgtcacagagctgtgccctccgacggtcctggcgaaggcggcggccgcccgcgggtcattactccccgcatctcactcacctggaaagagaaatgaggtcacactgccgctgtcggtggctcagggaaatccagaagtttctcggacactgtaaatgtattatccttgcttcttattgcaataattaaattagaaaaatgctaattggaagagccatacagaactggacacgtgcactctgagactgttgtgatttaatgaagcaagtccagaactctgactccagagtgaaatacagcacatcgaaatgtcaaggtcccaaacacagggggcatcaacggttcaccagctgcaggggtgacccccaggaactattagaatcaaaatattcagaccacgcctatgtgcagggaaaaccgcgtggggtcggcggggttagctgagcaaaacccacatgaatctcagtgctcctgctcacctctgtctggtagacatcgtacaagtaccccaccccactggagtaaaactggcatcttcccgtggtgaggggcctcggttcctagagaaacagataaacacagatggaataaaacaggtgcctccaggcgggagaggccagaggcaatttcaggcctgtgggtctcaggctcagggcctcaaggaccaaggccaacaccaacttgagcctcccagacacagaacacaagatgggagactccacgctccctgcagagcagctgggctgctgcatccaggaggccagacagcagaaagccccatgggagggtacctcgggccatgcatattctccatcagtcaacaagggcagcagaagggagacaggtgcttggccttttgaggggcatccctaccaccccacatcacaggtgttaggctcctgcatcgtttcataaaagaaaatattgtctcttctactaggaaggtagcaagaaggatttcagaccaataaactcatccctccaaccatccaatcatccacccacccacccaaccatccatccaatcatccaatcaatcatctgtgcatccacccattcttccttccatcctctacatctatctattcattcatccataatgcatccatcatccatccttccattcatccacatccatccatccacccatctgtcatccatacttcatccatccatccatccatccatgtatccatccatccttccatccatccacccatcatccatccattatccatccttccattcatccacatccatccatccacccatctgtcatccatccttccatccatccatccatcatccattatccctccttctatgtatccatccatcatccatccttctatccatccacatccatcatccatccttccattcatccacatccatccatccaaccatcatccaaccatccatccatcatccatccattatccatccttcgattcatccacatccacccatccattcatctgtcatccatccttttgtccatccatcatccatcatccatccattatccatccttctattcatccacatccatccattcacccatctgtcatccatacttccatccttccatctgtccaccatccatccatcatccgttatccatcctcctatctatccatccatcatccatccttctatccatccacatccatcacccatccttccattcatccacatccatccatccatccatcatccatccttctatccatccatccatcatccatacttccattcatccacatccacccatccatccattcctgtcatccacccattatccatccttctatccatccatccaaccattcagccatacacccatttgtggccctatccaactatcaatccatccgaccatctgcaacattcatggagcagacacagtgccaaatggtaaggataacgagacacagttcttgcccttaagggatttatagactagtgaagaagacagacccataaactgaccattgcaaagtgcttataattgctatggtagaggacagcaggaagtaccaaaactaaaatgccacaaaactgcatcacctgcaaataagctagggtcacattgcccacgtttagttttattagtatttctcaaaggctcctagttctgaaccaagaaaagtattagaaaccactagtaacactgcaacagatgagaatgagaatcactcatcggtcctttgggcccccactggtgaagtactattatggccggatgcgttctaggtgacacagcaatggaggaagcagacacaagtctctgtctctgggtgtttatcttcccctgaggggacagacatgagaccacaggtaacaatgagtagcccaaggggacagaggctccttcctggagagagggcagtgcaccccaaccccacggacagaggctcctgctgggagggagggcggtgtgccggaaccccatggggacagaggcctagcagcacggtgtcctcggcctctctcaacagttggaaggcacgcatctccccatatgacgcccttagagctgtaattcaccatctgtcttcttcctcagcagcacacgaggcagtgccacattttcctcgatggcatctgagctccagtgagtgctgtctgcgcatccgtcctaaagtcagccctgggaggccccggccaggggccctgctttgtttctaaccaagaggctcccacacttgcctagatgcatgccccgcgtggccctccagaatggacaggcgcccgaggtccggaacctggggacacccccgactgcggtcagagactggaccctgctcctcggcggggccacggccacgggcgcctggagcacagtggaaaccaccgtctggaagccatagaatagcaagtcacccagccacccgctgagaaagctcccatgacgcacctccgtgggagtgtgtgtgtgcgcgcgagtgtgagcatgtgggccgtggtgtgtgcatgcgtgcgcacgcacgtgtgttttgtgaatgtgctcccacacttgccttcatataatgaaaccgttggggcagacaaaggcctaacaccaaccttcagtgcctttcagtgtgatttatggaaaaagagggagaaacaatcacaggtttggtctgagagttcatgacaagcaattcggctgctcccggggaccagctgacgcccagatggcgagagcccacccaggagcccagccagggaggaggggggatggcgcagcccaccggaggctgaggacgcacctcaggaggacacagaaacgattccttggcctgcgactttagagaaaacctgttcatttagaggtgaaaagagcgtggtgtggtgtgtatgtgtgtgtggtgtgtgctctgtgtggtgtgtgtgctgtgtgctctgtgtggtgtgtgtagtgtgtgtggtgtgtgctctctgtggtgtgtgtggtgtgtactctgtgtggtgtgtgctctgtgtggtgtgtgctctgtgtggtgtgtgaggtgtgtgctctgtgtggtgtgaggtgtgtactctgtgtggtgtgaggtgtgtactctgtgtggtatgtgctctgtgtggtgtgtgaggtgtgtactctgtgtggtgtgtgaggcgtgtgctctgtgtggtgtgtgaggtgtgtactctgtggtgtgtgctatgtgctctgttgtgtgtgtgctgtgtgctctgtgtgttgtgtgctgtgtgctctgtgtgttgtgtggtgtgtgctatgtgctctgttgtgtgtgtgctgtgtgctctgtgtgttgtgtgctgtgtgctctgtgtgttgtgtggtgtgtgctgtgtgctctgttgtgtgtgtgctgtgtgctctgtgtgttgtgtgctgtgtgctctgttatggtgtgtgtgctgtgtgctctgtgtgttgtgtgctgtgtgctctgttgtgtgtgtgctgtgtgctctgttgtgtatgtgctgtgtgctctgtgtgttgtgtggtgtgtgctgtgtgctgtgttgtgtgtgtgctgtgtgctctgtgtgttgtgtgctgtgtactcttatggtgtgtgtgctgtgtgctctgtgtgttgtgtggtgtgtgctatgtgctctgttttggtgtgtgtgctgtgtgctctgttgtgtgtgtgctgtgtgctctgttgtgtgtgtgctgtgtgctctgtgtgttgtgtggtgtgtgctatgtgctctgttttggtgtgtgtgctgtgtgctctgtgtgttgtgtgctgtgtgctctgttgtgtgtgtgctgtgtgctctgtgtgttgtgtggtgtgtggtgtgtgctgtgtgctctgttgtggtgtgtgtgctgtgtgctctgtgtgttgtgtggtgtgtgctgtgttgtgtgtgtgctgtgtgctctgtgtgttgtgtgctgtgtgctctgttgtggtgtgtgtgctctgtgctctgttgtggtgtgtgctgtgtgctctgtgtgttgtgtggtgtgtgtagtctgtgtggagagggaagttcgttgtgtaggaaatgagacttactgagaggagagacagtcactggcaacccccagcgtggagactgacggtgaagccgtctgagctgagatctgcaaaatgaaattgtacttttttcacgtcgactctttcagccccggaaagcgactgtgcacacaatgacaatgtactcacaatgtgctgtgctgcaaatacgccgtccacgatggcgcagcagaaggcggccaccacgccaaaactgataaacacgatcgctgccaccagctgcaacagaaggagaggtgtgggtgcccagcttttaccaaccccggttttcaaacgcaaaccaattcaaagtcccagctcgaggtcggggcttctttcacagaactgcctcttctcacctctacctttcgtcctatgacttccagccctggccaggccggactccaccctgcgggtcgtcctcacgcgtctattccgcaagacccacccaggcgccttctgcacggaagggcgttgccatccccgggccctcggcacgcgcctctgagaagcaaccccagacggcagggcgtgtgcccaaccctaatgtgtgctcatcacacgcacacacatgtgcatgcttgacacaggcctttacagtcatcggatcagcttcacacactgtcgcacaacctgcttttcctacctaatggtcttggagcttggagccaggaatggtttatagtgcgttagttaaccagtgcactctgatggatagttaaacagttggcaatttcttgccactacaaactctgctataaagcggggtgtcctgccctaaccctaaaaactagcagggagtctccatccccgtggacccctgaccagagggcgggtgctgtcattcttttctcggtgcctggcttggtaccacgctgggcagagcagaccctcctgaatggccgctgaaaactgtggccccgagttggcatctcgcttggttccgtcccgatggatgagttgtcggctcgggaaagaggtcccagtgacaagcagaacccatcggtaacagcagagggagggcctgtggctcgggcacatggtgctacacagggacaggggaagcctgagtctgttcggacctgtcctgcgcaccaggcacgagcgtgggtgctcgtccagactcagagcagagccgaccgagcagagtggtctcctcctcacacttgcaaagacgcccggcagaggcaccccgaccttccttctccctggggagccaagtatgtggagagaggagttccatcgaccgtgaccctcacgtggaactgctgtggcctcttcccccgatgtcagcatggccctgtgtgtccatctctgccccaggctgcacacctatcgtcacccgcaacccaaagagaagccaaatccagcccatctgccaaggctctaacgctacccgctggattcgcaggtgggacgcattcccatcaggccccacagcagcagaaggcggggggtgggggctggcgggcccaaacctttcaggccatggaccagtggtggccgcctgcccctccctctccttctgaccctccacaccacaggcccgctgggggtcctccctggaagccccatcagagccggtccagggcgcaccacgctgctggccaagcccttttgcggaggaaagtgcagcttcttttttaaacagtgggcaccctcactgcgagtctgggtgtttttatccttcagcagaggaagagctgtcaactgggggcttcctggtgagcccacgcttggcagtcaccgatgccaccttgcattaaatgtgagtgatgaggcggtagggctggggcagcgggccggagagcgagtccacagaagtcagtgcgtccttgggtgggtcccagaccggcacggtccctgcgtgagtcacagagagatggttctcccacctgctggcacctttcttctcaggtgggtcccagaccggcacggtccctgcgtgagttacagagagatggttctcccacctgctggcaccttcttctaaggcaactttcctccacagcagatcagacgagacattctgagagctcagacatcaagcacgtgcccttccaaaatacatactttaggtttacgagaagaggtaggtctgaacaaagtccgggcagttagcaggaagctggccgacacccctgagctctgtctcccagtggctgtgcgagggggcagagggggacgtggccaccagacccaagggcagcacaagggttctcggggtggccttggaccggagcccttaccctcgcatcccccctccacctccccaggcagagcagagcagagctggcaagctgagtccttccagagcgttctctgaactgctgggctggacttgcccctagtggtccttggttccccctctggaaagggaggtgctgggttcactgacttattcatgagtgtcacggacgctccagcgtccccacgggatacgcagcctggtgctgcaggcgcagacatgagcaaaacaggcacctccccgcccttcccgcgtctcacgtttctggcattttatcatcgattgcctaaaagaaagttgagatgctcccagaagaaagctgtgcagaaaaccatggctgcattagcctgggtctgaaccaaaagcttacttctatttggactttctacaggctgtggcaatttaaaaatctcctcttctgcctaattgctctggttcgactgactaaataatgacggagcccatcgcatggtgtagctgcccagtgtgctggaggaacagacagatgagggaggttccctcttgaacagctgaccccgtctgacggccaccatagcaaagcataagccagggctctgggtgcacacacaaggaaggcctcattgcaccctgagaaagaaggaaggcctgaacgagtcctggaagaataaacagaatttcctcaaggggagacagggaaggtgctgggggctgcacgtcggtgggactggggcccactgaggtggggcagaggccacgatgtgcagggctaggggtgagctgcagccaccatgttacggtcagaaggtcgtcaatgccaaggttgtgtggccgaaggcaagagacttccttcaccttcctattttcctgatgaaactgctgcataaaagtaaaatgactattatgcagagctgtgtaaaaacagcgggcagaaattacacctaactgaaatttcctacattcagttaggtataaatacgtaaaatacattaaaaatgtaattgtttgaacaaatacataaaaacacacacagacggctcagagggcaacatttgaggtttcccagtcggggccaagcccctccaccttcccagaggaagatgaaagccggcctccagcggggccgcgtccccagctctggggcctcccgcagttccgggggatgttcctgtcccgcagtgcacccttctcgtgggtgccggcctggatcagggggctgcgtgcctcgctctagcattgcagggagagcggcgtcacatcccatcatgcctgcagacatgcttccagcattagatgcaagcacgcagaggggccgtggtcccgtcaccactgcacacgctccttaagaactcccacagtttctgttgggcacaattcccaaccaaagaggcagaaggaaaaaagacttaaagatgaagaaaatcactttaaagcttccaaagttctttcgctcgacccatccttctaatccgcacaactgtgacatcatcatcacaatttgcattttgcaggtgcggctctaaggacttggggctctaaacatctttcgctcagacagcgcctcagctcaggagcacaagcaccccttccctgctcctggttgagtcaccaccctcagagccactggtgtccccaaggggacatctgtccacacgacgtcgctcccacagatccctgaggggtgtgtgaccagtgtggtcccccagattcgttggggctgcccaacgttaggaagcccacatctgcctagtgggagccgaagccatcccaggaggatccagcgtccctgtccggctcggcggccggcaggtgccacccgctagatgccccggccactttcagaagtgggtggcaggtgactcatccaggctctgctgggtctctcaccgtaaatgcgtgcagcagagactctgccaggatgtgctggccctagatgttcaccttccaacccagtaacccctcatgaatgccatggagccaggaacctgctgcaacccagccctgggcaggacacaggcccagaccgttgagaggtgttcatatttcacccccacccaatttcacccaaaacatcacagaagcaccgaattgttagagcatccctaaaaattgcagggtctaccttccatcacccatgtttcataaacacattcaaacttggtcatgcataacacttcccaccctgcgaacgtcctcgcagatgtcccagctctgcctggctgtccttcctcccgctctttcagtgtgaaaggtaaaattcagcgagagtgtggccacgcgcagcaagttcagtgctaggatgtctacgtgtccggtcagtccagagctaggatatccatgtgtccagtcagttcaatgctaggatgtctacgtgtccggtcagtccagagctaggatgtccatgtgtctagtcagttcagtgctaggatgtccacgtgtccggtcagtccacagctaggatgtccatgtgtccagtcagttcagtgctaggatgtccacgtgtccggtcagtccacagctaggatatccatgtgtccagtcagttcagtgctaggatgtctacgtgtccggtcagtccagagctaggatgtccatgtgtccagtcagttcagtgctaggatgtccacgtgtccggtcagtccacagctaggatgtccatgtgtccagtcagttcagtgctaggatgtctacgtgtccggtcagtccacagctaggatgtccatgtgtccagtcagttcagtgctaggatgtccacgtgtccggtcagtccacagctaggatgtccatgtgtccagtcagttcagtgctaggatgtctatgtgtccggtcagtccacagctaggatgtccatgtgtccagtcagttcagtgctaggatgtccacgtgtctggtcagttcagtgttaggatgcccacgtgcccggtcagtccagcgctaggatgtccacatgcccggtcagttcagtgttaggatgtccacgtgtctggtcagttcagtgttaggatgtccatgtgcccggtcagtccagcactaggatgtccatgtgcccggtcagtccagcactaggatgtccatgtgcccagtgaatccagcactaggatgtccacgtgcccagtcagtccagcgctaggatgttcaggtgcccagtcagtccagtgctaggatgtccacgtgcccagtcagtccagcgctaggatgtccacatgcccggtcagttcagtgttaggatgtccacgtgcctgttcagttcagcactaggacatccacgtacatggtcagtccagtgctaggatgttcacgtgcccagtcagtccagggctaggatgtccatgtacacggtcagttcagcattaggatgtctatgtacacggtcagtccagggctaggatgtccacatgcccggtcagtccagggctaggatgtccatgtacatggtcagttcagtgttaggatgtccatgtgcctggtcagtcagcactaggacagccagaaacatgaaaatgccaagagcttctcatggtgcttcaacccgagtccaggcagtggtgttgggaaagacattgggaatggcctcctccagctcctctggctaagtccgaaagtcattgccagaaccagcctcacgagagctgcctcagggaacagcccacatccccctggactgcctggctctgtcacgacttttctccaggcattgttaactcttgttcagataaattttttgtgacctagaacgtgcatagcaggaaccagatcaattctccaaagacacaagcaacccactctccatagcccatgaggactgcgcatgtctacggccactgccaggagaaactctgtccctgcactggagccacaaggatctggactgaaggctgtgaagatctcattgcattctgttggggcatcttctcttgagcaaaggtcaccttcaaatgcctctgctctcagagtttacattccaacagaagaaagtagatttacaaaaaaaaaaaaaccacactgagcataaggtcatggtgatcagaggaaaagaaggaaggggataaggtggggagggagagtggcccgggtgcagctacctcaagagggcggctgggtctctgtggtctgggacattcgagcagagactcaacaaggtggagaccctgcccaggccacccagcagcacctgcaaaggccccacagcatggcatgtgggtctaaggagcaccagggcagtcggtcggtggcctccacgaggcaggatgagtggggcaggagggagggagggaggcgcggcgcggcccccgggtgcagtggtcagtgggaggggagccagcttccctggggtttcccagaactctggctggggtgagggcagcggcagggcccaggcaggaggtgacggcgatggtgagggccagaagcgcgagtggagtacacaggtcgagtgtgcagagacaaacgggtggagggcggccacacggtgacaccgtgctgatgacggcacagagccagggcccggatgggcaagagcagccacttccatctcacaggtctgttatcacccacacgatgacggctaagatggctgtgtacgccataaatccagcactaggatggccacgtgtggcaggaggagacacagggagccaccagccgagggcagagaggagcctctgctgcgccagtgccaggccacgcaggcagtgcaacccctgagcccccacccaggccagcagctccacctgcgagaggcacctgatgcagcctctgctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccactccctccgccttcccctctgcggcatggtgcccctggccgacacctggagctgcccatcccgtcttaaccacagatgtcttctcaacacctcctccccgtccatgccctctcctccgcctcgcttcctttagagtaaacctcctggagagagtggacggcacctgcagctggttcctccttcctgggtcaccaagcccaaatctgcccctcccaaggtcaccatgccctgcctgccatcaatccaggggtcaccctcagccccagctgacgcgattcaccatgagcatttgacacattcacggctctcacactcccctccccactgctttcccaggcacaacctaattcacttcacaagcaggtccctgctcacagttctaagccatgtacaatttcagctcattaacaatttcctctccagcttcccttcttcacgtctgacctgcacacctgccatgcgggtgtcccagaaccacaaaactcaggggctccccacatggtcgccactgtctacaccctacactcgcaccatccacaccctccaaagaccctgaactttgacctgctcatttcacctatcatcggtttctgtgagcaaacggagaagagaagccgcaccactcaggtcagcaacaggcagcctctgtccttttaagccttccccacacactgaagaaattcttagaacgtttaaaaactgttttccaacttaaaccaatcaggcattattttagtctagaatacatgtttttcaaatgctaataaataagtgataaaggagagcaaccaaattaaaatccagaccgttggctctgggagatgcccaatgtagctcttccgaaaacacccctgcgcgtgcacgtggctgactgtggagctagcaggtttgcacaaggcctactgtaagttttctctattagagacaaaattttaaaattatttaattatgacatattttcacatgttctgttcattaaagtgtcagagtccaggtatgaaacaacgaacaactagaacctctcagaagtgccttacggggcccattgccaggagtaatgtggtctcctgtgtgaaggcatgccccatgcatgtcacatgtgtaactagtgagcctggaacagggctcactcctcctcaaaaaccaagacgtggcctccttctcagtgaatgagaggccactacagatgatctccaacgccaccagcccagaccgagaaatgagaaatccatcgtaatggtttcttctgatgactcgtctgcaatcccttttcctgcctgctctctgacgtggatgccagggaggaaattcactccccagcagagaggaagcagctgctgctagtgacgacagtgatgacggtgatggtgatgacagtgatgatggtgatgagggtaacgacagtgatgatggtgatgatggtgacaacagtgacgacggtgatggtgacaacagtgatgatggtgatgatgatggtgatgacggtgatgatgttgacgatggtgacaatggtgatgacagtggtgacaatggtgatgatggtgatggtgatgatggtgacaacagtgatggtgatgacactgatgatggtgatggtgatgacaacagtgatgatggtgacgagggtgatgacagtgatgacagtggggatggtgacgatggtgacggtgatgacagtgaagacggtaattacagtgacgacagtgatggtgatggggatggtgatgacagtggggaaggtgacaatggcaatgacagcgaggatggtgacaatggtgatgacagtgatgacaggatggtgatgatggcaatgacagtgatgacagtagggatggtgacgatggtgacaatggtgacagcggggatagtaaagactgtgatgacagtggggatggtgatgatggtggcccatggttctctggctagaatcccgaagtccagagccctcacggtttgatgcttgaattcattttacagcaaagcatgccctggtctgaagaagtccatgcacagcctgcatttaccccacgttgtgtgaatgttcgtgtgctttgctttggaaacacgaagtgggagactgcctcagactccactggaggaatcaaacggtctggcccatccccacgttccctcctaaaatccaaaacactccgagaagcatctggctccgggagtgtccgagaagacacagggatgtgtgagtacgtcaagccactatcccaggtgtttttcctgcctctcctgagcccctgagggcaaccctatcatcccttcatcgagaagaggacagggaggcctggggacgtccagcacccacagtcacgtccagagtggggtctccaagcccagcggcaaccgttcctacttctgaccctgaccaatgacctaagggtttcaaaaccagggaaagctcatgttggggagactgaatttctaaatttctgctgacttagaagtttctttaattgaacttttcagctttccagcctctctcctccggtgggtctatttctctgtcagtggtctaagacctctctttgctcatgcatttgctaaagacaacagcaagagaggtaggacgaggagcaaacatgagaccctagtgccagctgagtcagaaaccgcagctgggggtgagggaagcccgcaagcctccctctctgccctgcagtgttttgcctggagggcaacctctgtcatggtattagaagtgcaggtggaaatcagaaggcaaagccagtgcctgcgtgcagggcagtgaacttcaggaaatgactctcagcctgggcactttgccagtgacagagcaggggcatcaccatcttggacaaacactgccattttaagttccctttgactaaaaactgcctaaatccagccccagaaacatcaacttactgactaatgtcagcatgaccataaaccacaaatgacacctccgaccagaaacattccaaccctgcaataaaactctcctccacccagaaacattctgctcctgcaataagctccccgcttcataaacccttaaatacccttatataagagagaacactcctgacctaaattcaccagaagcccctctcaggtttattctccaaaataaacctctctttgatggttgagccacttttcatgtttctttcctctttaactcttacatttggtgccgaaacctaggacaggtgttggggccagaggctctcttgcaacccaggaagccgtgggcagtggcagctcgtcccaggctaattcctagatcctgagggcctctagccacctgccttgtcttttctctcactttactttctgagcaatttgcataaggaggacaactgacccgaagggaactgtgaggcttgggccggggctactccccagtgggctctcaaaatcctcaggtctcagaaatccacctccaaccgctcacaatgggcatttcactctctaacccttctctccttctcctccttctcctcctcccttctcctccttcttcttcttcttcttcctcttcatatccttctctctctctctctctgtcttcctcacgtggctccagtctgggaggcgctttgccaattccaactggaacatccaacaccagacacaaatccagctgactggtaagatctgccctcccctggctttctcatggtacccaggaaagtcagatctgccgtcctggtcctcagaggaccagtgggattaagctggggaaaatcttgggaactcccagtctcttctcaggttaattgtcctctttataaacaggaatctgggtctctgtctttcttctggagacacctagaacaaaaacagacaccctcggcctcctcttaccagctcacatgggtgcccaacaatcccacatccctacaccctccccgctcggctgtctccttcacaacctcaccaaacttggcttacaggggagcctaaagccaaagcgtttagttttttatggtaacacggcctggcccaattcaaactagataacgacagccaatggcccaaaaacagcatctttgactttcaaattctcagggaccttgacaactttataaccaggagcagcaaatgacaagaggttccctatattcaggcctgcctatgtcatgcttgcacccctcatgaaatccttcttcttaaagaaaaccctccccaggtcttcccttcctccgaaatcccttcctccgaaaccccttctgaccctgcagatgaaccccctctgtactctcaaccctctgcatctgctcctcacccgaccaaaccctccaccctgttggcccctcctacccccaagcctttagccccaaacctcacccatcctccttctccaccagtcacccattcagaaactaccccagccagtcaagccacctctgccattctccctctccaggaagtagctggggttgaaggcactgcttgcgttcatggccctttctccacgtctgattttctccacgtctgacttgtcacagatccaacagcacctggaatctttctctgaaaatccctctcattatcacagggaattcctgcacatagcccaatcctttactttaacttggcatgacattgacataattctaactccaccctcactcctgatgaaaaggagcatatggcattcagctgaggccgacgcagataaactccataatcaaaccctgatataaaacccagtggctaacgatgcaggccccgtagagatccagattggacttaccaacagggagacactggcttcaggcaaagaaaccacgtgatcacctgtcccctcgcaggcatggacaaaaatgcccataaggcagttaattatgaaaaactcagagaaattacataagagccccaggaaaatcctgcccttttcttaccacacctcactgaagcgatgctaaaatataccaatttggacccagaatctagagaaggtcaaacttttctccccctccaatttgtttcccaatccaccaagatatccagaaaaaattataaaaattagaggagggtccccagacatctcagtgggacctcctaaatgcagccttccatgtctttaacaacacaaacgaggaacaaagaattcaaaaagacaaacatctccatataaataccagatgctcacctctgctgtccaaaagtcagctccacaaaaagcctcctgataacccgaaagaaaagtcccccacctctgggagtctgtttctgatgtggcaacgctggacactgggcaaaagcttgtcctaaacccctgcccccaccaaactgtgcccaacctgtggtctctggggacactggaaaatggacggctcccaacagggacaccttccccgttcaggtggggctcataatgaagcccccccctccgaccatcacaggaggaaatctcatcgctgccggcactgacaacggaggactgagggtgcccggatcctgcgcccccatgtccagtgagtccacggaacccagggtaactgggacggtatccggtaggccagaagcaagatggagtcagttcagaccgttttcactgtctcagtcataattgtgcaatggcagtttcataactttaaatgattaccacagttttcataaatgatctaggcaagtgattaaaataattagataaatgtaatgggacaaatatttgtaaacaaacttgtcatcatttggaatctaaagttatattaaattaaactacagctatttcattatttaggtttttccaataaaaatatattgtaggaaagcattctttctaaaacttgtatcctttttaaaggttaaataatttgtgtctaattcaaagcttatttaaaggttttatataaaacaaggtaaaagaaaccaggaaataagagagatataaagaaagttacaaaactaaaaagttgtaaagactgttgctaaaataaaaatatcttcaaaaatgtaaacagttggtctaaattatgcaggtcaaatattaggtttattaaatgcttttagatcataaactggttctttgacttaaaaattgttcaatttattttggagtgttaaattctagataaggcctggggatataagaaattagccatgccccctagctatgcaaaaaggtattaaagaaaagaatatttatataagaaaggatcttgtatgataaatttttgtcctgaagtaaaataactggttgtttgaagacagggatgtttaggacaagtcagaaagtcaaggcatgtggtagcttgtctgcgtagtcataaaagaatttatacaagggaatttatgcaagaaatgatgtagaatttaaaggtgattaggcctcctaaatgctttataaaatgccactatgactcttagctgtacaacttgcctgctttatatctaggtaaggcctgggacacacggagtttgatgctggaatgaatcagaccttgtgtgcacttctgtctaagtcccaggcttcacacctagtacatcatttaaaatcccaaacgtaccaaggtcttcaccaaaagtgaaggttgctaagagttaacagtgttacatgtatttaagactattgaagaaacagtttacatgcaaggtgtgtaaggaaagcaaaatatacttttggtaaaaagattataaggaggcacgggaatgtgaatttttgcctagattaaaaggttaaagggttgttttaagttggataaaataaaaatgaaggtttaagcaagttgtgaatggttgattgtaaaggaaattctatttgtaaacatattggctaaagttaaaggggtatcctccagtttttctgcaaattaagcattaaaataaaagcacaatgggtttctcttagagcactagcctgctctttaacaaaaattgtaaagagttataaaaggtctataaaaatcttaccttatgatcaaacattaaaattgggtaaatatgtctataaagttttattaagaattgggtttaacattaatagtacactaatgtaaaggtgaaattcggcttatttggtataaaaattatacaggaagcattgccaaatatgcaatggtgtttggctttctttgggctgtgtttgtataaatatgttattggtatgtgttccaaagttatgggagacttctataattctgatatattttagtgtacattatcagtaataattatcattgttatgttaaaattattgtgtgccacaaggtaacagatttccttgtcaattgtgtctttaactatggctaccctaaaacattttgtcatccataggcaattgttgtcttgttttggtcctgtttagaaggtggtttcataatcagctataaagttttaccaggtgctcttcaatacaggtttctgataactttgaagactgtgacatcagaatagaggaaaaatgttcaggactcttgaagagctaaaatgttcattaatatcaggcaggacaggaattaactacatgaactgaaccaataggagactggagtgatcattttgacattttgcttaaaatgttgctaatcctttgttttgcttttcagagtcaaggaaacgtcttgcgagctattgacagcttttaacaatttagtatactcccatgagcaaaatttggagcttatttgttcctctctacctgattttctccagaatttggaaagtatttgtgactattcttaagttatggcaatatagtgatttgcataagtgcaataagaatctgttttcttttgtaacaggacacaattggagaaactggttattttaccaagactttggttggaatgatgtgctttcctttaaggaatcaaacttgacttatgaagccaagaaaggccttggaaactggcctcctattctgtgtacacagtccctgcacaggggttctgatctggggtaagtaaagaatgtcactttctgacaggccaggaacctcaacaggagaggaattcacccaactcataggtatttaatggtacaattccatggctgggctcagctttaaaaagtcttatctcagattccttctataaaacaaagttccatcaaagacaatttaaaaggcctatgtgaaaaataattattcttgctgcactgtatacaaataattaagccaagtataataaagtaaaccagtcctaccatgtgtcttttaataaaaatggaaaactggagagagaaaattgtttcaaaaactatagcacacctgttgttaaaattccagtcttgtctgatgtttttcaattgttattattttctacagtttagattaaattctaatttttctggctacgagtctccaaaataatgttttcaatttttcctttttccccacttttctaactggaaatcactgaaacctaagctgtgctttcttaaagccccataagctgaagacgagatgtatcagcagacgctccctctacgcccccaaacagagagcgcttccaggaacaaacccacctcttccactcctagatgtatcagcagatgctccctctatggccccaaaacagagagcacttccgggaacaaatccacctcttccacccctagatgtatcagcagacgctccctctacgcccccaaaacagagagtgcttccgggaacaaatccacctcttccactcctagatgtatcagcagatgctgcctctaagcccccaaaagtccagtgctgcattcagtgccccgtaaggaccactctctctcagcaggaagtagccagaaagaacacatcacccctcgtccttttcaactacagggtctggattgacagagcaagaacatcgccatcttggacaaacaccaccattttaagttccccttgattaaaaacccccaaaatccagccgcaaaacatcaacctaatgtctaatatcagcgtgaccataaaccacaaatgacacctttgaccagaaacatgccgaccccaagataaactcccctctgacctgaaaccttccaaccctgccataaaactccctccacccaaaaacactctgaacctgcgacaagctccccttcctaaatccttaaatacctttagtctgtaagagagaacactccagacctaaatcggcccgaagcccctctagggtttattctccaacataaacctgtttttgactattgagctgcttttcatgtttcttctttcttcaactcttacagccagtggccaggagtgagcatttctgggtgtttctctacgggtcagtttctctatgggtcagtggaggccctgcccaggctagaaaaagatcaacaaaaacctaatgtcaggttagtgaggcagttgagtgaaatccggactcacccagaagatgccacagtaccacaggtgatcatcgtcatatcattacagcaggtgaaatcgagactcacccaggagaagacgccacagtaccacaggtgatcatcgtcatatcattacagcaggtgaaatcgagactcacccgggagaagacgccacagtaccacaggtgatcatcgtcatatcattacagcaggtgaaatcgagactcacccgggagaagacgccacagtaccacaggtgatcatcgtcatatcattacagcagatgaaatcgggactcacccgggagaagatgccacagtaccacaggtgatcatcgtcatatcattacagcaggtgaaatcgggactcacccgggagaagacgccatggcaccacaggtgatcatcatcacatcgttacagcagctgataccattgcttgtcgcagacccagctacaccacaggttcagactctcatcttgctgggagatgacatattgaagctaaagatcccctttccctccctcacatctccacccctgtccaaaatcacgtgattcctgttcggccggctttttatactgcagggttctgccagacaggaacacgcctgtcctgcaccgatcctgctggagggcagcttgttccgagccttcctctacaggaatgcatcccatccacgtctcctgacaagctcaggactagtcttgtgctgtccaccccctcaggccctccaccctggcacaggcagctgtgggctcctctctgtgaccctggccagccctgaccggtccacagtcgtccaggaaacccccagagaccacgcagcactgcccagcaccacctggattggttattgttagcaatggcttcaggtggtgaatgacagggtcagccaaggaggaggcactcagggggaggcagagctgcagcacccacccaggaaggctctgtctgaggccgcccaggctgcacagggcaaaggcagtggcaggaagcgccgccctcgctccccccatgacctagggagacggctcatccccctccttaggacaagggacctggtgcggggaccctggggattcccttcccaagaccatcctcctttgagcaaagcctggtggacccgggcgggagctgttctaggtgctgaagcacgtgcatcccacacaccgcagtccctgccttctgggctgagtctagagtcagcacagcgctgggggagctgcccccagagacacagccggggccaccgcgcctcccctcggccccacagcagtctggggtgcacagtcagcgggtagagctggcagcctccgccactgtccagccctgtactgggaacgggcaggcactccaccaggcttgacaggcactgttggccccgcccaggtcacatagctggcaagaggctgggtctgggttcaaatccaggtgtgctgggtgtaaagagaggcagagagatagagagggagacagagacagagagatagaggagagggagacagagctagagggagacagagatccccaaagtgcaccacatcttctaacagatgccgaggctccggtgacatgtaactccctgcggagtggccacagaaacagatctggctgtggctttccatgagaaattccagggccctgtccaaaaatatgcagatatttggacacagccagaaaatgagttggattttccaaacaagcagatgtggatgcagcttctgtggcagcaaaaatagaaattccaggtgttggtttcagacagggcactttacaagcagacagcccaagcacctgtgaccctaggcgaagctctacctcgtaaccaatgcatccataggcgttggctcctgggacctgtgggtgggcgtcagggatgctcagcatggggtgtagctctgctgcagaacgaggaggagcttttcctgctcaccagggcgtcagcaccaccagctcacgcatcaggatgggagacaaccaagggaaaaccaaggtaggaacaggtcgcctgcgcccactgtgtcgggaagctccaggtcagcgacccctctgagtgtcacactcggccccacgtgtccgggaggctgcaccccagcccctgctaaccaggcgtgcccagggaggcaaggctgctcagacagcagaaaaaaacaggcgtcctgaggcgagggcctgctaggcccccactgtggccgtgggacggagccagcagctctgaggtggggtcacgtgcacagctcacagctcggacagcagcaggtggggatccggctccagcctgtctgggctggacgtagctgtcgggaggacgacaggaagcaggtgccgcccgcagaagagaggtgcgtttaagaaaccagagccgccgagtcagcccctgagtggcaggtgcacgatcccacaggcctccaagctcaggggcctaaaacctgggacttggttgattttcctgtaactagacctagtttccgtggcagatgcccaggcagccagaaaagaaggcagggcgggcggcccccaagtcgctccactcacccacccttgtgccagtgcccacccttctcccaaaattaacccaagtctggagggttcaggtggcagcatctttgagcagagagtgggggacgggacagggtcctctttgaacttcaccccatcccctgcaggtgtggcctgaggcgtttgcatggaggaggtgtggactggtgtcctgggcaggtcccaccacggtccaggaggggcggcccggaagactcagcttcagctcacaggccgcacatggctgcacacagagacctgccgatgccacaggccacgtgcacctggaaaagtctgactcaagccacctgtggggccgcaggggtcccatggtccctgggcggggatgtggggccaccggcctgagaaacaccccccagtgcctgacaggcacggagagctggggcctcatcagggccacaggagcttcagggaaagaggcctcggtggtgaggctgtgggcccggcaggaccaaccccgagctgggtgcccagcgagtgtggccgcctgtgcccatgctccgcctgtgctccactccctcagttattcccccgctgtgggtgaggtcgtgggatccagggttggatggcaagtggatggggcccactcaacgcctgtcctccagaacacccggcccttgtgggacctactcggggccgtggggccttggcacgggctcttgccctgggcagctcacagtgtcctcaccggtgacccgcagagccgcccaacactgccatccagggatcccagaaaccactctccaccagccccacccaaaggggcggagaccctcacagcttccacaggagaaggtgcggggcccgacgccccaggaaggctgatggggctcccacgacagcgaggccctgagcagaagctaagcagggcgcaaggaaggcggccgagacctcaccctccagcacttagaggaatggagaaaacgggctcagtccagaccaaagacttctgtgtgtggtgtgtatagtatgtgtggtgtgtgtggtgttgtagtatgtgtggtgtgtggtttgtgtagtgtatgtggtgtgcattgtgtagtgtgtgtgtcatatatgtggtgtgtgtagtgtattgtgtggagtgtgtgttgtgtgctgtgtgtggtgtatgtggtgtgtgtggagtgtgtggtgtgtggtgtgttgtgtgtgcaatgtgtgtcatgtgtggtgtgtgttgtgtattgtgtggagtgtgtggtgtgtggtgtgtgtgatgtgcattgtgtggtgtgtgtcgtgtgttgtgtgcagtgtgtgtggtgtgagtagtgtattgtgtggagtgtgtgttgtatattgtgtcttgtgtgtggtgtgcgttgtgtggtgtatgtggtgtgcattgtgtgttgtgtgtgtcgtgtgtgttgtaggtggtgtgtgtagtgtattgtgtggagcgtgtattgtgtattgtgtgttgtgtgtggtgtgtggtgtgtgtagtgtgtgtggtgtcgtgtgtgtagtgtatgtggtgtgtattgtgtggtgtgtgtgtcatgtgtggtgtgtgtgtcatatgtgtggtgtgtgttgtgtatagtgtgtgtggtgtgtggtatatgtggtgtgtattgtgtggtgtgtgtcatttgtgtgttgtgtggtgtgtgtgtcatgtgtgttgtgtgtgtgtggtgtgtggcatgcatgtgttttgtactgtgtggagtgtgtcgtgtgtgtctgtgcatgtgcacatacgtggggcacaggagaattgccagttaacactgttttatgcccttccctttcccatccctgtgggacctatgggactgtgccaggttacagagctcttcctgaaataaatgattcatatgtctgtttgggtgaggaggaaacagtaactcattcagcagtggaaaaatacctaaagctgatgtgatttggggcattcttcagatgtcaccggagactaacatgataatgggtagggataatggcgaagccattcctaatgatcagatttcatcccttaagtgaacagagtgaaatctttataaatgaaatgatgccacgtctggcatttgcttctaaacaacataggaagagaagaagcaggcggggggtgaacaggacaagtgatggagttgggtggggggcaaggagggttcattgcgattttcttcacccttgtatgtgcttaaagttttctatggtaaaaatttaaaataaaaataaattgagaaaaaagtgttcacgtgtatctggaagcactggaaatacactcgttctctctgtagctgacgttgacagcctgccttgctgccttttgaaataacttgaatgttctgacatctatgcacttaaaaccagtgtataacaatgaccaccgctttctcgaaacctgtcatgaacaagacattctcatgtgcattggctcaaatgttcccagccaccatgcaaatgaagaaactgaggctgaaatgcttcagtaagtttcctacgatcacgcagcactcacggacagccaggttccagctaccacaagtattaaattaatgtgagattgtgaaatatgggttcaccatacaacatcagcccagaagaatgcctctcctgaaaaggcagaaatgagcttgcacaggcatcacagacaacccctcagaggttctggtctggggcatccgggtgccttcctcaccccagtgagggaagcccgtggacaggtgaacaccacacggctctggcagtggccgtcactcttgggtctttatcctgtcattccagtacccatgtgtttttaccgaagccatagaaatggtccccatgcatccagattgtaaaggaagaagcaaaagtgtttctatttgacatgctccagtagattaaaaaatcctgaggaatccattttttaaagaactactagaacaaagaaatgagttccacagggttgcagatattagatcaacatacaaagtcaacagtatttctaaacacttgcaatggacaacccagaagttaaattaagaaaacaattccactcaaaatagcctcaaaaagaataaagtacctaagaataaatttaatttggtaagtacttcatttgataaatactgaaaaataagtaaatttgatacaaaacttatactctaagaactacaaaacattgttttaaaaactaaagaaggtctaaataactgggaaaacattccatgttcatggattgggatacttaatattaagatggtaacactccctacactgagctacagattcagcacatccctaccagaatcccagctggcttccttgtagaaattgaccagttgattctaaaattcatatggaattgcaagggattcagaattgccaacgtaatcctgaaaaagaacaaggctggaagactcacaagcccttatttcaaactcactctaaagctacagtaatcaagactgtggtaccggcacaagcaaagacatatagattaaaagaatagaattaaaagtccacaaataaaccatatatgtatggccaattaattttcaacaagggtgccaagaccattcaatgagaaaagaacagtcttttcagcaaatggtgcttggacaactggatgtccgtaaatgcatgaacatgggtccctacctcacaccatgaagaaagttaactcaaggtggatcacagaaccagatggaagagttaaaactataataactcctacctcataccatacgcaaaagttaactcaaagtggatcacagacccagatggaagagttaaaactacaaaactcttctagaaaaatctaggggtaaatcttcatgtccttagatttgtaaaacattcttagatatgacaccaaaagcatgaacaacaaaagaaaaaataaattagagttcatcaaaattaaaaacttttgtgcctcaaaggacaccattaagaaagtgaaacggcaatgtacagaatgtgaggaaatatttgcaaatcacatatctgagaagcgatttgtatctagaatacataaatgactctgatgactcaacaggaaaaggcagcccaatgtaaaaatgagcaaaggaaatgaacagacatttctccaagaacatatgcaaacggccaataggcacatgaagagatgctcgacatcactaatcatcagggaaatgcaatcaaaaccacaatgagataccacttatcacacattagatggctagaatcaaacagtcagtgacaagtgctggtgagggagtggagaaacaggagccctcatgcctgtctgtgggaatgtaacatggggcagccactttggaaaacagtctggcagttcctcaaatgattaaacagcattactgtatgacccagcaattccactcctaggtacatgcccaaaagaaatgtaaatgcattttcacacagaaacctatgtacaaatgttcacagcagcattattcacaacagccaaagtctgtaaacagctgtaatgtccatcaactggtgtatggataagtgtggcccatccatacagtggattattattattattatcattgttattattattatttgagacagagtcttgctcagtcacccaggctggagtgcaatggctcaatctcggctcaccgcaacctctgcctcccaggttcaagtgattctcctgcctcagcctcctgagtagctgggattataggcatgtgccaccatgcccagctaattttgtatttttagtacagacaggatttcaccatgttggtcaggctggtcttgaactcctgaactcgtgatccgcccaccttggcctcccaaagtgctaggattacaggcatgagccaccgtgtccggcccatatagtggattattattcagccatagaaagcaaggaaatttggaggaagcttaaagacaccatgcgcagtgccagacaccagacacagagaccgcacataacacgttactgcctccacacacaagcccagagtaggaatctacagagaacacatatcacacattactccctccgcaggcaggcccagagtaggaatctacagagacaggaagttgattcctggttgcttaggctgggtaggtagggtgctaagagaagggtgtgggtttcttgctgatgtgattcatgttttaacactggctgtgctgatggttcacatatctgggaatacactaaaaaccattgaattgtgtgctttaaatgggtgagttatatggaatgtggactatatctcattaaagccatttttttaaaaggaaagaaaaacagacccacactgtccacccatcctgtgcatcgccaaagcccagcttcacacccagcttctgcctctttggggaaatcttatggaaaagtcttcaggaggccttccctcctcaggcccacccaactccctacaggcaccaagcagctccagactctgaagagatgctgtctagagaccatcatgggggcatgctggctcccaaaggtggcgtctgtttccaacaccattctgtgactggtgtgtgtgaggcctttgcccaccctggtcagctgtgacgcccaccctcgggagccaacaacagggggtgggtgggagaggaaatgccgggcctatctctccgtctctttgcaactgctagccaagaacggcagctcaccctgcagtgcacactgtctctactatgcagaacagaacgctttgctccaccagaatcccagtgtctttgcagccacccccaaccctccagggacctcccaccctcacacggtcaggctccatctgcccaagggtcagtctcctgggcagcagtgggagtttgctgggtcccatgcggggtgatatggtttggctgtgtcctcacccaaatctcatcttggatcctcatgtgttgtgggagggacctggtggaaggcagttgaatcatggggggcagatctttcctgtgctgttctcatgatagtgagtaagtctcacaagatctgatggttattacaagggggagtttccctgcacaggctctgtctttgcctgctgccatccacgtaagacaggacttgctcctccttaccttccgccgtgatcgtgaggcttccccagccacgtggaactgtgagttcaattaaacctctttcttttgtaaactgcccagtcttgggtacgtctttatcagcagtgtgaaaacagactaacatacagggttccgagggcatacaccgcggcccagccatctcaccctccctctcggcctgggaactgggaacaggcaggggttgggggcccgacacaggtcatttgcacgctggatgatacagtaacatgacagccggtgcagggaagagctgagaactccagcctgctctgaagcaacaactgggagatgaggcagaaatggcccaaccacctcccctctaaaccctgctcttaaaattcaatcctggctgccaccgtgaactgacaaaattagccagtttttgtttttaaagttatagtccccaaaacagtgcatcaacaaaacagacttccagctgaacctgatcgctgttgccgcgcatacagccacgaacatcatggacaggcagtgtctggatttcactctgcattgctgccatgtgaaccgggggctccctcctggttttatgtctttacctctcctcttagtctgggcaagataaacattaaccaaactcagacgaaaaacaagactctagagccactggttcaaaaggaagagaggcttatgcacatgtttttgcctgaactttacacactaggacttaatttaatttgccacccccgtcccaaacttcatgcattctctgagcttcccaggcctcagcattggtggttgcacaccacgtgaggttgatacaccagcaacccagggccatgctcgcttagactaaggtgtgaatggtactcgctgaaccctgtatccaggactgtgcaggccacagcccgggaacctcagagctggtcctgtagacaccagtgtgctggggaggcagggctgactcttctcagagccccagtgcagctgtaccatcccctgatgagggactcatgctccccaccaccccatgtactttcttaccatttgccttctattctccaccaagttgatgccaataattcctaagaaagatccaaagccgagctaaaaccaaaggaagaacgagagagaaacactcattaacgtgcctagaagcttaacactgacatttaaagcaaataatcccgccctcaaaggcattttatccagggacgaaggccagacatccctacctcaagaacctcaaccactgagcagcaggtgcgtctgctggcgttgggcaggcatctctgcaacatcacctgtcctgtcttctctgctcagaggtttttaatgatgcatctgtttggcttgtgactctggggtaagagaagttcccactcctcccccagagacaacatcttttcgggaacccagggccaccaagcaccaccatctgtcccgtcttctccaggcctgagatgcccctgagcatggctcctgggtaaggtattagggaactacagccgtgtttcaaaagaagggttgccaggcacaagggccaccagtgacccctgctcagacggcctaactctggttgctgcttcgggagagtgagcagggcagaccgttagcagggaggtgccaggtgtggggaaagggcacctgagccaggcacagagggggcacctgggccaggcacagagggggccccgggctgcagcacaggccaccaggggtccggcagagcccccttactccacaggaagccccagctctgggcagaaaatgatactgggatgtcgggaaatagacatgggactgtgctgtcttagaacagaggccaccggccgggcatccgcaccctccacccagggcccgtcctggcaggtgacgcccacctggcagaggaatttttaaaatcagtgtgaagaacatgcatttcagcaacacccaccgaaaatctggctcagagcagccaacatggacctgccaacgaccgtgccgaggcctaagacggctcttgctcccacgcaggtgcgccgggccggtcgcacttcccagtgagtgtctgttggaaggggtggcccgcccggcacagccttggagttgctggggccgtggtgtcaagtttaatgcactggaaaccggacttctttatgtaaatagttttgccttttctgtaattgtctgtgtgtctgtggtgatagacacgtacacatgtggctttcaccaacggtttgagaattctccagggataacaggaatatttcttcatgtgctgagcttcaaaatactgcagttcaactccacacgtcaaaaatatcaaaatttcacttcgatatacatgtattaaaatacatctgttacactacgttttattttttggggatttgaaaaaaaccacacctttcttgaaaatgtggagatgttttcacgttctggccgcttcttctgagatcagcttcttaagtctctacattggcagaaagtctccacagaagtgactcttagccacgtttccttgaagctgcttttatttgttgtctccctagtttgctttcagaactgtctgtactacaggccatttcaatctggtcagcacagcattaattcattgcccagaaggtagattctttacagagcatagcttgggcattagccattgatgtttttcattatgttattctgaggcagctcttaaataagcttgaggacaaaccaaaaaaaacaaccactcaaggctgatcttgatgtttcgcaaatcacttggaggtccctcctcacagccacttgccctctgggctcccctttctgcccaggaagcagaaaagcccctcacatgaggccaaggtccccacaccattggcctcttgcaattttactgataaagctttttctgcatagatactatttgtatatgtttattcataaactatacacaggtagatagtgtagatgtctaaggcacaccctaagatataaacaaaggaaaatataatggtgaaataaacagtatttgtaaaatatttctaaatacttagggccaaaaatctttcatctttgctgattgtcatcaatattattaccaatcttggtagtactttaggtgagagtaatgagattgaagaagccgcattttaaaatcttgctttagcactttatgacgtagcaaccaggctctggggcatgtgaagggcatcgcagctgatccaagccattccaacagaggttcactgtgcagaatgcaggcacttaggagaattcttttactaacgacagaggatgtaatttcatagttcaaaaaaccttgatacttttgaatctgggtgaccaattcttgccaattaggttaccatcaatttacctcgccgccttactgttcaaaatctggcctgacgggtggatgaggtcagcaccaccaccttctggccgttcccacgcgatcacgtcactaatacgatctttgacccacggcttcttggtaggaatcgtttaaagttactttccccttccatgggctatggtggtcgacctggtccctcagggtaaaatccttccaggatgcttggggaggctctgtccggcctttttggacatcctgggctcctggcccctcctccaccttggacatttcctgttgccgggctctggcccccctcctgccctctggtcaccctgtgaccacatcgggccaacccagacaatggagggcacctggccctattttgagatcaacttggacctcaaccccaattcccctctgccttggacctgccactgtcccaggtcctggggattgggaagtgcatgtctgtgggggccataaccctgccgaccacaagcactgatcgaagcctccccaccttcagccccagccctgtgagctggcgtggactccaccctgagagagccacacaccaccctgccctccccggcccaggccgcccgcccggcgcactcacaatgatccctgggtagtagcccccaacggtcacattctccgtcctggtggtggcagccagcccgacggtgactatgaggacggacaccagcagcagagaccccacaaaccagagcgacgtcttcttcctcctcgaaagcccttctgtggggaggaaggcgaggacctgtcagtgagggctcaggctcaggagggcgtcaggccagcaggctctgggccgtgctccgttacccaggggtcctgggatgcactatccccgcctgcctccaggcccacctcaggggaccacccccaacctccattagataacagaataaaatctctggaccataagccactatactggatagcctggtatttgcggccaaacctaattctaactgtcacagaactcaagaaagcaaactagaaaggactccttcctattggctgcctcttcctctatctgactttctccccctggtgtccccaggaggacaggagcatcttttgtttactgttttatcattaccattcgctcacagacacaccctctctatccgcctatcccagccacacccagtgggggagggggctgccaccaggggaggggcagggagagaggaacgcacacagcagccatccagctgtgccatctgttttgctttattttttgaaaactgaatcatcttgatccctgtgtgactccaaacaaaataggggatttaaaaaaccatggtaaggtcttcctactccaagagtttgaaaatcaacatttgtgtgtgtgcacatgtgtaagtgcgtgtgtgcagggaaagcagaccgcacactggagagccgctggcagcgatgacggccgtgcagacattgtccacaccctagaaggtccgcatctgaagatttacacttctgcaatcccatcagcagagctcaatggcaaggcaaggttatcgcacccaaggaagggattgttacatcctcagaaatgagtttcacaaaactataaatcaatgtgcagatgcagaattgctctgctgatctgagagagtcatttttatccagctgacccagcaagggcgtggccttggtcacggccttccttcaaggccctcttggactcagcacagcccccggcacagcaccctgcctgcctcttgacccttgcaaagatacacttgtcccaagaatctcatcctaaatcgctttttaccttccaccttggaggggaccagatcactccattcgccaatgtaataaaccatcggctcccaccagccagccaggctgcccccgtcttggacccactgcaccgaggcggccagtggcactgtccttagtgttatactccaggccgcaggcagtggtttcagcctctccctggttgccccatctcctgcctccttagaggcaggcttgttgcagcatccacagggcctttgtacctgctgtctccagctagacactcgcagcactccctgaaggcctctcttacatgttgctgcatagacacactgagtatagtagccacactcacccctgtgctctccacagttgccccttcacccctgcccctgcagagcatcctcgcatgtgagaggcagaggggacaccagacagacagaggcacacgctgcaggcattggaaaaggccaagttcagtggagaaaacttaagcagggctggggacagggcgctccggatgtgtcacccacaggcagcgggcagagggcagagccttccctgaggggcctggtgatggcacagtgcacccctcagcccagcaccactggtgtggagtgaggccctccttctgaaagccaccctcctgagacaccagaggccgcagcccggtgcgggccagggagcaatccccacacccagcctcaggaacacgccctggggttcggggtccctgcagccagggccacacctgcgccctccgggtccccaaggcagcttctgcaggggtcacactgaataaacctagaggggtgacaagcaggtgggtgcaggggcgggcacagcaccaggagccccaaggccacactggcggcccaggacctggcacctacacatccatcacccagtgtctgttaaagtcatgctcccccagccccaacccgtgtccccgtgtcccacgcccacgccccggcccatcccaccccaggccacacctgccttcctgtgtgcatggagcacgtcctttcttgtctttggatggggaggacactcccctcaagtgaccgaggcccaggcacccgacacctgccctgcatgaggggatgggcgctgcacctgccagccggaacacacggcccaaggcctcctccagctccgcctctcagtccctcgcttctcagcctcaggcttccttcctcctccccacctctaactcgcacagttcttccctgtgtctctcatggtatttctgaactaaaagccaaccctcgttggactggaaaaggttgggaagatgataacgacattcttacaaggaaaagggagacagtgggtatatgttggaaagtgtgatttttacgctgctcagaagagcagagtgattttttgtagaacactcataaagtactgaaaaatgcaaaagggaaaataaaattcatggtaacctaaattaacaagtaggcataaaatcttatggtcttttttcaatgcactatgtactttttaaaacatttttttcttaaattaggaccacaatgctttatagtaattttttcactgaaatcttgcaatttgttaaaaacctgaaaggttatatgttcacggtcgtttgcccgagagacaggagcgatggcgacagatcccgggtctctgtcgggaagtcgaggtgagaaacggcaaacccacgctgggagcaagtgggcaagaggaaggcaggcacctcccgtgggtgaaactccgttctggttgattcgttttagaaaggtaggtaaactttttaaaaatggacacaaaatttaaaaatatatgcaattccacattttggaagttaatgaaacagctattgtggaattacacaaaataatcatattgatgataataacaccatctatggattgggctgtgtgtcgattttcagagcagcctaacttccttatctcatttgatcatgaccagaggctccaggtcaccctcaccagcctccatgtaacacctgccaatgcagccaaatgctaggtgccttcaactcacacaattcccgcttcagcctttcctgcttttccttaggctcccattccaatcttttgactgtttaaatgtattttaagagcaatacaatttctaaaactaaattttatgggactaagtatttgagaaaattatcagacaaacgctgtccttctcaaaggattttgttgtgcgatttttcttaattaaatgcactgcatgcatataatattatgctcaaaatagttaaccagatgactcagcgtctgcttcgacccacaggtagaaccttccgtggggctcctgtcccagcctcctgtgggcgtccgtctgtcaggaaccctgtgactggattctggttcttaaagctggaagctctgctcggttccttggcatgaagagtgggggcccagcaagacccactgggctaactgaccttgtcaagtcaatcggtaacatgctgacttgttaattactatgcgaagagttagacacatctcctctgaaaccacgtaaatcctcctacaaaccattttcaacctaactttgctatgtttacccctctttcctgagtctaacttcccccccatctgctacaaaataaaaagcagaaggtatgagccacccttttatcagcattcctatcacagattcctagattatacaagtctagaaagacagtagaacttacatggggcactgggagcaatggttgcaaatcatctcattcaattacacaatggtgatattttgactccagatataatagagataacaaaaagaagactcccaaccttaaacacattctataaatacatgacacagcataaaaatgagaaaaaaaataaactcaagaaaagaaggtgggatatctttataattagcataagagataattataaggtcagattttcaagagaaaggggctttcacttaggagaaagataattaaaatcacctgaataatttccttgatttttttttttttttcctgtcccggaaatactgttattacacgcactgtgaaaattaaagtgctcctaagtgccccaactattaattaaaatatctaccaataggtttctattgcagaggcagcttacagggactggacccaaaccattctgggtctgtccagacccattgtgtggtcttgggcggccatttaatctccctgagcctgggagaagagaaccctatgagagccaagagctctgtctcttgtttgtcgccggttcccggggctcagatgaggacatagacacatctcctggtacggaatgaatgaaggcacttcagtctcctgacctgtaggatggaaatcatgagaaccacctgctcacccacctcttgagattgtgataagcgtccagtgagacacgatacgtgggctctcatataggtttttgtaaatggaatgcatatgctaatcatcagggtggtgtgaactttaagatggcgtagcggctattcttaaccagcatttctcccactggagttgcaaggaggagttctgagatgtgaagctgaaggggccaacagctacctctctgctatcaagtgcgctgatttttctaattctagtcttccccaggtgcagcccatctaggatatctcagaatatcaccttgtcactccccaccagcccccacttctcccatcccacctgctctccccttcctggctccttccccagccttagctggaggagctgaaccacaggagcctgtgcccacgccaggtcctacctggaagacacgcgaggctggaggtcaggctcttcctgcccctcagacccatttcctctactccacagagccaggaaggggaatgtcacaaagcatgggaggtggcactgcttggaagggttctaagatccggccttcctgccagccggacctggaacgcccaaaaagaagagtgagttccatttaatcatgtggggacaccagtcatggtgtccaagtaacaatcccaggtaaaactgtaatcactcagccgtcaattcctctttcgtcctgattttacacatgcccagggtagtgaacaaagaagggcaaagcagaaaaacccataatcctacccccaggtaccccaaagcagaaagactatggtccacccccagataccccaaagcagaaaaacccacaatctacctccagacacaccaaagcagaaagaccataacccacccccagacacaccaaagcagaaagaccataatccacccccagacacaccaaagcagaaagaccataatccacccccagataccccaaagcagaaagaccataacccacccccgataccccaaagcagaaagaccataatccacccccagacacaccaaagcagaaagaccataatccacccccagataccccaaagcagaaagaccataacccacccccagataccccaaagcagaaagaccataacccacccccagataccccaaagcagaaagaccataatccacccccagacacaccaaagcagaaagaccataatccacccccagataccccaaagcagaaagaccataatccacccccagataccccaaagcagaaagaccataacccacccccagataccccaaagcagaaagaccataatccaccccgacacaccaaagcagaaagaccataatccaaccccagacacaccaatgctttatacattttagtaaaagaccagctccaaacaaaaagacccataatcctacccagatacaccaatgtttcatatactaaaaagaccagctccaagtattgttttaaggtttaaagttctttgtcagaagaaaatctaagtcagatgctatttttaaacattaaggcattctaataatgataaaactagttaataaataataataatagttatcattattaaacaccaatagactaatccacattaatacatttgaccatagagcattttgctttagattggaaggcatatagtggtttcttttagaaagaagccaaattatttgattattttaagtaacagtaattcgtccggttccgaacgatgccgcagtaaaagggttgtgaggttaatccccagaagtttgtgttggattatttctgagggagcggcagagccccctagacaccactccatccctccctccagccgtcagggcttcactttctagggaactctgtttctcttttgttctgaaatctgcccagccctctccccctcaggaagacacccggcatccttccagtcctggccacttcccggcagagcccccgagcccggcttgcgaactggtgaacacgcaacaggtttcctgttttcccagcctttgcctggctccgaggctgcagcgggcttggtctgggaagtggaagaattggagattccgtgaacacaccggggagaaacacgagagaggggcgagccgaaaccaagcaacactgtccagttctgtgagcgcctctgcacgttcaaacaggaaaaggctacctcgctcttccaaacgaagttttcccggaaaatggtgtaggttggaataaacggaagagatggggaaggagcgcactttggggcgcctgttcctcataataaaacgtaacagggagagagagaccaagaggaacggacacagagtcagaggaaggcaaagactgaggaggcagagacagaaagagcgagagagacagagacagagacagagagagagacagggagagagaatgaatgaacgaaccggtaggacgaacgcccgaccccagtgcgaaatgcaaagtgttccaaagacagagctcgaaggaggcggagggaccagaccccgtgccgcgtctccgcgcaggttccgcccgggccggccggggacctgtagtcccagccccggggtccccacgctcccccgcaggagccgagacgagcccccagccccgcgctcacctgcggggtccagcaggcccaggggcccgggcaccggcggctgcatcccgaggccccacccggctctcccggg

SEQ ID NO: 615 - DNA, 13194 bp, Homo sapiens
tcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 616 - DNA, 43526 bp, Homo sapiens
accgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttggtgagtcccgcgggcccgagaccccgtccccgggcggcgggaggaggctccgggcgcggcttgacgcgtccccctctctccctccgggcagccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggtgagcagccggcgggcgggatgcgggggaacccctggcgcccgcgcgcctccaaccgctcccgagaggcagcgctgctgccgccccccagctccgcgcggcgaggcctggcctcagggtcccaggagccccggcccgccccgcgtcccccacgcccatcccccggcgaccccgggatccccgcgcaggccggtgagacgctgcggggctgtccgggaaacgctcgctgtcagacgcctccccgcggggaagccgggagtccgtttccaaagtgcgagagaaacacaatggttaaaacccaaaccgcttccccgcggccctccctctgctgggctggaggtgaggaacccccgggccgcgcctcgtcctcctgagaggggtggagagcagtcccctcccgaaagaggaattgaaagggccgagggcgggaactgcttgcggcagcaggtccaaaaataagattccaggaatcgagcggggccgcatgcgggaggggagggcggctccgcggccccgttctgccaggtgctctcctggaggcagcgggtgctttcaggagcccgacggtgctggccccggcacctcggttaggaatgtccttggagaaggcggggcgcccggggccgcctcccgcaggagccgccgtgtgaggacggcctggccactctatcctgcgggctcgggagcgggtgactttggaaagtccgagaaggtgtggattcccgttgacgtccctcccgccctgaagtcagggtgatttcatagcgaagttttccgttctgctggaatgttccttttaaagaattctcctggggtggaataaatgtcacccgggatgaaagagtggttctggatgaaccatggaggcctgtttccgcttacatttctagtggttgacttgacccctcttagatctgcctttctgaaagctctgaggctgtcagatggccactgtgcacttgtggacatagctcatccctgcagagatgacgcacctggggctgttgcccgggggctgcccacagccccacaggcccgtgccctccttcagctcagcctagcttggtcgctctccccggcctctctgttttcctgtttctttaatgatgaatcctggcctgtgctgctggctgaggcaggtgggcctgtgtgccctggtcgctcggagtcgccgcccagctgtggggttggtcgtgtggctggtgcagtgtcctccaacagcgtcctcacccggaacattctgcgtgcacagggactgtggcatggggcgtgctggtgatgggagttgagggcagcagggtcacccccaccccacagtacccgctccgcgcagccctgcaaggcctggccgcagcccctcctcgctgtcctccaggacctgcagggcccatgtcaatcagactggacgctgcctggatgtactgtgctgttcttcccaagtcagtcccctacctggttttccaattttaatttaataactttatttacaaaggtgtgaaatgaagataagaaaatgaaaacagcactcaggaccccatcactttaatacaactgcggttgcgtcacatggtttctgtgctggcatgttcatctcctcaccctcctgcatgtggctgagtggctttggtgcccgggaggcatccctcccatcctctcacagcctggccccagcagcctctgtcggcttcttttcagcgtcatctcagttcccagcgttctgccctccttcccagcccccatgccaaatgataacaacccgctttccctctggtttttggatctggccattagcttgctgtctgtttctgtttctgtttccggttcctgccggcaggtggatgctggggacagcctggttggggcaggggcaggggcagggtccagaggctggcttgagtcccagccggctccagcacaccaggcccacccctcccaggaccctagtctccactgcatcctctgccacactcttgggagaccccaggcccgaggggactgtccaagcacaacttcctgctaatgcatgaaaatcatccatgaacttctccctgtcaaaggccaggggctccttgtctttgaaatgttgctcactttacattttgtgcagtgcggctgattgaggaaaagggctgtggcctgagctcaagaggtgaccaggacctggccatggtgactgtcagagcatccttgggtccctggcctccccaggcccaggatcctgatgtgtggtcctccacgggtggttgtagggaaggtggtcccagccccctgccattttaggatgtgggaagtgcctggccgccgttagttaacacgcacctacccagccctggctgtttcccctgggcaggctcctacgagggagggaagggacagctggagccagctctccagtgtgctcaccttcatgtccacctgctaaactgctaacctgcccgaagtgtgtcccactgccccttgctggggcatcttcctggttgcgccttcttcccggaagcacccgctgtgcagcccttccagcaggcagatactaagcccggcacccctcccaggctccaggctcacttgtgtgctaacctctgtgcccacctggccacctgctcacctgcctgaagcgtgtcccactgccccaagctggggctgcttcctggttgtgagggaagtgcctgctctgcagacccccaccttccagcaggcggatactaagcccagcacccctcccaggctctggccctccccacacacctgtggtttcaagccctgttctgctggaagggacactcctcccacctccccagccctctctgctggagccgtgcccctcccccgacattcctccaggctgggccacccccacatgcctccttgctctccaccgcccagaccttctccttatcttgttttcctttttatattgttgttctccctccctggccttgcctctccctgctgggttccttgcccgagtttctaattcagagaagactgggtaactccccacagtgtctctgctaaagcttcccaggcccagtgactttttactaaatcctcgaaggccatcaggttccagggcctgctgaggtctccataatcaccccttgattccagaaatgatccgagactagagacttatcccagcccagccctactgcccaggtcctccggtgcctgcctgggagcctgtttgtgcactttgatccccggcctgcctgccggaaaatcatccaggctgtggttcctgatcccatcacctggctttatctgagatacaaagcacaatattcaccgagggctggtggccttccctgagggttggcctggattagcaacctgcacctgtacccgcacctgcacgacatgtggccaggcctgtgctccgaggccaggtttcccttcccccatctctttctttgtctccctctgtgtttctctctctgtcccagtctctctcttctccccactgctggtggtgaggaattctccgcatgggatgttggtgcatccgttttcaaacttgctggctcatcctgaactgcatgtgccctccaagcaccttttccctgaccttgtggattctttgggaacagctggggaaggggtaccctttatggaaatgaaaacccctctgagtccccacttgggaacagccacttggctgggacacaggcccagatgttgggatggcctaaagggaggtccctgttggaggggagggctgtacaatgtgggggcgcctggtggggaaggtgatggccaggctgagacctcccctgccctgccttgacagaggctgcagcacactcccacacacagacacatgcacacacattcacacatggacaccagcacagataggtgctgactcatggatacaggtgtgcagggacacacacacccctacctagacacatgcacacatgtacatatgttcccatagacacagatatacatgcacacacacaggcacacacatactaacagacatgtacatacgtatgcacacattcacatagatatacgtacacacacacactgacagacatgcacacacataaacaggcacacacacatactaacagacatgtacacatacatgcacacattcacatagacatacgtacacacagtcacacactgtccagacatgcacatacaaggcacacacatactaacagacatgtatacatacatgcacacattcacatagacatacagtcacacagacatgtacacatgcataatgacatgcacacacatactaacagacatgtacacatacatgcacacattcacatagatgtacctacacagtcacacagacatgcatacataggcacacacagacatgtacacatacgtacacagtcacacacacagacatgcacacacaaaggcacatactagcagacatgtacacatacatgcacacattcacatagacatatgtaagcacacagccacacactgacagacatgcacacacatacatgcacacattcacatagacatacgtacacacagtcacacactgtccagacatgcacatacaaggcacacatactaacagacatgtatacatacatgcacacattcatatagacatacagtcacacagacatgtacacacatgcatgacacgcacacacatactaacagacatgtacacatacatgcacacattcacatagacttacatagtcatgtacacacatgcataatgacacacatactaacagacatgtacacatacatgcacacattcacatagacatacatacagtcacagacatgtacacacatgcataatgacacgcacacacatactaacagacatgtacacatacatgcacacattcacatagatgtacatacacagtcacacacacagacatgcatacataggcacacacagacatgtacacatacagtcacaaacacacagacatgcatacataggcacacacagacatgtacacatacgtacacagtcacacacagacatgcacacacaaaggcacatactagcagacgtacacagacatgcacacattcacatagatgtacatagtcacacacagacatgcatacataggcacacagacatgcacacacaaaggcacatactagcagacatgtacacatgcacacattcacatagacatatgtaaacacacagtcacacacactgacagacatgcacacacatgcacacattcacatagacatacgtacacagtcatacactgacagacatgtacacacatgcataatatgcacacatgtacacacagtcacataaatagacacatatacacacacaggcacacatggatgcccagccacatgcatgcagacacacacagacacatgtgcaccctctcacacacttttctctttctacaactttggggtcagaagaccactgacagctgcagcaggatcactaaaaagtgacacaaggtcacggggctctgtggccccagcttcctcagacccccagggtctctccactcccagagccccctgcctgaggggccggagccctgtggccaaggcctttcctcctgggcccatcctgaggcctgcaggtggaccccggcccggcctcctctgagggccgtcttccgtgctggctccgcagccctctcctgtgcccgcacctgtgcagatgcttgttttcacccgggcgtctgcaggcacttggtgccaggctcctccggggctttctcagaggcagccgagtgccaggccctgcacacgacaccctcacccgagccggagagcttcacatctgtggaaaactctaattaaagacgttttgagaaacgctgaacgtctccctttgttatttaggaacaaaacactcttttaggaagcaagtgcttatggcttctttcttgagattctgagtaaaggggcgttaagcttgctagctggggcatgctgagcacttcccaggttatggctttaccccagagcgattgacaggcatccaggtttcctcatgcttcattttcccctgttttctaaggttaaaactgagagctgtttctccaatgcaaagctgcttgtttaagggtttcgtatttgatgttggaaatgctctggactcttccatggtttttatattccagtgatttcactgcaaacctggtgtgtacgccttgtaaattttgaccctggccaagtgaaaggttcattttaaaagttttaaaataaattttaaaggggagctggaagtggaataagttaagaacagtatcagttttgcctttcactctgacagaggcactctctgctctgactgacgggtgttgattaaaagtataatattcaaaagaaatagtaaagtgcattgggccttgttaatgttctactaattttctggggctccgttttcaaattataggtgaaatttttttccttccagtgttagtgcctatgataagaaaatacattttctccacatctgtccacaaacctgctagaccctgttttgtgactacctccccttggaacttggggctccatggaaaacacacagcttgacccagccagccctcagagagcctgggccggtcactgcagtggctggattctcagcataaaaaggccaaacgttcggccaggctgggactggctcccatccaggaccaactgtccacagtacagtaaggccactctctgagtcaacattgtttcttttctgaattgctaagttgaccgtccctgcagaagcagagagggctgcggtgtggcattcctgcccactccaaatgagggcagcccggacgcgggagctctcagggaggcgcagtgggctttgggtgtgtctggactgtctccaccacacctggaagatactgttcacttcctttttacacttgtgggaaatacatgacagtgtttacgggcaggctggctttccgtttatttcaaccctgacaattgaatagcagcagcagatgatgaaactgttcacttcccgatcactcccgttctcagatccatcacttagctcgtccgtcgctcagctcgtctgttagtctgaaagatgaatcgtgcacgggtcctcctgagagtgctgttctcggggtctccatgtgtgaagttgttacatcctcatgacaactgtgtaacagctgtcactgagccattttacagatgtggaaactgaggccctgagaggctgtggagggctacagtgtgtcctgggcatttgagccccacactctgtcattaactcctgtgctcgctgggactgggggagagcaggacgcggcagcacccccggccccactgtgtgctcctctgtgtgcaggcgactgtgagcatactggcacccatgtgagggctgagtggtgctggtgtgggcgcataaagcacagggcggctgcggggagctgggtgtgtgtcagtggctcggagcattagtctcgtgaacatggtctgccaggtgcgtcatgctgggctacagagcccatggctccaccataaatggtggttttgtgtttgaacttgagtgttgctgctcagtgaggccagaggaaggcaccaacctgcaggcctggccggtcctcacaacacggaaggcaaccagtccactagagagacatgtgtcccggccactggaggagtccaagtgacctttaagtctcaccagtcctcagagcaacccaggtgaatttggggcctgagcttggtcgtctggccgaagaccagctcaacttggataaagctggaggagaagcctgtccctcaggcagctgccagggcatctgtgatttctgcttgcgtgcactcttggcgactattggtggtggtcgcagtcagggcatctggttgcctttactgtccttacaccagctgggcagagctcaggctgggagcccagtgggagaggccggggcgtgactcccggcgcagaagcggcagtggcacaccggcgtcccaagcacagctgtccctgccaggcccctgcgcgttggatctttgggttgagtcatgctcgatggtgcagccatcctttcaagggaactgagctgtccagcgtcccatggagcagctccccgtggatccggagaggccgtaaataaacctccccatttgtaagccgggaacacacatgaactttgcaatcgtgtttgtcctgggatcatagaacgtggtggctggcaagacccaggcatcctcatcctgtgctgctgtgaacagaggccggtagcttattgagggaccagtcccagttcgctttctgtggggaagactctgatggaagcctaggccccaaactccaaggttagcacatcttcttggggggattgacacctccaaaggtgaacttgggtccaaggcacgtgtgtgcgacctgaagcatgggtgccgtgtgcaggagacgccctcaccggagatggggaccgagtccacacggctctaactgcagaatcactggccctgtgcccacgactattttattttgctgttttatatgatcacaaagtacactgtcttgtttttcccaaagcatttgcagtgagacatcccacttcctctccacggcagctgttgcgggcacgaggctgctcccaggacagcgatgccaccggggctggggtgggcacggaggaaccctcttccttcctcctccccgccctctgctcccccacagactggcctgtctttagtcagcactttcccaggctcccttctgcccaccacgtgcaaacagtggcgtgtcctgggcctctctccttgtagtgtttcttgtggccagcatccctcccatccaacagctgtgtggcttcctgactggcttctctcagggcccgcaaggatgctgccaaatggccagagacagtcactgctctgcacttcaaagcaggcagccctcggtggggcttgccctgaaagacagcgggccttcctcgatgagagcctgtgctggctcagggcctgtgggggctgcagctctgttccttccctgcgtccacgctcacatgctgaatgttgtgcaccacaggacaccctgctgggggctgtcgggagcatgctctgtgtttggggcagagacgggcagagtgagtctcagcattactgccgtgcagggttgagtctcagcatgacttccatgcagggggagtctcggcgtcactgccatgcggggcgagtctcggcgttaccgccgtgcagctgctggaagccactcgagctcctctgtctcgtttgccatgaagcccatgagagacactgatgtgtgtctcggggcttctgtgagaagagcttggttacccaccgggtcaggcaccacgtcggtgctgtgaggcatggagggtgctcacagctgtgcagtcagctacagaggcctttcccagcatccacatctgaccgggcagtcacaccaggatgagctcccaggaagagggctcccagcaagggagggcgcacctgggtgtgagcttggaggagggcagaggcacctgtcaccgctgaccctgggtgcagatgggcatgccgggtatactgactgtgctttcctggggcctgtctccctccaggtcagcctggggtcctctgggctgggggccatgcactgcctcctgtgggcagtgggatcagcacttccactttgctcagggctagagcaggctgctgcgggtgtgaagacttaggaaacgaattcggaaggaaggaaaggattttgcacttcccaagctagaagaacatgaatagagccgggctgccaggccaagggtctgtaagacggcggctcttcagagagtctgcaaatgctgagaaaggaaggctccccaagggcagttcctgtgggcgttactctgagttttctcatagaagtcaagttcttggaagacagcactatggtcaaagggttagtgaattcttgtgaccatttcccatggaaaatatcagagaaagttatggtgttgataaacagagtccctgtgctcagcagtctccacccacttgtcaagtaagataaagatttttggaaacaaaatttatggctgttatttgctaaagagagtaatacattcttagcacactctgaaaaataaccactatttgctgtatgaatgcagatgaaactcacacaaaaagatttatgcaggactgacatcgggtgtttgcagaaggttctccacgttcactgacctctgatcctcactgcagctctgcggggactgtggcccaaggatgagtgagcgtcaggtcgggccgtgcccttaatcccctggctgcccctcaccaccaggcagagaccttgctgggacccaaggagttaaagtgtattcagagatgaaggtgtttaggaaatgttctggaaccttccaaactgactttaggctgcgtgaggtgcttccagttcagtgcactttgggcccaaaagtgtttcctgtcttgttaatgcactgtgttgtgtgccatcaccgcatggaggttttggccatttttaaaaagtgaatgggccctcccagggtctagttggatcgagagaccactggaaaccctcaccaagctgcaggcaggtaggcaggggccccagagcaggcctaggggaagagtccccccggccccttggagggtctcttcacgtgctgggtgctgcctgattcctgcggtggcatggggaggtcaccccaccttgttctgaaccacagctctgggtgaggaagcctgtcaccaggttaaaggtcatttgggggttggggcgtgagaaccgcagtgccctgctggtagggttgccgcatgggtggccaggctacagcctggtccccgaggccgacccatcctgggaaccctgtgtgcagctccctgccatgcttgacctttgccctgtgggtggctttgagcgggggagacctgggtctggtggtgggcagggcaggggcggaggtggacttgggtctttgtgacactgcaccaattcccatggattctgccggcacccactgccctcctgagcagagcaaaggcagcagaggcggatgccagggtccggaggtggcatctactcatcagacactttctgtagttttataacaaatttggggcctcatgttagaccccagccagaccaggctcctgtcctggggctcagctccctccaagctgcttcaggttcagtttcctccatgcttacgaaaccgaagggcaacgggcacagtcagggaggcgtcagaggaggcaccggctccactgttcacaccgggaccttctgcagacggggctcccagcctcgaccagccccggaacccccagcacggggacgtccaatcttttggcttccgtgggccacattggaagaagaactgtcttgggccacacataaaattaacactaacagtagctgatgagctaaaaagaaggtctgtgcctaaagctcatgttttaagaaagtttacgaatttatgttgggctgcattcatggccatcctgggccactcacagttgcgccagagcctcgggagcacaggccgagcacctgccctgcttcacccagggacggggccctgcactgaccaggaggctgttgccctccaagtcgtccctgccgggaacagcaaagcacacaaacctccgagagacctaatggctgcatcctccgtgcagtgggcaccacgcttgccacctagaagagtgggtttggcagatgtcagttaataacaaggatgtaagttttaaaatcacgtgggggtttgtaaacttgaggaattacagcacaaacacttccatattattaaaagaaacagactgggagcattgattttgacttttcttccaagtacttatctatgatttaagtgaaactgagcattcagtgctctgtgggagtgaaaactgcaggcccttgcacttgcccactgattcattcattcacccatccacccactcattcattcaactatccatgcactcgctcatccatccatccactcattccttcatttattcatccatctccatccatccagtcacccattcacccactcactcatctatccactcactcacccacccattcactcatccattcacccacccactcacccacccacctattcattcattcatgtattcatctatctactcactctcattcacccattcattcattcatctgtccatccattcacctatccacccactcatccattcatgtactcactcatctacccactcactcattctttcattcattcatccattcactcacccatccacccactcattcattcactcatctggccactcactcatccacccactcactcattcattcatacactcactcatccatctattcactcattgttttattcattcatccatccatccatccactcacccatctatctacgcatttattcatttacccactcagtcatccgtccatcctcattcatttatccatccatctccattcatttactcatccacccactcattcattctttcatccacccactcatccatccactcattcatttgttcattcatccatctctatccactcatccattcattcattcccattcactcattcatccactgattcattcattcattcatctggttattcacccatccactcacttatccatccatgcatctgtctgctcactcatccatcctactcactaatctatccaccgattcactcatccatccattcattcattcatctgtgcatttatccatacatgcatctatccatccatctatccatctatcaatccatctgttcagtcattcatccattcactcatccatccatccacccactcattcatgcatccatctgcccatccactcatttattcacccatccattctttcacgcactcatccactgtccatctgtcatccatccatgtgtttggtgacggctcatgaggcctctgggggacagtcagcaccaggctcggtgctgggcaggtagatgttgtctttttcctcttgaagcttcagctaacagtgcagtggcttggggtttgctcacttatttttatctgtagctgttcaaataaaacagaagcagatccccggggaaaggatttccaggggccaaatggcgccatttccagcctgggaatcccagcttcttccccctgttgccctcacctaaccccagcacgccaacccattaccataggtcttgctcttcctaggtttagaagaaagagagtcagtgtgtacataaggagctcctggttctaaattccggcctcctgagtggtggcctctgctccatggggactcctgggggtgctgctctggagatatggctaatgcagggcttcaggccaaggtttatggacctgaacaagcagtagtgcagacaggggtgggagggttttgaggacaaagtgctctgtgtttggttctgcaggtcagggagcttatctgggtgcctttactcaaagccatttctgggtcttacatctttggctagaatgttctcaggacaatgtgaaatgtctttatctcaggagtgtataccagaatgttctcaggacaacgtgaaatgtctttctttcttgggagtgtgtaccagaatgttctcaggaaaatgtgaaatgtctctttttctttctctcaggagtgtatagcgtttttaggtttattcatcttagcttttctcttgctcatggtttaaccatctttcccctagtttgccggtggaattagcatatgctttctgcctccattactgtctcaaataatcaaacatgcaaattaggatacagtgcccagggctataaccctgtggtttcagaaaccccattcccataggtgtggcgaactgacaggagattggcatagtttttccatgaataatgcctttttgcaacaataaaacttggtattaatacagattacacattaagtagtatgactagtcttgattttgaaaaatagaacacacttgctgtaaagctgtggtaatgcaagcatttgtgtatagttaggccgtttgctcactagttcttagttgttttcaatccctggcttctaaacctgaaaggacaccttttgcatccctcgcaagtcttttatttcagagccagagcctcctgctttgagacaaagccccatcacttcccttctccttccaagcctagaaacctggtgccacttcgtgttgctccaggactccaccagggctcacttggtatggctgttcttgccttttcttggagtttgccaacccatgactaaaattggaagtgagagaaatgagggcaggcatgagggtgtgtgttccaggtctgcagccctcctggccttcagggcggccgccctcccaacagacacgtgagctgcacaccagctcaccctgacccttcctttctcttaagggagtaagagtttaagagcatcccatctttcctagaacacaactttgtgaaaacacatccaagcaggcctcaggagggtgttggcaaggctggggcggggcctccaggctcttcccacaaaaggtgtggcaaggccagcaagtgtgggagagaggtgggaaggaggcagaaaggccatgcagagccagcgcatgaagccagaggcgcgttgcagacggcgctgggtacctaccgcctctgtctgctactctgcaaaatgctaccagcgcctgctaatcctgaccttcatgcccccaggtgaatcccacaaccatcctgaagccgggtttcctcattcctgataatgggattaaaaagaccttcctgggtgttatttgtgaggatttcataaaatagtgtaaaaatgctgactcatacccagcatggagaggccgctgggactattctgccatgactgtggtctcttggtttagagcatttagggccaaactgctggcatggttgaccctaagctggagattggaggctgctttaaccaggctgtggccctagaatctgtgggccatggcaaaaggatcctgaagaagtttccggccggcctctgctggccaagtgacaggcaggtggttccaggactcgacagctcacttgtgtcgaatgtggacctcgtcagtgcgctttcatggataagaagacccttcattacagcctccatcctcacccagtaccaattttgtttcaccaatactataagtgcaaatcaatgcccgtgtgccaaaagaaaggtctttggggttttgagagacctttgtgtcaacagggaactaaggtctttgggttttagagacccttatgtcaacagggaactaagagtggggttttacttggaagcattcttgtcctcctgggcaggcctctcccctggacacacctggtagcacttcctacgcagctggaaatggccctgcctttgcttgttggtctcacagcagtcgtgccccggtcacttcccctcagttccccgggtggggcggccctctggctgccccgagagcagcctctgattaaccagctgatgcttatgttgttcagagaccctcgtagtgtgccggtcaatgcttgccttttctttttctttttccacaggattatttttacccaagatacttaggtaagtctcaattacttctctactctggttgtcgtagaggcatagttgggggtgcgtgtttcatgttggaggaatctcctcaccacgtaactcttggaaggaagattcttaatcacatggtgcacgtggaactgtccggaacatgcaggtcagaaacacaagtttctctctttattttataccacagctttattccgtgttagtggaacctcaggtgaatgctgttatctgcaaaccccttctctgagttgatgccaggctcagctccttgtcaggacgtgtaattgattttgtcctccggttttctgacctcagcactaatcacttctgaagtcattgaggaccccaaaggggtccatgttcatgtgggctgtattgactgatatttaccgtattcttaattaaaaccgaaaacactgaatagtgtttctgtttaatttgaagaacgggaatgccagacgttatctcagccatcagagcagctggtgcatgtggggcggcctctggagacccccactgtacacttgggaagggaggacagcaagaaagtgaaacccagagaccccgggtcagcccgtttaactgacaccatcttagagctctttgagagcatttcacttagaaggagagaaatgtattccagggtcttctttttaatgttgcaaagtgcattttagtaaatgtcctcttaaagggtccttccctgggtccatatctggaacaaacacagtgggtctggcactggcccagaaagcccaggcaccagcgaggactgagttctgaagcagggggtggccagcggtccacagcacacctgcaggaggccttccgctgttcatccgtgccgttctgcgcctggataagcaacagtaacccactgaagggccaggtcgagaggccccgcaccgttctgcacaacctcacgcttcgggttatccctggatgtgcatgtgccaggcctcgcctccccccgccgccctagcgggatgtctgctgtcaagctgtgttcagccagccagagagcatggaggggctttctccaaagcagagtggctttccagttaagcacagcgtttcccaatgggggtccactggaaaatgaagtttagcttttcgagtaccgtcaggaacttactgagcattcccggtgattctcccgtatggcaggaggagccccctcgaaacggcgggcggtgctttacgcacttgactgtgggtgcacaactccgctgagttggtggaggtggtttcctgtttgtcagggttggggctaacatgttttttattaacacaagctaagcggcattgtttctggaggatgatagcaccccaggtaagcagagtaactgcctctccagagcgtctcagaagcagaggctctgcagtccatccggtcttgtaaggatgactgacatccattccctttcttcctgcagactgcatcaacaagtatgggtctccgtacaccaaaaactcaggcttcgccacctgcgtgcaaagtaagtcggcctcctttgcgccttcctgggagcactgtgggtttgggcggctttaggcttggctgtggtttgtggagggccctgaatagttctgttttttaaggagctgtggtcccttgccgaggcctgctcccttttcgccaaactttcttttttaaacaagtaaattttgacgtttttagcaataggcaataaatgcacatggaacaaaatgtaaatgtttcacagagtgtgatgtgaaagcccatccccgcctctgagtcgtccagtcagacaccaccgtagttacagttccaagaatcttgtgcttagacatgtaaacatgtgtgagcggccttccgctcttcacacgcgtggcggcttagcacacacggtctgtcccgtgcctctgcaactctgtctgcacaggagaccctctcttagcgtgtctcaccttcacgctggcatttccagccggtgcatcatatgaacttagcccatgcatattggctgatgtccaggttatttccaatttccatcatttaaacaaaactggcgtgacatcctcatgcacctgttgcctcccacacgtctgagtgtctgcgggatgcgttcccaaggatggaatcgcagaggcagtcctcatgtttcctttggatacagatactgccaaattatcccagagccagccttagcctccgcccctgcaggggtgaatgaactgtttttttaaacttttgatctcttccaatgtaacaggcgagaaatgacatcagtcatttcaggtttttttttttttttttaactaatgagtaaagctgtccttcataggtttaaaaactgtgtatttcttttcctataaactgttgtttatattttttgcctgtttttctcaatttgtaggagtttgcacattagccattggtagtaaagttatcaaaaattttttcagcttgccacaagtcttttttattattttaaaattatcatgcaataagattgattgttttgggtgtcctgtatgaattttaacataccttcagcacaacccacacagctccccttgcactgggtctgtggtccgctggcgtcacgtgtgtctagttttagatgaaagtccagcttggtgagtccctgtgggcgctgagagcagaggcgtggcgggacggagtcatcctgggagaggcaggagtctcttcccaggcatggctttggagctggatcccagtcagcagaaggagtcagaggtggctcagtcccgctccccaagccccacgcactgtccgtgggcgtctctggcctcccggacttgtatcacagaccccagcccaagagacacaggcagaggaaatgctcagtgtaaacatgggaatgggagggtggccctgccctgtggcccggcctgccctgacctgcaaccatgcacagtagccaggtgccacgtagggcccaatgtctgcatttggggcagaggctcctgcgtgctcagaggagacaagcagatcctgtcacgcgtgttttatcttagtgattgctaaaccagtctcttcttttaaattctgtattcacacttgttatactctcttagttcctgggctttaggcttctccccaagattacaaaacagttacctgctgttaggtgttttcatctgtgacccgcccgtaatttcttttgacgtgatggatgaggtggggatctagactgcaggctcagttcctgccccaacaccacacatttgagtctgtctcaccccagtgcctcacctgctgccgtcctcatatgctgggtatttgggagattttctgccgggtttccacaggccgtggccacagctttagactcggcctcatgcacgcgggtgggtctcctatgccctcctcagtcttttttctggttgtcttgcttattttttaataaaactaaaccttaaaaatattcttaaaaacctaaaaaagccctttagatatttttaactgggcttgccattcatatatcggagactgtgtctgaacagtgttgcgctttcctaaccccggcaccgtcctgtccgtcccttggagcacttttcttcctgtgcgtcccgtgcttcctttgctcagttcacttctggctatttgcagcaaagaaggccgtccttttcaaggcgtcgcctcgcttccttgcatggatgaagaggagtgattgctacatgttcctttctgttcccgccgcccaatagagttatcttgttttggttatttcctttgtggcatcagcgtccccaagtgcggccagctggggagaggagggcaaggtcaagatccttgagtttgttccctgtgtgataggaagagaatctcttgctgtggctggtgccagaggcaacacatgcagtttctaacgggtccacctgccccaggccagaagctccggccactctccctgagccggccctcagaggctgccctgcctgtggcctggggctctcagcttctcctccagagcacgtggctggggcctctgatgttcgcgtgcctcaaaagatgcctggcggtgaagaaggtgctttggtggcctggccacagcaggcagccttgcactcccttgggaaggcgcctcccggaggatgcagctggggcagcctcacactctgttcctgttcattggttccctcgtgaaaattctctgacttggtgctcacggtgctgtcctggcttcagttcactggttatcggtcattgtgaaattaaagccatagccccataaagtccaaattcagccccagacaagcaggcccccagcgggccttgcatgggagcctgcggccctcaggctgtcccaggacccaggcggcacagtggacggagggaggaggcctgggaagagtgtaggctgcgttcccaggtgcccctgaagagcctctgcttccatttctttcctttcccacggacacacccagcttctccactgcgaacgcgcccgtcctgccatagcggccacttggtgcttggatttctcggctcctttgacccatgggtttccccaggaaggtcaggtccccacaggcggtggcccaggcagcggtcactgagccccggctaccgggatcccacccccgccacggggagtgtcccctcgcccttccctcgggcagacagggctctggtcctcgctcgtcaccacccagggaaaggccctggccgcccgcaccggcttcagattccagccacagccacagccgctccctcctgtccttcaacgcagtcatgggccaagctgagataaacccttcacctcctgaacaggcgctggcgcccagggcatgaccagccaggccaccgataccctaggcccagcttgcgggatggggatcagggaggtgggcgggggtcagggaggtggacggggtcagggaagtgggtgccctcgggggcctgcagaggtttctgtctccatcgctttccctgttgtgtggaggaaattccacagatatttgctgggcaccggctgactgtccacccctcaggtgtggttccgtccttgcatcctagaggtatcaatacattcccaacagggaaataaacaaatgagttgggggaggccccggggcaggtggcatgagtctggggaccgcttaagagctgggcacctggcaggagcaggcactgtccctcagcctcagggacagaggtctttccgaaaggcattccaggcaaagtcaagaccgggttcccagccctttgcatcacatgggcaggtgtccacttctgaaatggctttaatctctaaccaaacatcgtagcggcagcgcacagcatcccccagacatccctccatggtgggggcctctgaggaggtcaggttctggtgccggagggttgggccctgcacaggccgcctgccctgcacgtgtctgactccctcctgcccccagagcctcttcatctgaggccagggtggagaagcggatacgcccctcatttctctagttcaggccagacctccccgttccaggccctgctatgaccacatcgacgtctccagacgccccgcggacacagcacccaggtacagccgggcgacagcagtgtcagggatggggccccggccggctcctggcggctgtgctgatgcagaatccctggtcctggtcctcgtttcctcgtaactccgaaggccagccccagcccctgtgtgcttcagagtagaaagcgtttatagtgacctgctgaaaatagcatcttagaaacacttcgagacgcgagctccgtccacacccacaagtgttctgttgtcagtcatttgtgcaaaacaagcaaacggaggtgtagggaggaaactgtggggtgtactgaggaaactgaggcttatagaggaaactgtgaggcagacggaggaaactgaggtgtatggaggaaactgaagcatacagaggaaattgaggcgtatggaggaaactggggcgtatggaggaaactggggcgtatggaggaaactggggcgtacaaaggaaattgaggcgtatggaggaaactggggcgtatggaggaaactgaggcatatggaggaaactgtggggcgtacagagaaaattgaggcgtatggaggaaactgtggggtgtatggaagaaactggggggcgtatggaggaaattgaggcatatggaggaaactgtggggtgtatggaggaaactgggcatatggaggaaactgtggggcgtatggaagaaactgtggggcgtatggaggaaactgtggggcgtatggaggaaactgtggggcgtatggaggaaactggggggcgtatggaggaaactgggcatatggaggaaactgtggggtgtatggaggaaactgggcatatggaggaaactgtggggtgtatggaagaaactggggggcgtatggaggaaattgaggcatatggaggaaactgtggggtgtatggaggaaactgggcatatggaggaaactgtggggcgtatggaggaaactgtggggtgtatggaggaaaccggggcgtatggaggaaactggggcatacggaggaaactgtggggcgtatggaggaaattgaggcatatggaggaaactggggcatacggaggaaacgcgggtgtacggagcaaactgtgaggcatacggaggaaacgctgtgaggcatacggcgaagcgtcgcagaaagaagccagtgtggttgggcagcttccccaagaagcctgggactcgtagccagggcctctggtgagcgcggtgcctggacccgcctaggaggacaggggctgtgtctgtgccggccacaggcagtgactgtaagccctggatgagctggaggaactcagctttgtgaaccacagacccgcccgccgctcaccctggcaccgggcacccctgaccccggccaggtggggatggaagcggctcctgcactgacagccgagcccagaccctctggtggaaacgccacattctacagacctggtgggaaacgtcaccttgggagcctcaggaacagaagcgacacgctggcagtgagagcccatgcactgaagactcgacgtgcccccaccagggctgaccccttaggacgatgctggcccagtgccctagggccctgctggcccggcctgcacttttcccagggactggtccttattgaacttgtgtggaatcaatggaccggagccctctctcagccagcaggggggccctacccagggttccccacggagccctgtgtggctaagctgagcgtggctgagtcctcatgtggggctgagctgagtgtggaccgcgcccctgagcactgccatgctcagccccgagctgcttctgctctgccagcagccatgaaaggattctttgagctccgggtgtaattgtcgttctttctgccaacttcccggggctcaggcttgcgtaactgcactgtcgggggcttccctgcctgcctctgggacgtggtttgggtccgtgtcctggaagcgtgtttgtgagcagctcctcgtatgaatgtgtttgtgagcagcttctcggatgggggactgcttgggaagcagctgcactggcacgggttcccaccctcaggccctcacccgttcccctgacctctggccctgcaggagctgagcccaggtgaccaccctgagaaagggcagaacacacctggcctaaagccatcaagacacgtggagagggggcagctaagcagaaagaggggggcttcctggaggacccctctggcagtgcagcctgggcctggggtcctccccgccacacccagcagggagagttcaccagagatgggctaggggctggccagggaaggcagaatgttccgagtctgcctggaagcccccaggtcagctgggggttctgtgtgcctactccctgggaggtctgagctcccaggcctcacgccaggcagttcctgctcctttgccctcagcccttcccaccttgcgtccaggcctgctggcactccctcccagttgatctgagttttcctggagccggccccagggcccgccagcctattctgtcagccctaggccagcacagagggctcgggtgcccaggggctgcctcagcctgcgcccctcagagctcctccgggctggacccgagaccccacagccgccccgatctcagctgcgttgggcgcgcaggggtggggcagctgaacatgattttccactttgtgtccccaatcagacctgcctgaccagtgcacgcccaacccctgcgataggaaggggacccaagcctgccaggacctcatgggcaacttcttctgcctgtgtaaagctggctgggggggccggctctgcgacaaaggtacgtgaggctgaagacaaaggcggggtctccctccatctccgaccctgccctgatccccgctcctcactcccactccggggcacggccatcctcaggctgctctccgacagccccaaggaggctgcagccctgaggtatcctggagccccaggagaattgggaggagctgcagtctcctttctgggagcagggctggaaggaaaggaaacaccaagtgatgcctcagcacccactgattgaagggcggggggggaaatttcacctctgaccgtccttgagtgcagacctgtggtgtcagtggcacccactgattgaaaggcgggggggaaatttcacctctgaccgtccttgagtgcagacctgtggtgtcagtggcacccactgattgaaaggccggggggagatttcacctctgaccgtccttcagtgtagacctgtggtgtcagtgaagaccctggaggaagaatagctccagggcctggtggagacccatagtggagagcccagcaggccagcctgtcccctttggcaaatcctaccccacaggtggcctgggagggctttgctaaggagtggccagctctggcctggccttgtctgtcctcggcacccagaggtcactcctggcctgcagcctcctcctgcaagcacatgggcatccagggagctgagccctgtgggctgtgactgccagcagctccccaggctgagaccgcagctggggatcccccatgccctcccaccatctacctccacacgcaaggccaggaccaggggccatgaaacgctagggctgctgagtggggtgtgaggtccaagccctggggtccctctctgctccagggctgggctgtgcacctctaggatctctctctgctcgggggctgggctgtgcactcccaggctctctccctgctccagggctgggctgtgcacacccgcggtcccttcctcctgctccagtgctgggctgtgcacccccccggctccttccctgctccagtgctgggctgtgcacccccgggctccctccctgctccagggctgggctgtgcacccccggggtcccttcctcctgctgcggggctgggctgtgcacccccgggctccctccctgctccagggctgggctgtgcacccccggggtcccttcctcctgctccggggctgggctgtgcacccccgggctccctccctgctccagggctgggctgtgcacccccggggtcccctcctcctgctccggggctgggctgtgcacccctgggctccctccctgctccagggctgggctgtgcacccccggggtcccttcctcctgctccggggctaggctgtgacccctggtctccctccctgctccagggctgggctgtgcacctttgggatctctctctgctccagggctgggctgtgcacctctgggctccctccctgctccagggctgggctgtgcacctctgggatctcttcctaccgtagccaggggctgtgcacccttgggctccccttcaggcctgtgcttgttcccagatgtcaacgaatgcagccaggagaacgggggctgcctccagatctgccacaacaagccgggtagcttccactgttcctgccacagcggcttcgagctctcctctgatggcaggacctgccaaggtaaggccctggggtgaggcctctctcctctctcctctccccaccttctattttcggtcatgtctgctcttctgcaagcggctgctgctggctgggttcctgtggttctggatgggatggggcatcctgcagagactacacaagcccaggccagccgcagcacagggagctgctcggcaccacaccaggatgactcacccggcatctgagggccaggactcagggggccggcccagcccatgaggccacactgctggctgtagggcctcgtccattccccagagcctcacagagcctggaagtgctccaggcacttgtgtagtgagcttgtgggtcagggctccaggctagggtccccccgccgtccactctccccagcatccccagaagcaccccgttgttggtctccctctgtccactaaatatagccctgccctccccacttcctttcatatttcagtctggggttccctcagcccagggccagagctggggagccccaggacaccccagaaagtcactgtgaatgtgcgcgcccccgacgctgttccaggtgctgctgctgccactggccctttgccactttgcagggggagcaccttcctcctccctccccacgttgtatctggacatgcccaggcgtgtccctgagagtttctggcatagttcttagcgctgctgctgactgtccaggacaccgaactgcgtggacaggacagacagttgctcagggagaaacagccccaggatctggagagtgaatctgaccagacaggaggggccacaccccatcccccgatttcaaaaggcagctgctatttctgtccactttggtggttcccttccctgaccacccaggagttagccctgtgtgcagatgacgtgattcccatcttaacacataaacccatttccccgccgaggacagagcccctcccatcactgctctatccctgacctggaagacagcagcaccccaggtttaaagagaggtgaagactaggccgatcctgagagatgacgtctaaagcatctcccgtgggtccctgcaccagtcgggcactcccggcaaagtctaggctcacagttactgcccacagtgacagaggcattcccgtcctctcctcctcctccccatcttcctcttcctccccaccattccccctcctcctttccccactccccctcctcctctccccactccccctcctcctcccccccactccccctcctcctccccatcttcctcctcctcctcatcttcctcctcctctttcttctcctcctccccccactccccctcttcctccccatcttcttcctccccctcctcctcctcattcccctcttcttcctcctcattcccctcttcttcctcctcattccccctcctctttttccccctcctcctcccccatccttatttcccctctcctcctcctcccccacccctccccaccccctccctcacccctccccaccccctccctcacccctccccaccccctccctcacctcctcccccacccctccctcaccttctcctcttcctccctgcttctcctcctcctccccctccgtcgtcctccccctccgtcctcctccccctccgtcctcctccttcccttccccattctcctccccctccccctcctcctccccctcctcctcctccccctcctccccctcctctccatcctctccctaccccctcctcctcccctcctcccctccccctcctcttctccccctccccttctccccctcccccttctccccctcccccttctccccctcctcctcctcctcttcctccttcccctccccccttcctcctcccactcctactcccccttctcctcccccacctttctccgtgcccctgcctttgctctcctctggtgactaaagggctcttcatttcagggttgcccctcctaccccagggtgcttggccgtaaacagcatctgtcccacattagatgctcaagtcttaggattgtggtttaacccggtagtgaaaattgattgaaaccagtaaatgcttctctttggggttggggttttagtttcaaatgcccccggggggttactttttacggccccgtgtcctgtagcaccgtcatttaaatggaacagcacagcgtgcaccgccgccccccacccctccaccaagcagggcccttcccagctctccacctgctgggctgaagtcagccttcccagccgggccttgatcagaagcgtgcaccaacaccccgggagctgcccggtcaggggaggagggcagggaaatggggccagggcgcgctggccccacagagtctggatgcgacctctgggtggtgccctggccagtccctgcagccgcctgccccagccccgtctgagatgccgctgtgctgcggttggccggtttttttttgcttgcagacatagacgagtgcgcagactcggaggcctgcggggaggcgcgctgcaagaacctgcccggctcctactcctgcctctgtgacgagggctttgcgtacagctcccaggagaaggcttgccgaggtacccacgccacgcggtcaccctcgctttctctgacgcccaagtctagacacgggtgccagtcactgcccgagccggttgctaacaaccgggtgcttctggtgaaagaaagtctctttctccctgtttctatcagcctggtaatggcctgtgctaccaccatgcccgcacacacgtgagcacacacaggcacccatgccccttgtgcacatgaacgaaccgcacacatgcatatacaccgcatgtacacacgtgtgtacccttctccacctgcatagacggggcctctccccaaagggacggggagcagcaagcctccctctactgttctctctttccagccgccatggggagggccctgttggccgtagagcctctaagaggggccgtgcccccagtgatgggaacagtggggctgagtaggcagacagagagggtggggaagcccaggctgcctgcactgacctccatttcccaccacagctgtcggcccctctgtgctccgggggacacctcactgcacagcccagaccctgtgcttcccagacctgccttccacaccggcccggcagcgggggtgggtctggctcgttgggagcaccctcctgggacacctgcgacatttttattccctcaagaaagagcccgggcaggagcaggccgagggtgcaacctagctttccagtggggggggacgcgacccccaagccgcccccgttagaatctgcatgtaattccttgagcgcaccttgcgtgtggtttgagcaatcgcggtgtgatcccacggcgggacagcgtagaggcctccccggctcaccgccgcttccctctggctggcagatgtggacgagtgtctgcagggccgctgtgagcaggtctgcgtgaactccccagggagctacacctgccactgtgacgggcgtgggggcctcaagctgtcccaggacatggacacctgtgaggtaggcggcccctggccccgcgggcccttcacggtggttccgggggccctcgccggtgggggctttcgggagaaacacttccgtgaagacctggcctttgctaaggtgttggggatctccagggccatgtggaggtttgggatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 617 - DNA, 27233 bp, Homo sapiens
accgggttcccagccctttgcatcacatgggcaggtgtccacttctgaaatggctttaatctctaaccaaacatcgtagcggcagcgcacagcatcccccagacatccctccatggtgggggcctctgaggaggtcaggttctggtgccggagggttgggccctgcacaggccgcctgccctgcacgtgtctgactccctcctgcccccagagcctcttcatctgaggccagggtggagaagcggatacgcccctcatttctctagttcaggccagacctccccgttccaggccctgctatgaccacatcgacgtctccagacgccccgcggacacagcacccaggtacagccgggcgacagcagtgtcagggatggggccccggccggctcctggcggctgtgctgatgcagaatccctggtcctggtcctcgtttcctcgtaactccgaaggccagccccagcccctgtgtgcttcagagtagaaagcgtttatagtgacctgctgaaaatagcatcttagaaacacttcgagacgcgagctccgtccacacccacaagtgttctgttgtcagtcatttgtgcaaaacaagcaaacggaggtgtagggaggaaactgtggggtgtactgaggaaactgaggcttatagaggaaactgtgaggcagacggaggaaactgaggtgtatggaggaaactgaagcatacagaggaaattgaggcgtatggaggaaactggggcgtatggaggaaactggggcgtatggaggaaactggggcgtacaaaggaaattgaggcgtatggaggaaactggggcgtatggaggaaactgaggcatatggaggaaactgtggggcgtacagagaaaattgaggcgtatggaggaaactgtggggtgtatggaagaaactggggggcgtatggaggaaattgaggcatatggaggaaactgtggggtgtatggaggaaactgggcatatggaggaaactgtggggcgtatggaagaaactgtggggcgtatggaggaaactgtggggcgtatggaggaaactgtggggcgtatggaggaaactggggggcgtatggaggaaactgggcatatggaggaaactgtggggtgtatggaggaaactgggcatatggaggaaactgtggggtgtatggaagaaactggggggcgtatggaggaaattgaggcatatggaggaaactgtggggtgtatggaggaaactgggcatatggaggaaactgtggggcgtatggaggaaactgtggggtgtatggaggaaaccggggcgtatggaggaaactggggcatacggaggaaactgtggggcgtatggaggaaattgaggcatatggaggaaactggggcatacggaggaaacgcgggtgtacggagcaaactgtgaggcatacggaggaaacgctgtgaggcatacggcgaagcgtcgcagaaagaagccagtgtggttgggcagcttccccaagaagcctgggactcgtagccagggcctctggtgagcgcggtgcctggacccgcctaggaggacaggggctgtgtctgtgccggccacaggcagtgactgtaagccctggatgagctggaggaactcagctttgtgaaccacagacccgcccgccgctcaccctggcaccgggcacccctgaccccggccaggtggggatggaagcggctcctgcactgacagccgagcccagaccctctggtggaaacgccacattctacagacctggtgggaaacgtcaccttgggagcctcaggaacagaagcgacacgctggcagtgagagcccatgcactgaagactcgacgtgcccccaccagggctgaccccttaggacgatgctggcccagtgccctagggccctgctggcccggcctgcacttttcccagggactggtccttattgaacttgtgtggaatcaatggaccggagccctctctcagccagcaggggggccctacccagggttccccacggagccctgtgtggctaagctgagcgtggctgagtcctcatgtggggctgagctgagtgtggaccgcgcccctgagcactgccatgctcagccccgagctgcttctgctctgccagcagccatgaaaggattctttgagctccgggtgtaattgtcgttctttctgccaacttcccggggctcaggcttgcgtaactgcactgtcgggggcttccctgcctgcctctgggacgtggtttgggtccgtgtcctggaagcgtgtttgtgagcagctcctcgtatgaatgtgtttgtgagcagcttctcggatgggggactgcttgggaagcagctgcactggcacgggttcccaccctcaggccctcacccgttcccctgacctctggccctgcaggagctgagcccaggtgaccaccctgagaaagggcagaacacacctggcctaaagccatcaagacacgtggagagggggcagctaagcagaaagaggggggcttcctggaggacccctctggcagtgcagcctgggcctggggtcctccccgccacacccagcagggagagttcaccagagatgggctaggggctggccagggaaggcagaatgttccgagtctgcctggaagcccccaggtcagctgggggttctgtgtgcctactccctgggaggtctgagctcccaggcctcacgccaggcagttcctgctcctttgccctcagcccttcccaccttgcgtccaggcctgctggcactccctcccagttgatctgagttttcctggagccggccccagggcccgccagcctattctgtcagccctaggccagcacagagggctcgggtgcccaggggctgcctcagcctgcgcccctcagagctcctccgggctggacccgagaccccacagccgccccgatctcagctgcgttgggcgcgcaggggtggggcagctgaacatgattttccactttgtgtccccaatcagacctgcctgaccagtgcacgcccaacccctgcgataggaaggggacccaagcctgccaggacctcatgggcaacttcttctgcctgtgtaaagctggctgggggggccggctctgcgacaaaggtacgtgaggctgaagacaaaggcggggtctccctccatctccgaccctgccctgatccccgctcctcactcccactccggggcacggccatcctcaggctgctctccgacagccccaaggaggctgcagccctgaggtatcctggagccccaggagaattgggaggagctgcagtctcctttctgggagcagggctggaaggaaaggaaacaccaagtgatgcctcagcacccactgattgaagggcggggggggaaatttcacctctgaccgtccttgagtgcagacctgtggtgtcagtggcacccactgattgaaaggcgggggggaaatttcacctctgaccgtccttgagtgcagacctgtggtgtcagtggcacccactgattgaaaggccggggggagatttcacctctgaccgtccttcagtgtagacctgtggtgtcagtgaagaccctggaggaagaatagctccagggcctggtggagacccatagtggagagcccagcaggccagcctgtcccctttggcaaatcctaccccacaggtggcctgggagggctttgctaaggagtggccagctctggcctggccttgtctgtcctcggcacccagaggtcactcctggcctgcagcctcctcctgcaagcacatgggcatccagggagctgagccctgtgggctgtgactgccagcagctccccaggctgagaccgcagctggggatcccccatgccctcccaccatctacctccacacgcaaggccaggaccaggggccatgaaacgctagggctgctgagtggggtgtgaggtccaagccctggggtccctctctgctccagggctgggctgtgcacctctaggatctctctctgctcgggggctgggctgtgcactcccaggctctctccctgctccagggctgggctgtgcacacccgcggtcccttcctcctgctccagtgctgggctgtgcacccccccggctccttccctgctccagtgctgggctgtgcacccccgggctccctccctgctccagggctgggctgtgcacccccggggtcccttcctcctgctgcggggctgggctgtgcacccccgggctccctccctgctccagggctgggctgtgcacccccggggtcccttcctcctgctccggggctgggctgtgcacccccgggctccctccctgctccagggctgggctgtgcacccccggggtcccctcctcctgctccggggctgggctgtgcacccctgggctccctccctgctccagggctgggctgtgcacccccggggtcccttcctcctgctccggggctaggctgtgacccctggtctccctccctgctccagggctgggctgtgcacctttgggatctctctctgctccagggctgggctgtgcacctctgggctccctccctgctccagggctgggctgtgcacctctgggatctcttcctaccgtagccaggggctgtgcacccttgggctccccttcaggcctgtgcttgttcccagatgtcaacgaatgcagccaggagaacgggggctgcctccagatctgccacaacaagccgggtagcttccactgttcctgccacagcggcttcgagctctcctctgatggcaggacctgccaaggtaaggccctggggtgaggcctctctcctctctcctctccccaccttctattttcggtcatgtctgctcttctgcaagcggctgctgctggctgggttcctgtggttctggatgggatggggcatcctgcagagactacacaagcccaggccagccgcagcacagggagctgctcggcaccacaccaggatgactcacccggcatctgagggccaggactcagggggccggcccagcccatgaggccacactgctggctgtagggcctcgtccattccccagagcctcacagagcctggaagtgctccaggcacttgtgtagtgagcttgtgggtcagggctccaggctagggtccccccgccgtccactctccccagcatccccagaagcaccccgttgttggtctccctctgtccactaaatatagccctgccctccccacttcctttcatatttcagtctggggttccctcagcccagggccagagctggggagccccaggacaccccagaaagtcactgtgaatgtgcgcgcccccgacgctgttccaggtgctgctgctgccactggccctttgccactttgcagggggagcaccttcctcctccctccccacgttgtatctggacatgcccaggcgtgtccctgagagtttctggcatagttcttagcgctgctgctgactgtccaggacaccgaactgcgtggacaggacagacagttgctcagggagaaacagccccaggatctggagagtgaatctgaccagacaggaggggccacaccccatcccccgatttcaaaaggcagctgctatttctgtccactttggtggttcccttccctgaccacccaggagttagccctgtgtgcagatgacgtgattcccatcttaacacataaacccatttccccgccgaggacagagcccctcccatcactgctctatccctgacctggaagacagcagcaccccaggtttaaagagaggtgaagactaggccgatcctgagagatgacgtctaaagcatctcccgtgggtccctgcaccagtcgggcactcccggcaaagtctaggctcacagttactgcccacagtgacagaggcattcccgtcctctcctcctcctccccatcttcctcttcctccccaccattccccctcctcctttccccactccccctcctcctctccccactccccctcctcctcccccccactccccctcctcctccccatcttcctcctcctcctcatcttcctcctcctctttcttctcctcctccccccactccccctcttcctccccatcttcttcctccccctcctcctcctcattcccctcttcttcctcctcattcccctcttcttcctcctcattccccctcctctttttccccctcctcctcccccatccttatttcccctctcctcctcctcccccacccctccccaccccctccctcacccctccccaccccctccctcacccctccccaccccctccctcacctcctcccccacccctccctcaccttctcctcttcctccctgcttctcctcctcctccccctccgtcgtcctccccctccgtcctcctccccctccgtcctcctccttcccttccccattctcctccccctccccctcctcctccccctcctcctcctccccctcctccccctcctctccatcctctccctaccccctcctcctcccctcctcccctccccctcctcttctccccctccccttctccccctcccccttctccccctcccccttctccccctcctcctcctcctcttcctccttcccctccccccttcctcctcccactcctactcccccttctcctcccccacctttctccgtgcccctgcctttgctctcctctggtgactaaagggctcttcatttcagggttgcccctcctaccccagggtgcttggccgtaaacagcatctgtcccacattagatgctcaagtcttaggattgtggtttaacccggtagtgaaaattgattgaaaccagtaaatgcttctctttggggttggggttttagtttcaaatgcccccggggggttactttttacggccccgtgtcctgtagcaccgtcatttaaatggaacagcacagcgtgcaccgccgccccccacccctccaccaagcagggcccttcccagctctccacctgctgggctgaagtcagccttcccagccgggccttgatcagaagcgtgcaccaacaccccgggagctgcccggtcaggggaggagggcagggaaatggggccagggcgcgctggccccacagagtctggatgcgacctctgggtggtgccctggccagtccctgcagccgcctgccccagccccgtctgagatgccgctgtgctgcggttggccggtttttttttgcttgcagacatagacgagtgcgcagactcggaggcctgcggggaggcgcgctgcaagaacctgcccggctcctactcctgcctctgtgacgagggctttgcgtacagctcccaggagaaggcttgccgaggtacccacgccacgcggtcaccctcgctttctctgacgcccaagtctagacacgggtgccagtcactgcccgagccggttgctaacaaccgggtgcttctggtgaaagaaagtctctttctccctgtttctatcagcctggtaatggcctgtgctaccaccatgcccgcacacacgtgagcacacacaggcacccatgccccttgtgcacatgaacgaaccgcacacatgcatatacaccgcatgtacacacgtgtgtacccttctccacctgcatagacggggcctctccccaaagggacggggagcagcaagcctccctctactgttctctctttccagccgccatggggagggccctgttggccgtagagcctctaagaggggccgtgcccccagtgatgggaacagtggggctgagtaggcagacagagagggtggggaagcccaggctgcctgcactgacctccatttcccaccacagctgtcggcccctctgtgctccgggggacacctcactgcacagcccagaccctgtgcttcccagacctgccttccacaccggcccggcagcgggggtgggtctggctcgttgggagcaccctcctgggacacctgcgacatttttattccctcaagaaagagcccgggcaggagcaggccgagggtgcaacctagctttccagtggggggggacgcgacccccaagccgcccccgttagaatctgcatgtaattccttgagcgcaccttgcgtgtggtttgagcaatcgcggtgtgatcccacggcgggacagcgtagaggcctccccggctcaccgccgcttccctctggctggcagatgtggacgagtgtctgcagggccgctgtgagcaggtctgcgtgaactccccagggagctacacctgccactgtgacgggcgtgggggcctcaagctgtcccaggacatggacacctgtgaggtaggcggcccctggccccgcgggcccttcacggtggttccgggggccctcgccggtgggggctttcgggagaaacacttccgtgaagacctggcctttgctaaggtgttggggatctccagggccatgtggaggtttgggatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaacaccgcgtggccgtcatctgctccccgcggggttctgcacacgtagcagcgtttgggatgagcggggctgccagggctccaggccgcaccctcagccgctccaaagatccctccctcttttctgctcccagcctggttgggcagccacggtctgctccccaggagcctctgactcctctggtagtggcggcaggggctggagcctcagtttacttgttctgtaaatgcggagaacgccctgctcggcccccaccacaggcagccagtcattgctgagtgaggagggcttggcacacaaatgcaggctgctggggcagcggcctctgagccaacctgggagggaccccgagctgggaccgagggccggaagacaccgaggcagcgcctgcacccctgtgccattcccgtccccaccctcctgcacagatccacttgcttccgggcctcaagtgtgttctgttgagaaagggaaactgctttctctgtgtcggtctggggtagagcttgccaggagcaaagccagccctgcttcccgcgtccccactggcagggtccccatgtccctcagcctcagcttccttgtctgcaaggggtggagcggtcactggtgctctctgaccccagcaggccacaagtctgcagggaaggtcagggcagccggaacgcggccaggcaggtgcctgaaatgcagtcgggaccctgcctgcctcctggaaggatgtcggagccgcagctggtgggggccacggagtcactgcttctccttggtcccaaggggacgaccaagactcatggcttgacgctcccgtgggacgcggccacctgtgctcgagcctctgggccaaacatgggtccccagggtggatgcggtcactgcaggggccacacgggggatcagggagggtttcagctctgaggcccaaaccaggattccactttaagaccaaacccccacccgtgctcggagctccctgggcaggagtgagacggggcagctcggagcagccccacctcccaccagtcagtcccagagctgcgcccaccgggcaggacaggctgtgcgtcggggcatctttgcctctgcctggctggggtcagcacttgacctagagaaaagtcgggtggagaagaaggatagaatccatgagaacccatccagggataaatcgccacaaatgaactgcaaagaggtttctagaaagaggcctgtggctttgaaggccacaggggaggccccgctggctggactgacaaggtggcatcggccgagtgggctcctgaggggcagcctcgggccgggaaggagcggcttccctctggcccccggcctgacggctgtggaatgggcagagcttctccaaggctcgggagccagcaacactcatgcccacctggagggaccctgcccgcctgggccgagctcaccccacggatggacggccagccaggcaccttgccaggggccatgcacagggggccccatcccctgccgtccagagccgcccagctcgtctacgctggagcctccaggccctggtggtccctgagggtccctggcaggcccaccctgtgtctctggggctcttgttgaccggtgccagttatgggctcctcgggccacatcccatgaccctgcgccatcgtgggcatgatgccacttgctctggacacgccgggcaagggcctcttgttctccccaaaatcttggcagcacctgggcagaagttctgttgattgagggctgcagcctgaattcaggacttcaacctagtctaagaggtattgcaggcaactttcgcttcggtaccgtgagaaaatagtgacgggggaggccctggcctcagagggcagacgtcaggctcctgccggctcccttcggaaacgtccatctgccgccagcggccccgcgtgtgtgtgacggctctcgccagcctcgcccagcagcacgtggaccttccgcaggcagatgcgctttctccactcgggccgggacagatggccaccggctgctcacacggtcggggacccgcagcccaggcctccacgctggctccgggatgtccaggtgctggttgggctgaggatggtcgggcccagggctcggatctggccatcagcacagaagcccagttctgggaggcccaggcgtggatgctgacggctcgctaagcaggccaactcgtctgaccccgacgatgccagagccagctgagcagagctccaagaagcccgtggaacacagccccctgggccccaggagagccctgcactgcccactgcacggcctcacacggccacaggggccacagccgcacgctgggatcccaggctccagcccggcaccgcggcgtccctcagatcccggcctccagcccggcaccgcggtgtccgtcagatcccagcccggcaccgcagcgtccctcagatcccggcctccagcccggcaccgcggcgtccctcagatcccggcctccagcccggcactgcggcgtccgtcagatcacattggtgggtgccccccagtgctctcccataatgttccccagccggctgggagcctgctcctgcccaacctccatcctccccaagtcaagacggccaggagcaaaaacaggcaacggccagtctcagggacagagacgtggggaggcccccacagacacaggctacagtcaccagtgtcctcaggacacaaccctccgcctgggtttctgctctgcctccagacgaatcaggaacttctgtttcctagtattgttttcttagagttccgggggtgccagaagttataataaccactgtcccaaacaagcaaaaccaatggtgctaggaattgcaacacagaggcccagccaggcctgtcacgttggcgacctggcaccctccacaaccaggcatgtctggggtgtgcaagaggatgggaagacagagcacgtggtgcaagtgctggtgccctggggaggcaggagggatgtgccccttagagggaggagggatgtgcgccctggagggaggagggatgtgccccctggagggaggggtgatgtgccccgtggagggaggggggatgtgccccctggagggaggggggatgtgttccctggagggaggggggatgtgtcccgtggagggaggggggatgtgtcccgtggagggaggggggatgtgtcccctggagggaggggggatgtgtcccgtggggggaggggggatgtgtcccgtggggggaggagggatgtgtcccgtggagggaggggggatgtatcccgtggagggaggggggatgtgtcccctggagggaggggggacagccctgactctgggctggagaggaggaaggaggttgggcatgtgttttgcaggtggggtcctttgatgtggccgcgtcctgtgcacagcagatgcagcatcgccccctcctggacacccagcctcatgacaacacgaaatgtctccagaggttggccactgtcccctgggcccgggcacctctggggaaacactgctctaagcaagaaggaacgtttcgtcctacttcacgtaatacggcaaatatgaacatcagatttttaaatgccaacggaagcataaagcaaatgtacagccgggctaatcccagcacagcccatttgtaggagaagctccagccacagcccctgcctgcaaagcaagaagggtcacctgccccagggtcaaggactccacgaggggagagggggagggtccgctccatggtgcccttgtttcaagcacgttttctgcttactgaattccatcagttaaaaggtctaggaaacagaaaaggaagtggcgcgtgtcgccgtctgaggatctgctgacgggccccggcctcgtggaatcctcttctgcctctgtgggtctccagagtttcggaggcatctctgctcccaccgcggggtctggtggccacggggtccccaagtctgcaggaggagctgctctgtgtggcgagggtgatgaccatggctcttgttcactgagcagggccggtggccagcactgtccaagtcaccagtgcagccccataaggccatcttcacaacatccttggggcccgtttctcccactcccgtttccatggagatgtgattcacacagcaatagccacgcctcatgagtgcagagcatgggtcggtggtcagtccatccacggggccgtccacccatcactgccatctggctcccggacactcctcttcccacaagaactcgtgtccctgaccagtgactgcacctctccccatccagaacacgcttagaacacacttgcctccccgaaaagaactcgtatccctgaccagtgactgcacctctccccatccagaacacgctgcaaacacgcttgcctccccgaaaagaactcgtgtccctgaccagtaactgcacctctccccatccagaacacgctgcaaacacgcttgcctccccgaaaagaacccgtgtccctgagcagtgactgcatctctccccatacagaacacgctgcgaacacgcttgcctccccgaaaagaacccgtgtccctgagcagtgactgcacctcctttcccagtcggcttctgtctgtggacacgccttctctggacactgcatataaacagaacacagtcttcatgtctggtgtccttccctgagcactgtgtgttacagcctcagcacccgttagagcttccttcctctccgtggccgggtgacccgcgtgtggatgggccacgtcctctccctctctgtggctgggtgagacccgcgtgtggatggaccactgtagtattctgttttcacactgctaataaggacatacccgagactgggaaaaaaagaggtttaacgggacttacaattgcacatggttggggaggcctcagaatcacggtgggaggcaaaaggcacttcttacacggcaggagcaagagaaaatga

SEQ ID NO: 618 - DNA, 15497 bp, Homo sapiens
attgattgaaaccagtaaatgcttctctttggggttggggttttagtttcaaatgcccccggggggttactttttacggccccgtgtcctgtagcaccgtcatttaaatggaacagcacagcgtgcaccgccgccccccacccctccaccaagcagggcccttcccagctctccacctgctgggctgaagtcagccttcccagccgggccttgatcagaagcgtgcaccaacaccccgggagctgcccggtcaggggaggagggcagggaaatggggccagggcgcgctggccccacagagtctggatgcgacctctgggtggtgccctggccagtccctgcagccgcctgccccagccccgtctgagatgccgctgtgctgcggttggccggtttttttttgcttgcagacatagacgagtgcgcagactcggaggcctgcggggaggcgcgctgcaagaacctgcccggctcctactcctgcctctgtgacgagggctttgcgtacagctcccaggagaaggcttgccgaggtacccacgccacgcggtcaccctcgctttctctgacgcccaagtctagacacgggtgccagtcactgcccgagccggttgctaacaaccgggtgcttctggtgaaagaaagtctctttctccctgtttctatcagcctggtaatggcctgtgctaccaccatgcccgcacacacgtgagcacacacaggcacccatgccccttgtgcacatgaacgaaccgcacacatgcatatacaccgcatgtacacacgtgtgtacccttctccacctgcatagacggggcctctccccaaagggacggggagcagcaagcctccctctactgttctctctttccagccgccatggggagggccctgttggccgtagagcctctaagaggggccgtgcccccagtgatgggaacagtggggctgagtaggcagacagagagggtggggaagcccaggctgcctgcactgacctccatttcccaccacagctgtcggcccctctgtgctccgggggacacctcactgcacagcccagaccctgtgcttcccagacctgccttccacaccggcccggcagcgggggtgggtctggctcgttgggagcaccctcctgggacacctgcgacatttttattccctcaagaaagagcccgggcaggagcaggccgagggtgcaacctagctttccagtggggggggacgcgacccccaagccgcccccgttagaatctgcatgtaattccttgagcgcaccttgcgtgtggtttgagcaatcgcggtgtgatcccacggcgggacagcgtagaggcctccccggctcaccgccgcttccctctggctggcagatgtggacgagtgtctgcagggccgctgtgagcaggtctgcgtgaactccccagggagctacacctgccactgtgacgggcgtgggggcctcaagctgtcccaggacatggacacctgtgaggtaggcggcccctggccccgcgggcccttcacggtggttccgggggccctcgccggtgggggctttcgggagaaacacttccgtgaagacctggcctttgctaaggtgttggggatctccagggccatgtggaggtttgggatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaa

SEQ ID NO: 619 - DNA, 190027 bp, Homo sapiens
cttgtacaccacaaatatacccaacttttatttgtcaattacactttaataaagctgggggaagccactctttttttgggcacagcatccggcttttatttactaactttgagaacagagtaccttgatcaattaaatggtagggagcgctgtggagacagcatcctccccagtccgggaagagaggcctaggatgcctggggcccagcggcctcttccctcctggcgtccccggctgccctcgctcccaggccccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgccatgtctaccgcccagtcactcaaatccgtggactacgaggtgttcggaagagtgcagggtaggaggcccctctacggtgggagatcaaaaaggttatgggaggaaggggagaaagctgtgagaagcgcctcccacctaaagtatgccttttcccgttgtggctgggacttccgctccgccatgacacagcagcggcggcggggagggaggcgaaacgcgcatgcgcccgaggacttggacgggcggaagtacgggaatggggagggaagtgggggagcgggagaggaggggtcaggggactgctgaggaccagaagtgggcggctgctgggtgcgggagtaagcggcacgggggaatgttgaagttgggtaggaaaagaagagggtcttttaactagtggtctcgttgcttgccactgaagctacctgggcttgacttgagttttaggaaggacacttagatggtttaaggttaatttttcagaggtcaaacctttttttagacctctttgtagctcttaaaagaatgaaattgttatctaatttttgtttcatcctaagtttaagtagttgccaagtttgtaatgtctggcttgttgaaaatattgatatttataaatgaaaatattaagtcactctgagatttatgcaatggaatataaatagggtagtgatttaacatccaccatcttcatttaaaataaaactcttcaacaatgggaaattttactcatttcttttcctctttgaatttgattttcatttcacttttcccaccgaattaccccattgttttgcttgagggttttttttttttttttgctcaccctatcatacttttctgcaatatgtatatgtacatatatgcacatgtatgaataagtgtaatgctttttcttaatttcctttgacaataaggctctcttagaaacaaatgctggttctttggtgccaaaaagaagaactagcgctcaaagaattttctcagcaaggcaattttacctctatagaagggtgcgactcgcggatgaagcaatggcaacggcacacctgaacaggggaggggaaggggttcttattcctgatgcaggtagcctctactgctgtgtctttcccctactggctagggttggaccgcacagtctaagctaattccgactggctattttaaagagcaggcgtacgagctcaagtggcggggtgaataatttggcaggaagggtggttacagaacaggtgactcaggatgattcaggtcagagcaggtgaccaggggtgactcaggatggagcaggtgaccagaggaatagaggtgaactactgattagaactggtggaaaaggttgtttactgaaactagaggcgaggagaacgaggaagctagactttagagcgcaaagaaccgagcatactgacatactgattctttgaagagaaatttagaactcattgtattcaacagctccaagtattaaattttttgtctggatggagttattattgaaattattattagaacactagatgaaaatataaaaagtatgataaacattattaaaatttaaaggtaaatttgtgttagaagtttatttttttaattttatttttttaagagatggagtcttgctctgtcacccagactggagcaagtgcaatggcacaatcatagctcactgcagcctggaactcctgggctcaagtgatcttctgcctcagccttctaagcagctgggactacaggctcatgccaccatgcatgactaatttttaaaatttttttgtagagaaagggtctctgttgcccaggcaagtctcgaaatcctggcttcaagggatcctcctgcacttcgcctcccaaagtgatgggattacaggcgtgagccactgcactcagccagaaatttattaatgagaagactgggggtgtttatggaacctcggttggtggaagagttgaattatccttgtatttggtactctagaggtttttacactttggtgcagtgtaccagggtaagattaagaatgggtaaaagtgtgccttttgtaaagagatctttttttaatttaattttatttttatttcctataggtctttggagaacaggtggtgtttgattacatgaataagttcattactggtgatttctgagattttggtgcatccatcacccaagcagtttacactgtacccaatgtgtagccttttgtccctcaccccgtcctaccctttcccccctgactccccagaatccattgtatcattcttttatgcctttgcatccttatagcttagctcccacttagaagtgagaacatagaatgtttagttttccattcatgagttacttcacttaggataacaggagacctttctttcaaaggatgattgtgcaaagggaggtaggaaaggagtctcaggtcagttttaggaaggaatatatgtggaagttgaagatctggaaattgattccctgaacattatgcatggatctgtactctttagaaagtctttgagtgaacccagcggtatgttatcctgctttgaaaactgccacaataagtcaccaaaacacgtaatgtaaaatacgaaagtggtggcaaagatcacctgacagaatggtccactagagacaaatggcagtagtgaaggagtctgtgtgtgtgtgtgaatgtgtgacatttattatgggtgttctttgtgctgagcatttcactgttgtttacttaatcatcacaattttgtgagatgcatgtcttattcctgttttaacaaggacaaaacaggtgcacagagattcagtaacttggacaagcccttagttgacaaatgggatttgattctacatctctctgactttaaaagttgtgctttcccattataagatgttatctgctattacattatatatttctattaactatacaattccacttttgtgcacatagtggtaacacggtatataatcaatttggaccagcagtaaaaatatggaaaagagaaacgtactatacataaatagtggggtttaaaaagtcaactttagggcaataattcctatagtttgcagtatgctaaatggaagagagtacatgcccactattgatcaaggcatagtatgtagtacaaactcaccatcacatatttacatacatctacattgacattccctgacaatttagaatgtgccaagctctgtactcaacattttacatatattgtctcatttaatcctcatccctgtaactgcaatggtttttctcatttaacagatggagacattgaggcgtggggaagtaacttctttcccagttatacacaagttaagaagtgggatttgaatcttagtagtcttttttttttttttttttttttttttttttttaacagggtctcattatgtcacccgggcaagatcatagctcactgcagccttgagctcctgggctcatatgatcttcctgcctcagcctcctcttgagtagttgggactacaggcatgagtcaccatgcccagctaactttttaatttttccttggtagagagggagtctcactatgttgactaggctggttttgaactcctggcctcaagcaagcctcccacctcggcctcacaaagttctggccttataagcatgagccactagcctgggcaacagagtgagactgtctctaaagaaacaataaaataaataaagtatggaataataaaattttagtgaaaactgtcttgttagaaataatggctatgaaagtaaattcgcaatggaagaacctataattgggaacatttattatggacaaaatacggattgataaagtcatcattaaaatatttgagtggaaactattcccagtgaaaattgtttcaatgacatgaaagtgaacatggaaaaaatggaaaatgttttaaccctcctgtatggaaaattgatcaatgaattaaattggcttgcttgagtttattgcagaaaacgttttccaaccaaaaatgatgtgttgttagtatagggaccgtacaactggtttaagccaatatggatacattattatgaactaaagtccttacttttttcaaggtttccttagtttttacctaatgtcttttttttggttccaggatcccatccagatacatttagcccccttgcctcctcaggctccttgaggctgtgacattctgttagacttaccttgttgtcgatgacgttggcagttttaaggagtactttgaggtcaagtactttgtagaatgctccccaattgggatttgtctgatatttttgttatgataagactgggataatggggtattggaaggaagaccacagaggtgaagtgctgctcttgtcacacctatcaagggtatatactgtcaatctgacttatcactgttgatgttaaccttgatcacctggctgtgatagtgtttgtctggtttctccactctaaagttactcttttttttctctctctcttttcatcctgtactttaaaaaatcttcacattctcaaggagctccacgttttttccccatcaacttcccttgcatcaaggactttgggagagggttaagagagctggggactgagcccctgtgcttttagagtgtttgtaactgtggcctggtttataatgtttctatagatgtttaattatatttacatctagaataatataatctgaaaatttgaaagggaaattgattatgctgtgtatagatgctttgatgctttaccagctctcaggggaatactaatgacactcctagaaatgcattgtgactatctgttggtatacatgtgcttagaatttttttttgactgagtttttttagaataagagtagcttatttgactactgatgacacagaattctttcagtgccactttgccagccagaaatctccacggctagtggcacctctgcccaggctttgcttgggcccactgggcttactctgcccacttggcccagcagactgcgctcaggctgtgctactggtctggatcctgcgcttgccttggctctgtggtcagcccgcagctggtccaggggtgccgtgaccaacttctaccttggatgctggtgtctggatgagggggatgtggcagtgcccaataacttggagatgccagcaaccacagagccccaaggtgtgttacagcttttgcttggggagtcctgaggcctgagcctccagaaagtgttacactgtcgttcatttctgctgtctgcagcttcagtgaatgggagcgtgtcacaactcattgggtcctgctgcctgcagctcagcaaatgggggcatgttggcacacaatggttttttcactcctatagctcggcgagcatgagcatatgttacagctctttttgcacctgccattcgctcttgtcccatgaccaagaggaatgaggtacgcggacactggagagtgaacaaggcagagaagaattttattgactgacagaaaagctctcgataaagagaggggacccgaagtgggtagccctctgtgtgagagggggcctgaaagtggatagccatctgtaaggctgagtctggggtttttatgggctcagaatggggtgtatgctaattgttccatgggtgggcctggaaaaagcaccattcagttggctaaaaggcatcgaggaagttctcactctggttgtggactccacctggaactggcaactcggtttcaggtttcacttgaaggtctggtttcaccggagacctgtccctgtctaccgaggaatttgtctgtttcctactgctataactgagatgaataccatatttcttaaatattgcttaaaatgaaaactgggatgaattattaaatggctttgtcagataatgcatgatttagaagtacacatttttcttacatagacaagtaaatggaaaagctgtgttttagaggttgaaaatattaagtaccaccattaaagtcaagaaacataaatatggttaactctaattccctctcctgtctttgttcttatagtattttatttatagtagttatactttgtgtttatccttttaatcattctgctttcagctacagttatctgtgtacacttgtatgtgtctctcactagaaaataatgacagtattttgaaggtcaggctggtggcttgttttcatatcccctacacggctacgcctctagtgggtccttcaaaagtgaactgaattaaattgaagtatttggggatatctggcttggagaagaaattgtagtgtgatggctgttttaactgtttgaaagatgccgtggtgtatggctccagggaacagaacctggactgatggtgaaaggttaagtaaggcagaattttattccacataaggaaagctttgtaacaattaaagatatttacagtcattaagggctgctttgtaaggcagcatatagatcacttcctgcattcaaaattgacacatgcagtcagatcccaggatgaaatggtaggttacaatataaaaaataggattttacatgaaaaggtgttgacatttaaaactcatcacaggtttctttaaatatcagtgtgtgtttgtcaattcaaagtatgatttactttgcaaacattcctctcagggtttctcactgacacctctttccacaaagtgaggtacagttgtagtggactggaccttgactgagcagcatatcgtgctggagtcttttatcaccaaaagggctgatgtctgccccagtttccagagcagagtgtctgtaaaaaacctgcatgtgtcatatcagctttccttctcttcagcaagtgaggtggaaaaagtatggggaggccacgaaagcccatagataaatctcctacagaagccctgtcccaagagggctgtgttccagccaacactgataaagtgcagaaaaatgtctccacatctaccttttctttctatatagatatctatctgttgtgcagtatgcttcatactaggaatcaggactctcagaaagattctgggaaaattcctggtggcttatgaaactttgagcagttgattcctgcatggttcagtgccttgcagagttaatgggctagaagtcttgagactccttggctcaccttcctcccaaggctttaaaataagagttgtagtttgaggggcccaacaaataacacctatcttcattgtgtgagttactgtcaagacaaagagtaaagcggagttttaggaatgtgatgtctatctgcaggtaagtggactttataatgacctgtactacagaattaaacagtggccaccccaaacttcaggcacagggaggctactctagggtagagccagaagtatgatccctgtgggtaacttgctcccagcgggaggaagaagaggacatgcctgggctgtgcatgtttctccttctaaatttacccagtagatgagtcactgcatgtccctgtgacaagggcagggtagaaagtagccaggaatgacacactaatgatacgcctcctcacagaaggaatttccgctagagagaaagatgctttctcctgcagaaataagttataaaatctagagagagctcagtcatttagttctacttgccgtacttcaagaggatcttcactgcagttgttttggtatggagtgataggaaaaagtcagggaggttgtacggtaagcaaaattggagaatgactgcccttgttctacaaatagaggtaggaaggactacatcatagtcctgttttctgctttcctttttttgtgtgtgtggcattaacaaaattgagatataatttacataacactaaatatacagtagtttttagtatattcacaatgttttgcagcattaccattaattccagaacatttccatcacccctccttccctttaccagctgcttcccattccccacctcattcccccattccccacttcttcctccatcccctggcatgttaaagtgcctcagggaagtcagggacaaagtctctgatgtccttggcctctccctcaagatttcaagattgctgcttagctccaatcataatattcataccatgattaggagaaaaaagggtaccagtgcaataccccgacatggagaaaccactaactcccagccaagtcagcccctgttgaagagctgtcttgaaagtcccaaccagtgatacggcttacatttcattggccatccccactataaggaagtctgggaaacatcaactggcacattgctgccccaagtaaaatcagagttctgttagaagggaagaatgggagaatggatttggggtatgcaactagctgtgcctgtcacagtcgttcatatattaaatacacttctaaacaattattacatttgatgtttttttcccaagtagtgacacaaaaggacacattacaaaaagattgtgatcttgtgtccataacctctccttcaaaacactggctccgtaaccaaaaacaacctaaatttctattaagttcatattgaatctttttttttttttttgagacagagtttcattcttgttgcccaggctggagtgcaatggcgcgatgtgggctcaccgcaacctccgcctaccaggttcaagtgattatcctgcctcagcctcctgtgtagctgggattataggcatgtgccaccacgcctggctaattttttgtatttttagtagagacggggtttctccatgttggtcaggctggtcttgaactcccgatctcaggtgatccaccctcctcggcctcccaaagtgctgggattacaggtgtgagccaccacgcccagcccatattgaatcttttctatatgatttatttcagccttgtttatttccatctattactgccttaagcaatgggtgacacttttattatccacccagtttgtcaagaagtatgaatttaaccaaaaattgtgcctcaaacttactgttttaagatttaataaatgcatgtgtgtattgttaccattcatagttaaaaatgcttttatttgtttttttatttgtttgaaacagagtcttgctctgtcacccaggctagagtgcagcagtgtgatcacagctcactgcaatctcgacctcacaggctcaattgatcctcccccactctatcctccctaatagctgggactagaggcaagtgctatcatgtgctatctaagacgcatgtgctaactagaggcatgtactgtcatgcccagctacgttttgtattcatattttttgtagagatggggtttcaccatgttgcccaggctggtcttgaactctggactcaagcaattcatctgccttgtcttcccaaagtgctgggattacaggcatgagccaccatgccctgccccaaatgcttttaaatttaaaactttgaaaatttaaaccaaattaacatatgcacatggatttaaaaaaaaaaactcaaaacagtatagaaaagctggtgataaaaagcaacagctaccatatcctgctccagtttccaaccccaaatcctgtatattctataaaacaaccaatttgaccatttatttttaaagtcttgtggtttttatgtcttttgttatgtatatactatgtgtgtttgggccataatcctgaaagatacaattccaaacgccataatcttgcatgttgaaattccaaaacatcaaaatccttaaagtctaaaatcccccaaatcacagttctgaaagatcaaaaatcccaaaaatataatctggaaaaaatcattcaaagagtatttaaaatactaatttttggccaggcacggtggttcatacctgtaatcccagcactttgggaggccgaggcgagcagataaccagaggtcaggagtttgagaccagcctggccaacatggtgaaaccctgtctctactaaaaatacaaaacttagctggagatggtggcaggcgcctgtaatcccagctactcaggaggctgaggcaggagaattgcttgaacctgggaggtggaggttgcagtgagccgagatcgtgccattgcactccagcctggggaacaagaacgagactatgtctcaaaaaacaaaaacaaaactagtttttaaacatattaaaaaggggattcaggctgggcacagtggctcacgcctgtaatcccagcactttggggggccgaggtgggcaatcacttgaggtcaggcattcaagaccagcctgaccaacatggagaaacctggtttctactaaaaatacaaaaattagctgggcatggtggtgcacgcctataatcccagctactcgggaggttgaggcggaagaattgcttgaacctgggagaaggaggttgcagtgagcggagattgcaccactgcactccagcctgggcgacagagagagactccgactcaaaaaaaataaataaataaaaataaaaaggagatttatttgagaaacatttaaaaacacaacggaaacttcataggccagtttgcagaagaagataggtaataataacgtatgtatttttgtgactgtacacactgaggtgtactgatgacagtcacataggtgtaacagttacgagaagatgaactatattcataaggaagtaggtctaaaagcaaaatatataaatgcatatcactatagttggtaattctgtgcaaccagttttgtaactggtcatctgacataccttgatggacaacctaagtcttttgatgagattgatcaaaaattgtgacggatcaccactgtatatgcagtcactcaaaaagccaggatgtcaagaaattttatctttcacaaatgtacgtatacaaaaaggacatctcttcattcattaaggaagtttcaacattttttacatacatacacaatactaagtcagcgttgtggtgacacactcatagagtcaaatttgcaaaaaaaaaaaaaaaaaaagcataaaacaaattagaactctaaaactctttacaaagtttatgcttctggccgggtgcagtggctcacgcctgtaatcccagaactttgggaggcctaggcgggcggatcacctgaggtcaggagtttgagaccagcctgcccaacatggtaaaaccctgtctctactaaaaaatgcaaaaaattagccaggtgtggtggtgtgcatgtgcctgtaatcccagctacccgggagggtgaggcaggagaataagttggacccgggaggtggaggttgcagtgagccgagattgtgcaactgcactccagcctgggtgacaagagcgaaactccgtctcaaaaaaaaaaaaaaaattgacatgcaaaaaagtatattacagtgaaagattataggcagttgcatggaggtagtccataagaattggccaacttttcacaatcattatctatattttgaagtcttccttcatgatgaatagctgctttttttttttttttttggacatggctctttttggaaaatacatttacatccgtattctacatggcactgctctttttgaaattcttctatgatttgatatacactgacataatcatcccctattaaggttttccatcttcagtgctatgcttctatgttttgcatacatggaaattcattctgcatgcactcatatacagactacaaatttagtgcagactatacttgtgatcaaacaacaacaccgttatatgtcttgtaatcctaccatgcacataattatttttaaaccagtcagtaactttgctggtttcttcaggcaaatgcagattcaatccattaaaagctgggctgggcgcagtgactcacacctgtaatcccagcactttgggaggccaaagtgggtggatcatgaggtcaggagattgagaccatcctggctaacatagtgaaaccccatctctactaaaaacacaaaaattacaaaaatacaaaaaattagcccggtgtggtggcatgcacctgtagtcccagttactctagaggctgaggccggagaatcgcttgaacctgggaggcggaggttgcaatgagccgagatcacaccatgccactccactgcagcctgggcaacagagcgagactgtctcaaaaaaaaaaaaaaaaaaaaagcttctggaatttcatcacctggaaggaaagccaatgcagacaaatgacacatttttaaattgaagttttcatcattgccatatctcatggccaatcgactcatctaagttttccactaaatgcatcagactgaatggaaaaaataaactttgttagtgacatcttgaaattcactttcagaagctttgttgcacctaatctgtcattatgatttggggattcagttgaatccattttcttttgcaacatccaccaaatcttcaaataagtgttttataaagtgcttcccttttgtccagtcattcatacataaatgagtggataagttctagaattttgagatccaacagggggatgaatcatatgcaattggcaaaaaatggtggggatggttttgaaagtgccacacattagccaaactgaagcatgcactggtttttctttgttagattgggtggtttaataaatagaagtctatcttctttgatggacagatccctgatcaagaatagttcatcatttaacgtgttttgtatcactggaggaacctctgtatcagcaagtgcctttcattcagaagttcactgagcttttcaaattccattttttttttggctggaggtagtggctcatgcttgtaatcccagtgctttgggaggctgaggcagttggattgagtgaagccagaagtttgagactagcctgagcagcatagtcagactccatctctacaaaaattttaaaactatccagacgtggtggtgtgcacctgtagttctagctacttggaatgttgaggtgagagaattggttaaggccaagagtttgagaccatagtgagctatgatcacaccactgcactccagcctgggcaacagagtgagaccccatctctttaaaaaaattccttttattctccgatgaaggttattttttttccttttccccccttttttaaaaaaaattcagttggcacaaaggaaggattttttttttagggcaagcgtggtactatgtgtgaagatgcggaagtcatacacaattgaataatttggcaggggagatttcttgtatcttttgcctgcattttcacttctctgaaacactcaaaacactgagggcagatcttacccacttggtctactcagactcacagtaatctctggaaacacccttacagacacacccaaaataatgctttatcaggtttctaggtattccttaatccggtcaaattgacacctaaaattaagtccacaaatccagccctggtcaatttggcacccatatgtgtctccttaaaccataattcacttccaaataaagacaataacaaggtaatagttctgtttaacatgatgcagctaacatgatgcaaatattatgcacacaaccaaacaggtactaatcgtatccccagaattaggctttctagattttatcattcagaattttaatctttcaggattgtgattttcaggattttaatcattagggattttagactttagagatttttaattaaaatttttatttttctttcagaaatgaagtcttgctttgttgcccaggctgatctcgaactcctgggctcaatcaatcctcctgcctcagcctcccaaaatgctgggcttacaggtgtaagtcaccacacctggctgactttagggattttgatctttcaggatttcaacatttaggattatagcattcaagattatgattggcactaatactatgtatatgcctaatgttatgtatatgcataatgtcaatttaggcattattagtaacttcttgctatctattatagtatatatactatctattatatataatagatatgtactatggagatatatgtgagcattaagcatgtatgtctacatatatatgtgtattatatattcagtcattatatattatcactgtgtaaagttctactagaatcaacatagaattcttgagattctttccagaactttgaatgcagtaaattgagcatcatcactttgaaagtaaacttaaagtctaataaatatgattatatgtatattcacaatatacattaacaataaatataatatataatcaatatgttaatattattaatgatattatattataaatgtataatacatatataataaagatatataaaaatttatatgataaattattataggatagttaaatatttcacataaatatttatcagctggtttttaaaaattcatttattcaacaaccatgtgccaagctctggtctaggtgttggggacacagtggtaagtaaacaagacagaaaaattcctgttcttatggaactgacaatctactataaagataggaaatcaaaaagtaaacaatgtatgtgcaagaaacatggggtgcattgctgttttagataaatttgttggggaatatttctttaaggaggtgacatttgtatggagggataaataatgggaaggagccagtaatgagaatatcagggggaagaggattcaggcagaaggaatagtcagtacaaaggctagggggcttggcatctttaaggggccaaaggaggcatatctggctggaatggggtgagtaaagaggagagaagtaggatatgaggtagaggaattagggggctgtggcaaccagaatacatttcatttccagtgtagtgggagcccctgtgggcttttaagctggggaaggaaatgctttgatttttagttaagaaaaggaaaccatgttgggtgctttatggagaatacactgtaaggggggcagaattggaagcagggaggctagttaaggaggttcttgtagtagatgagttgaaagattatggtaactttaagtatataaacattatcacccattcttctagacacagttggaacagaattaaactatttttcagtaaatcttcagtaacgactggggcctagaaataatttagaaaatgagtacaatgcatgggtttgaatatttaactatgcgtggtatccagatatgccctgatctcaaacctcgggcctttgagcatgctctcctatctgtaatgttctactctcatcatactaatttttgctcatcattgaagtctcagctctaagacctgtttttcaacaagccagccctaaaatcacccaagagtgattgtctgtcatgtagctgtcttatgaactctaatttatatctaggcttatggattttacagctccaaattgtccattattttaattgccatatttaattgccagtttacttgtccatctttcccactagattgtaaactcttagatgcagggactgtgtcttactcatctcattctttgcacttaaaattagacaattgaaaaatgtttgttaagtcaataatcaatgtttaactgtgtgcctattagatttacctgagttacctcattcttagattatgttagtgtgaataaaatattacatcaatagattggagcaggtaatttccttaacactgcaacacatagtggaatatctgtgtttgattccactttaaaaattttctcaaaccccatcaccataggctaatggtctttgtcatcatcaatgaatagatggtggaagggctgctcgagattcgtaaatgttgaaaggacgttgctcttcactgaggggcatgttgtcagtttccctctttgggcagctccagtatttctactagtaagtggtacagatggagggagaaatctacgtgacaggctgcctaggctgtgccaatgtcaggtccctttagggtgcaggaggggagagttgcctttttatcatgcatggttttttccatgtaattcgtctgacttgtgaaaaaaaggtgaggcaacaatgacatgcaaatacatgagttattaccaacaccaacttgaacagtgtgatggagcgtgcatcagatctgtggtaccctacgagattttaattttctccttttgatgcaattcttacctgaaatataaactcttttcaaatctctcccagacctttctttaagggggagtcagccattgcttctaaactttagtgggcataagaattgcctggaaagcatgtgaaaacagattactgggctccacctgtagcatttctgttccttggaggaggggcccaagaattttattttctgaaaaaaactctcaggtgctgctgtttcatggactactctttaaataggaaagagatggactacgtgtttctaatttctgtttactgccattgcaagtgctttctcttttcataacgctaatattctggcctgttagcggttgaggaactcagaggggaatatacacaatacaacctagaccaaaactttcagtctacttacttggtcagtgtcttactgtgttctgggatccccttacccttatgataaaaagacgcacacttttgcctgcacagtgcagcttgtcttctctcctgttttatctctctcctacctggtctggttgacctgaagtttctggaattttctgctaattccttttatatctaccagctaatgtcttcccctccatctatataacagattgcctttctgattctctttcagatcaatatgtcccactcatcattcctccacattgaacatctatctcttgaaatatttttatagccctataaaaactccatttgtgatactatcctgtcttcattgctttgctgcttttttttccttcatacttgttgggtaccacagtatactaccatcaggaaactataaatctgcttacaaaactgcataaaatatctaagctactgatgctttcttctgtatcctcttaaccaggcttaactgctgtatgtagaatcaataccttttggactctttggagattgatccatccgctgtgacttcccagtgtattttttcccaatgtattatttttcaattgagatagaatataaattcagcaacattcaccttttatagtgtacaattgaatgattttttttttttttttttgagactgagtctcgctctgttgcccaggctggagtgcaatggcatgatcttggctcaccgaaacctccgcctcccaggctcaagtgattctcctgcctcagcctcccaagtagctaggattacaggcacccaccattatgcccagctaatttttgtatttttcttgagatgggatttcaccatattggtcaggctggtcttgaactcctgacctcaggtgatccacccgccttggcctcccaaagtgctgggattacaggtgtgagccaccacacccggcccaatgaatttttaacaaatgcatacagtcatgtaatcctcaccacaactgagatatagaacagtcccatcaccccgaagttcttcaccccccattgtagcactctcccctctactcctggcccttggcaactgacaatcagttttctgtccttatagtttgccttttccagaaagtggagttacacagtatgtgtgagtctggcctctcttacttagcataatgcatttgtgattcatacgtgttgttgcttgtatccctggttcattcctttttattgctgcagctgcatgctattccgttgtgtggatctaccacagttgtttatctattcccaatgttttttaattgctatatcctctcctctaaatttaagcactttttttttctgtcatttggcttttgagtacgaaaaagtaaatttccaaatttaccatgtgttctaggtagaaataaaaactaagttgcaataggtactaataagctctgaatttctgcacctgatacattcctgatgtttctttacttaggcctattttaaccaactctcaagtaggagcccagatgtggggcatatctataccaaagaagcctgttctaattcatccttttggatcaagagttttccaagttgcaatttgaaggactgacttgagatctgttatttagggtcattgctgcaattcccaggagagatgtaagaaggccttccctttcactaaaggggtcccataccataaatacatatccctgataatttggaaccagcctgtctcttgtgtcacccccactctagggcccagttctctatgtatcaatatttggttctagaccacccaaggtatgaagtcccatagtattcttgacctctgtctgagatgagactcctatagttttgcaggctgggtaagcaaagtataggataccatcatagttggccaatatagaacagcttatcatggtctagatagggaaaacataaccaagaccaatgatacttcccagcctacatggttcaaagtattaacataatgtaatctacactatagagattctaagaatcatttccatttcagttagtttccattagtacttaggcttcagagctagggacagtggctcatgcctggagtcctagctactcaggaggcgaggcaggaagatcccttgagcccaggagtttgagggggcagtgagctacgattgcatcactgtattccagcctgggtgcagagcaagaccctgtctctaaaataaataaataagtaagtaaataaataaataaataaataaagaactgaggcttcagaagccaagttatggtcaagcatatcatttcataagtttcattggttctataactagaaataaaatacacaaatgttttattacatttaaatttgtatttagtccttacattttaagaagatatcttaaaagttgaggacagctaaattttatgccaagtatactcaactgtacctgtaataactattttgttttatttagcatttaaaaatagaataaatatgtgcttcagcattttatttatttggattcagcagaatattactatttttctccaaaaagtcttccttttctcttttcattttaaaagaaactaattttcaaaaacactttctaaatatattcagagtaaacattttatttatttcatttacttaccacttaataaatacaggggttcccccttgttcttgggtcgggatgcagtccaggaaccccagtgtatgcctgaaactgtggatagtgtagaaccctcgatatgctaagcatttatcatacactgtggccataacttttacaatttgaggtataacagcaaaactaacacaaatttcttcttccttcttcacagtttcatggacagaagattgtttttactttagatcttagcagcgtcagcatacaatgtttttctttccttatcaagtcgagaactttcaccttttcacttagaggaagcactttatggtttctctttggcgcatttgccagcatcactactctcgtgcttcggggttcatcattaagtaaaataagggttactcgaacacaagcactgcagtaccaccaagtcagtcgatctgataaccaagagagtgtctacagtgtggatctgctggacaaagggataattcatgggtgggacagcatgagatttcactatgctactcagaaaggcattcaatttaaaacttatgaattgtttatttctggaattttaaatttaatattgtaggaccacagttgatggaggattaagtgaaactgcagaaggtgaaaccaaggataaatggggaccacctagataaaagttaagtcaggaaacatataaccttttaaaggaggacaagctgacaattctttttatctttcttttatacaggtgtttgcttcagaatggtaagtcagtacaatctttattattttgctattttttttccactgttattcccaattacagagatagggcagttttctacttggcgctagtctactgtttactccctgtccttgacagcaaatgaagaaatatatgtatttctttgaaattactgattgagatttttattaatgctaaaaacattgtacccttcttagtatttacttaacattttctatattcaaaagtacctctctttgggtgattttaatgaaacgctttgattaggtgtattgaatacaaagtatgggactttctacatgttctggatggaagaaatcctctaggcaacggtacatatgttgcactgcaaaacaaaacacgctaatgttgcataatgaagtggttcccaggatttagcagattaagcgccacgtcgtgttttaaaatttatttatttagtttggagacggagtcttattctgttgcccagtctggagtacagtggtgcgatctcagctcactgcagcctccgccttccaggctcaagtgattctcctgcctcaccctcccaagtagctgggattacacaggtgcctgctacgacatccagctacttttttatttttagtagagatggcatttcaccatgttggccaggctggtcttgaacttctagccttaagtgatccagccacctcagcctcccagagtgctggaattacaggtgtgagccaccatgcccagccaagctaattttttttaacttttagtagagacagggtttcaccatattgcctgggctggtcttgaactcctgacctcaagttatccacctgccttggcctcccaaaatgcccatgcctggctccatgttgcttttaaatttttaatttttttaaagtactcctttcctacaacttaattgtggcatgcattttcacctactatctgaggtgggtcactagattaggtccctggttcccaactcctgagggttccaatattttcccactggtaaaatctctattatgaggcagccccatcccccaaaattcagattgtctccattttcgttattatctaataagaaagtgacttattttcagggccacgtcttacatcagtcttagctgttaccattttgatttgtgttgtttcatacagctggggatgtggagtgtagagatcttgatcaccctggcctccatacaggagaagagtatgtttttgaaaagttctaaggccggatgcagtggctcgcgcctgtaatcccagcactttgggaggctgaggcaggtggatcacctgaggtcaggagttcaagaccagcctggccatcatagtgaaaccccatctctactaaaaatacaaaaattagctgggcatggtggcagatgcctgtaatccgagctacttgggaggctgaggcaggagaatcgcttgaacttgggaggcagaggttgcagtgagccgagatggcgccactgcactccagcctggacgacaagagtgaaattccatctcagaagaaaaaaaaagagttctagtagactggatcaatagaaattttagtatgatgtagttaaaataattcaaaatcaaaatgttgctacttacatagcataactgaatttggagctagaaaaaggcaattttaaaagactattaataataataggagagataaatctacccatagacaattataacatttctgtgccaagtccagagccaacagaaaacatcagaatcttttagtcttataaaaactctgcaaaccagcatgtttatgttagtgttcttgctagtttaattttctttcttttttaaaaaaaaattattttaggttcagcggtactcatataggtttgttatataggtaaactcgtgtcatgggggtttattatacagagtatttcatgacccaggtacaaagcctagtacccaaaagttatttttttctactcctctccctcctcccactctccaccctcaggtaggccccagtgtctgttgttcccctctctgtgtccatgtattctcataatttagctcccacttctacgtgagaacatgcaatatttggtttctattcctgtgttagtttgctaaggataatggcctccagctccattcatgttccttcaaaggacatgatctcattcttttttatggctgcatggtattccatggtgtatatgtaccacattttctttatccagtctaccattgatgggcatttaggttgattccatgtcttggctattgtgaatactgctgtagtgaacatatgtgtgtatgtgtgtttatgatgaaacaatttatattcttttgggtatatacccaataatggaattgccgggtcacattgtagttctgtttttagctctttgaggaattgccacagtgctttccacagtggctggaccagtttgcactcccaccaacagtttgtaagcattcccttttctctgcaacctggccagcatctgttattttttggctttttaataatcgccattctgactggtgtgagaaggtatctcattgtggttttcatttgcatttctctaatgattggtgatattgagcattttttcatatgcttcttggccacacatatgtctacttttgagaagtgtccatgtccttgcctactttttaatggggttgtttataattttcttattaaaatgattttccctcatttttgctggaaatttcgaagtgttgtagtctctatttctgcttatcaatactctatgttgatcataattgtatatgttttttctcagtgattgagaatcttggattgattatgatttggaacccaggttaacaatgtaatttagtgttagcagtcttaagggcaatgcagctaaattttatgtatccaaaaacacatcataggaactgtttctgaaataattctcactctcagcgtagtttttcataatgtttttatgatagtggaattgtttttactgaaagtgaaatttaacaaaagataccatttatgtgaaggttcttataagtagaggttactgtaggtcatctatacaattgttggcattgactacaaaaaatgattattaggttagcattttttggatattagaatcaagtatgttatgaactcagacttttgatgctgcactttattcttcttgttttttcctgaaacagtatacagaagatgaagctaggaaaataggagtggttggctgggtgaagaataccagcaaaggcaccgtgacaggccaagtgcaggggccagaagacaaagtcaattccatgtgagtagtaaaattaataacatgtacatgaaatttatgaggctgctgttttttagttttttaagacatggtcttgctctgttgcccaggttggagtgcagtggcacaatctcggctcactacaacctctgccttccaggctcagatctccccgactcagcctcccaagtagctgggactacaggtgtgagccaccgtgcctggccttataaggctactttaatgtttcattggacagtaagaatagtattgatggaccagattttgtttgtagattacaatcaaactaatatgtttgtaggcaggcctgtgaagaaattctcagagttgggagtagcatttctatgtttaggaatggacttcccacttgggctggcctcgagaagaattgtggcttccctctccaatttgtatgtcctgtggcatctcctccagcgttagggagatgtccagggcccaagtaattctcatttgaagtgttgtgacagatgcgtagtgccttaggatggttcgtgaagttcttagggtagcgttccaggcaaaaagattgccatctcctttttacagttaagtgctttatttatctaattgtaattttatttttcctgccaatgagagtgtgtttaatgagctggagggttaccaaactatgaatccttgaagtccaagagaggccagattcagtaatatggggaaaaatgtcctgtgtacacaatgacgttttcaaaagccttgtgttttcagcttcataatttccactgctctttgtagtcttttttcttttaaattaaaaaatagctaacatttattgagcatttacatgttgggcaatatgctaagtaccttgtatgaattatctcaatcttcacaacagatcttatgaggtaggtactaagtaacactcaatttattttattgtttgcaatttatctttgttttcattacttaatatttttagatttccaaagcaataggttttgcttattgtaataagtgaagtaacgtaacactgagaagtataaaggtaaaacttgtaatgtgtacttttctgtctatttccctcccctttattaacctctgacaaggaatactttctacagctttctctttcacttaaaaatagttaagtatgcatttgtaattaaggttttgctgatttttaccgaaatagaataccttgtgcatatttttccataatttgtatttttattttctggacatttcagtaaacagtaaatatataattatcaactccttatttttctaattttaaatgtttacgtgcatacttgtgtttgtgtgtaaaactacacctcaaattgaaaagtggggtccaaaagttcagtttcacaaactgtggggtgacagttaatgaaaaacaatatttttaagtagaattgtcacaaaatgtacaagaaattttgggactttcgttgtacagaactgatagttcaatggaagagaaaatgccaaatgattgtgtggaagttttaaagtagagattatgtcccatgattcgagggagcctagaaaaaaataataatatagtttttaaaaacggggagtatgtggaagatagaagctcataccaatcatgtcatattcctaatccacattatagagggtcattgattaatttgcttaacataaatgaaatcgtatcatacactgtgctcatgttttcttttcaacccctgcattctccacccttcttaagtaacctgtgttagcaagctagtgtgtattcttctgcttgtctccatgttcacattctctctctcacacacacacacacacacacttgcacacacacacttttatggattttgttcaatatttgctttttaaaaatgggatcacggtgtattcccttctctgcatcttactttatcactcaaagatacatccaggaaaatcctttcaagtcgaatggtaatctctaattcattctttttattggctacttaatattccacaatatatagatttattattaccttattgctggaaatgcatttttttctgtcttgttttttgcaataagagcaatgctgcaataaaattttattggtgattttattttgattgcataggttcccaggagtgtgatttgttggttgaagtggctatgtatttttaatgtaaaaatatttgtcagactgctttacaaaacagctgtaaacaatttacattgttttcctcctcatcctgtcagcaattggtattgtactctctaatttttcttttacctgattggttgtgagtgattattattttttgctgtaatttgcatttctctaatgactagtaagttggagcatctttatgcttatgtctgtgaatttgttctcatgaactcccttttcacatcctttacccatttttctatcgagttgcttgtctcttgccaatttttaaaagctctttgtatattggttatggttactaacccattatctgttattgcttttgcaggtattttcccaaatctataatttgcctattggtttcgtctatgatagctttgcaacataaattgtttttcatttttattaactcaaatatggctatttttttctctctggttaagaaacagattgtaagtgttgtcgcccaggttttcttctaacttgatgctctatttattacatttaagcatttactccatctggaatttgttttttatttaaaagatgagatattggaccaactattttctaccagatgaatagccagttgtcctggcgccacttactaaataatcactctttcccccattgcattgaaatacatttttgtcatacgttaaaatctcatatagactggattttatttctgaattctctattctgttccactgatctatttctctgttcctacatcagtataccatattgatttaattatactatctccacagtatatttcctctcactgttctttttgattcttttatttgctttcttgggcatttgtttcctctcttaactttaagatacttttacctatttaactggaattctattctgtttattaaaaagaaaacttacatgattgtgtcacacatatgcttttaagataaactttatgtatttatttattttttgagacaagggtcttgctctctctcctaggctggagtgcagtggtctgatctagactcactgcagccttgaccttctgggctcaagtgatcttcccacgtcaacctcctgagtgcacatgctggctaatttgtgtgtgtgtgtgtgtgtgtgtgtgtgtatattttgttgttgttgttgttgttgttgttgttgttgctttgtagagatagtgtctcactatgttgctcaggctggtataggactcttggcttcaaatgactttcctgcctcagcctcccaaagtgctgggattacaaaaataaactttatttttgagaacagttttatatttacagaaaaattgtgaagatagtacagagactttccatatactccccacacagttttcctcctattaacattttacattaatatgatacgtatgttaacaattaatggaccaatatggatacattagtattaactaaaatccctatttatttagatttcaatttttacctaatgtccattttatgtcttaggatcccattattgtatttgctttttaattgggcattctcttgaaattaagagaagtgacattttggctgggtgcagtggctcatgcctgtaatcccagcacttcgggaggctgaggcgggcggatcacttgaggtcaggagttcaagaccagcctgtccaacacagcgagatcgtgtctctacaaaaaatacaaaaactagctggggttggtggcacacgcctgttgtcccagctacttgggaggctgaggcaagagaatcgcttgagtctgggaggcagaggttgcaatgagatgagattgcaccaccgcactccagtctgggcaatgggagtagcctgtcccaaaaaaaataaaataaaataaaaataaagacagaagtgacatttttatgatattaaatcttcccatttaagaacacacagatgttgttccatttgcttagattttaaaatttatccttcagtatgattttatggttttctttatataggtttttgtacttttcttgctaagttatttctaagtatcttaatgactttttcactattgcatatggatttctttcccatttatgcttctagttgttcatgcttaaatatggaatatctaatgacttttgtgtattaattagatatcatagtattaccttatcagatattcttattaattctatcagttttttaaaaaactatagtctattgggtttttaaaaaatacagttatgcaattagtaaaaatggtgtatctttgtttcagtgacttcatttgtcagacctgccatgacaatgttgaataataatagccatagcaggcatgcctgtttggtttctgactttatttaaaatagttttattgtttcacctagtaaaaagatgtttgctgttggttttaggtaaatatactttatcacaataaattttacttttgcattccttgaattagcctttgattggttacagtgtgttattcttttaaattattgctgaattgccaagtattgcttgccaatattttatttagaacttttgtatatatataagtcacgtaaggtttttgttttgttttgttttgttttggtggagtctcgctttgttgcccacgctggagtgcaatggtacgatcttggcttacttcaacctctgcctcctgggttcaagcaattcttctgcctcagcctcccgagtagctgggattacaggcatatgccaccactcccagctaatttttgtatttttagtagagacagggtttcaccatattcgccaggctggcctcgaactcctgacctcatgatctgcctgtctcggcctcccaaaatgctgggattacaggcatgagccaccatacccagccggttttttttttttttttttttttttggggggggggtattctatcatgttttgattttaaagttttattggcttcacaaaacatattaggaagttttccatccttctcttcattctggaataactaaaatatcagaattactgttcttaggttagtggaaacaaattaggaaatcacctggtcctgctgccttctcaatgttgacctttaaccaccttttcaatctaccctgtggtaactggtatgtttgttttttgagaaaacgttttgctctgtcacccaagctggagtgcaatggcacaatcacagctcactgcagccttgacctgctgggtttaagtgatgcttccatctcagccacccaagtagctaggaatacaggtatgcaccaccatgtccaactaatttttaaaaatttttttgtggaggtgaggtctcattacgttgcccaggctggtgttgaacttctgagctcaaacgatcctcctgcctcggcctcccaaagtgctaggattacaggtgtgagccactgcacccagcaagtaactgatatagttgagttttccagatgttcttggattcctttttattttgctaggaaattatccaatttttctaggttttcaaatttgttgcgataaattttataatttaaaaaatctcggccggtgcggtggctcacgcctgtaaccccagcactctgggaggctgaggtgggcagattatgaggtcaggagtttgagaccagcctggccaacatggtgaaaccccgtctctactaaaaatacaaaaattagccaggcgtggtggtacacacctgtaatcccagctacttgggaggctgaagcaggagaatcgcttgaacccaggagccagaggttgcagtgagccaagatcatgccactgcactctagcctgggctccagagcaagactctgtctcaaaaaaaaaaaaaaaaaatctcttttgcatctgtgcttatatgccctttgaaaattcctaatcttgtagaacttcattttctcctcctttttccttaatcaagctctgacagaatttatctacttaattggtatatttttaaaaaacagcttttagatttattgattataatttttgggagggttacatttcattaatttcaacttccatctttattaatttcctcttctttctttgtttgttgctcctctaagtcttcaacatgagtcctagttgccgttgtttttagttttttaaagttaataatgaaggtgattaggcattttctcctgaatacagtttttttcttttccattggttttggtagtaattgttccttccttgctttctggatagtttgtaatttcattttttatttcttctttgaactaatactgtaactaatgggattctgagtttgtgtttgtaaaattcccagttaaaacttttaaagtaattgtttattatttatttctatttttatttgattataatctgagaacgaggcctagaagatttctacttaaaaaattttgttaaatccttgtgataaatgacatgatatattttggattgatcagctaggatctatgattaaattaggatgctttaggctgcaagtaacaggatacctgattaaagtgcttgaatgaaggaactgatttttcccactttccaaacaggctggggcaagcagtcctaggattagttcagtgtgcgaaagattattaaaatgtacattttggtgttgctatacttttctctttttatatttttttatgatgggattttcaaacacatacatgaatagagaaaaaaggacagtgaagctcatgtgcccattacccactttcaataacagtatgctttcagacattcttgtttcatatattcctccaactttttttttgtcattgttagagtatttaaagcaaatttccggcattatattattcacctgtaaatttggtcaaatgatattaaactatcaatacttgacaatattttaatctataaaacaacaatttcatgttgttcaatctaatgtttgactatatacagaaaacagaaactctatatatccatcaatatgtattccaaatcccacacagatctatgtgcaaatgtcaaagtgcatcacacaacctgtctgtcatgctttttcctggaggcctgtcttccagtctgggtctgggtttgctacacaactgtcactctggtgttgctcttcgctgctttcctgtagagcaggctcctgtgtccttaatcatatgttttaatcattcttgatttattctcttattttgcagaaacataattctctataagcttccgaaggaaaggtgcatgagaggcaaaaagtttgcatctctgcatgccttcatttacccttgtgcttgactgattgacttacaaaattctatgccaaaaataatctcacactaagaattttgaaggcatagttccataacttacagtgttgctgttgagaggtttgatgtcattcgaatacaaaggattgggagttatacctgtttattccctcagaaagtttgtcagatattccacttatctctcttctccattttcacaaccatctgcctttgtgcatgttttaattttgctgtaaatgcacttggaggagaatgttttttctttgacaatttccttccctatctcttttggaccctcttcttttagaacttctgtatggacctgatcctctatttttttttttttttattacagactggattttaccctgttggccagtctggtcttgaacccctggcctcaagtgatccgcctgccatggcctcccaaagtgctgggattacaggtgtgagccaccatgcccggcccctgattttaaacttttctcacctagtttccatttgttattatgtgggaaattagctcaactttgtcttccaacctttctattatttttgtttgtttctgctgctctatcttaattgtttctctttcatagcatctcattcttgttgttgttttccccaaatctctctgaggatattatgtgtatctttcttttcaaagtattcttctgatttttgcattgtctctttttttttttttgagacagagtcttgctctgttgcccaggctagagtgcagtggcatgatctcgcctcactgcaacctccacctcccaggttcaagcagttctcctgcctcagcctcctgagtagcagggattacaggcatccaccaccacacccagctaatttttgtatttttagtagagatggaggtttcaccatgttggccaggctggtctcaaactcctgacctcaggtgatctgccagcctcagcctcccaaagtgctgggattataggtgtgagccaccgtgcctggctgctttttgcattgtttctatttcttctaagttacttttcttttctttctcttcttctttccatttttctcctgtttgcttgttttgcttatcttttatattgccggctttccttacaatcatattttcagtaacttagtcatacataaatcaaaacagccaacaataagcaggacttaaggaaattttccaatatgtagacttatgggcttgaggaatggtggtgactgggtggggaactggcatttttgttagtgaatctccaaatgtcagatctatgcgttctgtcttctgcagtggtgtctccaaatcctgagtcttctgtgaggtccatgggggtaagctgacttgcttctcattatttctgtaggcacttagtctgtaacatcctttggtttactgtatagttactccttctccacttgctttccttctttctttttgtttttaggcaggatcttgctctgttgcccaggctggagtgcggtggctcagtcatagctcactgcagccttgatctcctgggctcaagtgatcctcttacctcagcctcccgagtagctaggactgcaggtgtgcaccaccatacctagctaattttttaattttttgtagagacagggtcctactatgttgtctatgctggtcttcaactcctggcctcaagtgatccttctgcctcggcttcccaaagtgttgggattacaggcgtgagttaccacacctggcccctctgttttcctactaattatttgttgaaacctcttgtttaggttatagttttgtaccagctaggaatattttcagctataagttaacagaaaactggacttaaaaatggatataaaaaaagggttcatttttctcagtaataagaagtttggaggcagatggttactggccttagttcagtagctcaataatgtctggaccaatgtctctgtggttgtcttggccttttcctcatggtcaaaaaaggaaaagtgcagctgcacatgatatccacagttaaggcaggaacgagtaaaggattgtgttgcttttcctgacccaccccaaacagatatctacttgtgttccattggctcaaatagggtcatatggttactccttgctacaagggagactgagaaattggcttggttttttgatgccctgaaaaaaaaattctcttggccaggaagaaggggatggggatgggtgtatactaggtagtcaatgaacaatctgttacatctttcatattttgatgctatcattttaatggggcttcaggtgaaagaagatagacatgccatgtgtaattgcatggtgaaaattaagcgagaaaatccatatgaagcacttagtgcagtgcctggcatgtagtaataatcaataaatatttgctactatgttatgacccatatgctccactttgtacatgttgtctcgtggcagttggaatgatcaggtggagatgccactaggctcctagataaatgggtcatccctgcagagaaattgggctagagaaattaatttggttgtcatcagtatgtggatagtgtttgaagccacatacatggatgggattatccagggagaagttgtgtaatgacaagcaagcaggaagaagacactggagaatgtaaattaagcttaaccaacattataagttgtgatgttacatgtttaggttttaaaaaatgaatttattcctctagtgcaatatattaaggtactgaattatcaagaaattgaatcacaataagagatgttgcaaaaatagttgcaaagtcagactcagtgtggcacatttgtagctatatattaggttggtgcaagagtaatggcaaaaaccgcaattacttttgcaccaacctaatagtgccagtccaggaacggtggctcacacctgtaatcccaacactttgaggggtgaggtgggtggattgcttgagctcaagaattcgtgaccagcctgggcaacatgatgaaaccccatcagtacaaaaaacacaaaaattagctgggcatgggccttactttcttatagctatttttaaaaagagaaaaattttttaaaatgcaatgacagtaagttgcagaaatctgaattaaattgcctttaaaaaaaccacatttgtttcttcccaggccatgaaaatgtggaatacaacagggaccatcatttagagatggcctggctgtgattatagcagccctgctctgtctttactaacaagccagcagcatgtaagaacacactgtggatgtgtgtgttttcttcttctgtgttttattttctcaaaaagaatgactgatgactttcttttgcaaattgtactatattattccaattgcagtggtaagttctgccaacattttttgatgcataaggactgttttgaatctattgttttattatgtctttttttttgcaaaattaagaatattttctgtttcttagtaatcatgttaaattaatgtacagtgttatgacactgagcataagcctttgaataagtcctcagaaaatatattttccataaagactcaatggtagttttgtaaaataaaacacttgtatttggagatagccaaattctaaaattaaaattacatcttgattgctacatattttttaaaccgtatgttatgtatcagtcctctgcacttcaaaggattattaaaggactggtatatgtatataagaggatgatgaaatggttacatggcctggaaaactatgtcataatacaaggaatgcttgaaggcattggggaatttagctggagaaaaaatacttgaaatcatgatagcttccttcaagtatttgaagggctgatacataggaaagggtaaatgttctctctttttccagaaggcaataatcttgattggagccatgggtgaatttgctgaatttgcttatttcagctgaccctgacaacaagttttcctgtaaagtcattaaatgtatataatggtggaattttatcaatacctaggagtagtctagatcagggattggcaacccacggcctgttttgcaagtttagtaaatgaagttttattggagcacagccacacccatttatttatgttttggctatgactgcttttgtggtacatgggcagagtggagttgttacaacaaagactggatggcctcaaagcctgaactatttaccatctggccttctacagaaaagggtttgctgctcactgtataacagctgtcagacaagccgagggtgttgtaggtctaactcatcaaatggtatgttagactagatgtcctctgaggtcctgtccagctaagattctgtgtttcttttttgtttgtttgtttgttttttaagacagagtttcgccttgtggcccaggctggagtgcagtgccctgatactcggctcattgtagtctctgcctcctgggttcaagcagttctcctgcctcagcctcctgagtagctgagattacaggcgtgggccaccatacgcagctaatttttgtatttttagtagagatggggtttcaccatgttgtccacgctggtctccaattcctgacctggggtgatcggcccatctcggcctcccaaagtgctgggattgcgggtgtgagccacggcgcttggctagattctgcgtttctttcttttttttttttttttttgtgagacggagtcttgctctgtcgcccaggctagagggcagtggtgcaatcttggctgactgcaagctccgcctcccgggttcataccattctcctgcctcagcctcccgagtagctgggactacaggcgcccactaccacgcccggctaattttttgtatttttagtagagacggggtttcactgttttagccaggatggtctcgatctcctgacctcgtgatccgcccacctcggcctcccaaagtgctgggattacaggggtgagccaccgcgcccggcagattctgtgtttctatacagagctgatgattgcgcatgtacttaaaatgtgttcatagttcaagagttagaattagaatagagatactcactaatagagttgtgtttacctcttccatagatattaatacttgacatttgtgtgaaatatgaaatttgaacacctttctgccttaactatgaattgacatttttttgagtttccagttgtgacaatggtaaattgaaatgcaacaatggattttgtgaacaattaggtggtgtcagattcaaagttatttaatattttcaaaaataacttttctccagcagaccattagtggcatgaatgtctgtgcaaccagagtggctagcttttccttgctttttcatctgagtatttcaaggtactttgctaatatttttatactttattcatcaagttcctttttacacaaatagacagggttattaagaaaggttccattggatgttctattgaaacatagaaggtatttttttaggggaacaaaattcactgaggagctgtaattttggaaaaagaatagtttagtctaattgatataaattactctaatggaaaactaggaacatgaaaaatatctacagtagagttggaattctaacaccaggctttagacctcaaatactaaatcatttattttcctttagaacataaccgatctatattaaaatgacttaagggtatagtttttactttaaagttcatattttatatatgtgcatttagtaaggtaatcatatttaataaaagaaatgcataatgcagtactaattactttttatctttttttctttaatcagctttctcaggtagcaactaattacttaaaaaaattaatagactttcttttttagagcagctttaggtttgcagaaaaattgagtggaaactacagagagtttccatatatttcctcacacccaattccctaggtccctcagtttcccccattattaacatcttgcattatgtagtatatttgttacaattgatgagccaatattgatatattattaataactaagctgataggttacattagggttgactctttttttttttttttttttttgaggcagagttttgctctgttcccaggctgctgtgtaatggcatggtcatagctcactataaccttggactcctgggctcaagtgatactcctgcctcagcctcctgagtagctgggactaaaaacacgtacatgatgctcagctaatttttttattctttattttttgtagagatgggatctcgctatgtttcccgggctggtctcaaagtcctgggctcaagcagtcttctcacctcagcttcccaaagtgctgggattactggcatgagccactgtgcctgtccagagttcacttgtgatgttgtacattctactggttttgataaatgtatgatggcatgtgtctaccattatagtatcacagagaattgttccactacactaaaaatcccatgtgctctgcttattcatccctccttctctccctctagcccctgacaaccactgatgtctttactgtctccctagttttgctttgcccagaatgttatatagatggaataatatagtatatattttcacattggcttcattcacttagatacatgtctttaaggttccttcatgtatttttatggcttgacatttcatttcttcttattgctgaatactattttattgtttgggtgtgccacaagttgtttatatattcacttattgagagacaccttggttgcttccaaatttgttattttattaatttttttagagatagggtctttctgtgttgcccaggctggtctcaaaacctggccttaagtgagcctcccacctcagcctttcaagtagctggtattacaggctcaagccaccatgctcagctggtttcttccaagttttgtcaattatgagactgattacttttttaaaaatgtattttttcaaaattataatcatatataattatagggtacacagttttccccctatgttttcttatagtatgtttttaaaatcagtttcaggtcttgtgtttaagtctttaatccatttcgagttgtgttttgtatatggtgtgacataagggtcaaatctcactcttctgcatgtggatgtccagttttcccattattctttattgaagagactgtctttgccccatcgtgtgttcttggaacctttggaaaaaaaaaaatcagttgactgtaaatatgtgggtttatttctgggctctctatcctgttccattggatgatgtttctatttttatgtcagtaccatgctgttttaattactacagctttgtaatatagtttgaagtcaggtagaatgttgcctccagctttgttctttttgctcaaattgcctgggctacttagggtttttttttttttttcatgtgtgtgtggttctatataaatttcaaaataactttttctatttctgtgaaaaatgtcattgaaatgttaatagggattgcattgaagctgaaggtcattttgggtagtgtggacttttttttttttctttttttttttgagacagagtctcgctctgtcacccaggctggagtgcagtggcgtgatctcggctcactgcaagctctgcctcctgggttcacaccattctcctgcctcagcctctcgagtgcctgggactacaggtgcctgccaccacacccggctaattttttgcattttttagtagagatgaggtttcactgagttagccagaatggtctcaatctcctgacctcgtgatctgcctgcctcggcctcccaaagtgctgggattataggcatgagccaccgcacctggcccgtagttggactttttaacaatattaattcttccaatccatgaacgtggaatatccttatatttatttatgtcttcttcaatttctttaatcaatgttatatttttcagtgtacagagctttcatctcattggttaaacttattctcctaaggtttttttttttgatggctgttgtaaatgagactgttttctatatttctttagatagtctgttgctagtgtataggaatgctactgatttttgcgtgttgactttgtattcttcaactttactatttatcacttctaacagttttttggtagagtctttatggtttttgtcatcagcaaacagtgacaattttaagtttttcctttcctatttgaatgccttttacttctttctcttacataattgctccacaaggacatccagtactacattaaatagaaatgatgagagtgggcatcctggtcttgttcctgatcttagagaaaaagttttccatttttcaccattgtgtgtaatgtttgctgtgggcttttcatatatggcctttattatgttgatatacatttcttctatactaatttattagtgaaaggatgttgaattttatcagatgccttttctgcatctaatgtggtgatcatatagtatttgtccttcattctgttaatatggtgttctccatttatagatttgcatgtgttgaatcatctttgtatccctgggataaattccacttgatcatggtgaatgatccttttaatgtgctgttgaatttggcttattcgtattttgttgaggatttttgcatctatgttcatcagggatattggcctgtaattttcttttctcataatgttcttgtctggctttggtatcaaggtaatgctaacctcataaaaagagttcaaaagtattacatcctcttcgattttttggaagagttcaaaaaggattgatattagtttaaatgtttggcagaattcatcagtaacacttccagtcttgggcttttctttgatgggaaagtttgtattattgatttagtctttttgaattaccaattcaattattattggtctgttcagattttctatatcttcttgatttagtattggtaggttatatgtggtaggataaattctaggaatatatccatttcttctagattattcaatttattggcatatggttgtttgttcgtactaatctttatgattctttgtattctgtggtataaatcacagtgtctcctcttttatttctcattttatttatttgaatcttttcacttttttttctaggttaacctaactgtaggtttgtcgattttgtttatcttttcaagaaaccactgctggtttcattgatttttcttctattgtttttctagtctctattttatttatttttgccctgatctttgtcatttttttccttctgctacatttaggctttttctttttctgcttccttgaggtataacataatattatttgtgatatttattcttttctgatagactgcaggggtccccaacccttgtgacctgttaggaactggaccacacagcaggaggtgagtggcagtaccacctgagctccacttcctgccagatcagtggcagcattagagtcttatagcagagcgaaccctattgtgaactgcgcatgcgagggatacaggttgttcactcttcatgagaatctaactaatgcctgatgatctgaggtggaacagtttcatcctgaaaccctacctgcttccttcctgtcttccaccaaactggtccctggtgcatagagccatttattgctataaatttccctcttagaattgcttttgctgcatcccataagttttggtatgtgttgtgttttcatttttgtctcaagatatttttaaatttcgcttttgatttcttctttgactcattggttgtttagtaacatgttaatttccacatatttgtgaattttccaagatttctcctgttactgagtcctagtttcatagcattattatcagagaagatacttgaaattatttcacttctcttaaatttgtccagactagttttgtggcctaacatatataataaaggtatatatttttcatttattaaacaattatatatttgataccttttatatatgccaggcactgtttttggtacctgacctagagaaagttccatgtgctcttgagaagaatctgtattctgttgctgttggatggaaaattctacatatgtctgttaggtccatttggtctaaagtgtagctcaagttcaatatttgcttattaattttgtttattttttatgtaatcttaaagtttacctacaatataaaaactttagcatgaaatatatatatattttatttaagttccaggatacatgtgcagaatgtgcaggtttgttacataggtaaacgtgtgccatggtggtttgctgtacctatcaacctatcacctaggtattaagccccgcatgcattagctatttatcctgatgctctccctcccctgctccccaacaagccccagtgtgtgttgttcctctccctgtgttcatgtgttcttattattcagctcccacttacaagtgagaacatgcagtgtttggttttctgttcctgtgttagtgtgctgaggataatggcttccaggtccatccacgtccctgcaaaggacatgagttcatttctttttatggctgcatagtattccatagtgtagacgagcatgaaatattttcattttcttatttatgtattcatttttattttttgagatggaatcttgctctgtcatccaggctgtagtgcaggggtatgatctcggctcactgcaacctccacctcccgggttcaagcaattcttcctgcctcagcctcccaagtagttgggattacaggcacctgccacccatgcctacctaatttttgtagtgttagtagaaatgcggtttcaccatgttggctaggctggtcttgaactcctgacctcaggtgatccacccgcctcggcctcccaaagtgctgggatttacaggcatgacccactgtgcctggtctgagcatgaaatattttaaataaatattttttaaaaaggtatctcaattttccaaaaacttgaaatctattttagtttaccagtacaaaataaatgtgatttaaaaaaaaaatttacacaagatttacatggttgtcctaaaatttaaatgatgtggatttatgtggagtaaaagatgtaagttctttctgtcctcttaataccatagtcctatacattttttcctatgcatgtaacatgtatatatattgaaaatacatgtaatataatcccttattattttaaaaaaacctatacattcccatgtagttacatttatctctgtcatttgtgaagatgggatcatgccacacatattattctgcaacttaaaaaaatttcactgtattgtatattgtggatatcttttgatggcagtgagtgttcttttaaatcactgcagaatattcagatttatagacaaattataatttatttaatcattcatctattactgggcattcagctttctgcagtttttttgctattatgaatctcgttgcagtgagtatccttgtatacataatatgtgtatctttttcatttattaaacaattatatatttgataccttttatatatgccaggcactgttttaggtactagaattcagcagtgaccaagaaataaggtttaatttcttgtgtgggaagacccacaataaagaaacaataaacaagatacaagatactttcaaatagtagtaagtgccgtgaaggcaataaataaggtcttgcagaagagagtggtggttttccaattctagatggggtaatcagggaaaggctttccatggaggtgacttctaagctaagagatgcatggtgaagaggaggctgtcagtgcagagggtctgggaagagctttctgtgcagaggcaacagcaaacagccatgcaccagtgcaggtagtgggatcatctgcctggtgcaggcattatgggcacattgtatatagggaatttgaaaacaacaggaaaaccaactaaaagttggcctgcttttctttctttcttttattattattattatttttttgagatggaggctcactccagcgcccaggctggagtgcaatgacaggatctctgttcgctgcaacctctgcctcccaggttcaagcaattctcctgcttcagcctcccaagtagctggaattacaggcacccaccaccacgcccagttaactttgttttttttttttttttgtatttttagtagagacaaggtttcaccacattggccagcctggtcacgaattcctgacctcgggtgatccacctgcctcagccttccaaagtgctgggattaaaggcatgagccaccgtgcccggcctgcttttcttattttttttcctctttttgcccttattttatttttgtagagacggggtctcactgtgttgcccagcctgttgtcgaacttctggtttcaagcaatcctccagccttgacctctcaaagcactgggatgacaggcatgagccactgcacccagcacggtctgcttttgattatcaccatgcaccagcaattctaaccaataaaatactgtgccttatttccctcccgctccatgccactgacatgagatatgtgctattccccatatttttgaagtgttgattcctggatatgggtcaaaggctgtctgcaatttaaatttaaactttggattcacttttaattataaaaattatcaagtgtttttcaaaacatactgagtaaactaaggcctcgtggctgaggaagttttgctctcttctgtgcttttgtaagtaaaaaaattgtattgatttaagtaatttaagtgaatcaagccaattacaaaatattaagaaatggaaattaaataaaatcacccataaacctaccgtttgaaaacaaatttggacaatattttgatgcataatgcaagtttgtatttctctttctcttttttggggcaagggtcagctaactaaacatttggtttgatattcttcagagttaggttgtaactctctatatatacatagttgtatatatactctctctatatagtatataggcttactactataaaaccatgtgttataggtttactactataaaaccactcctggttggcccttcgtctgtggcaggtacttttgactgggctgctaaagtcaagctccctgggctttaaaaaaaaaaaaatcctcaaaaatcagtcaatactgcctgagatcacctgttttaactccaataaggttctagagcaagcatctcattcggtcacgtgaaggtggcatacctgggtggtggtggaactcagttgcagaactgggcttcaaaaatattcataagtcagtgcttatattggattatgactttttaggatgcttttttttttttttttaatgagacagggtctgactatgttgcacaggctggtcttgaactcctgggctcaagcaatccacctgcctcggcctccaaaagtcctgagattacaggcatgagccaccgcacccagccaggatatttttgaatagttaaagtattttatcatgataatgttttcattcagtaaatgtttattatgtgtatttcgacgtccctctgctaggtgctaaggggcataagatgattaaaggggttgtgaaaagtccagtctaactggggtgagagaggtaggcaggtaaattagcacaggttggaagcacaggggtagagtttgggaatgaagctctggggcagcacagtgggaagagtgctcctcctgccttggggaacaggacaggccttgcctctccttctggcttcctctgtcactattcatctcgcaggcttttctgtcctctgccacaagtgctcttcctccctgaggacttttgcagaagttctttcctctgcctggaatggatgcttccttcttgtctccacgccttgctgattgctccccactctttcattccccacttgctgtgttgtagcccctcactgtgtgctctgcttcctgacatcatttagcacggctgctgtgaaaggatgacttgctggatattccccacctccccctcaagagaatgctttcagctgtaagtaacagaaaactgataaacaagtggctcgacaaatggtggtttattctcaaatatataggggactggaggtcagtagccactggtgcttgttgagctgtcatcagtgtcaggatcgtgtctgtaggattctcttgtcctttccctcatggttataagatggctgtcccagcttcaagtgcacccacactcaaggctgggggaagggatggctctgggtcttttcctttttatctggaaagcaaactctttcccagaagctggcagcacacttctatgtgtgtgctattgtccatccctggcagtaatcagctttttcagccactcataaggatgaaagggagaggggggagaggtattaagactagtgttgtgtttgccattcaacaatgccatctacacttctcaagactgtaagctccttaaaggcagggattgtctgtccttttcttctttgaattcccagtgccttgcacagtacctggcacatagagtgaatggtgacaagcatgtcagaaagagaaggtggaataaggacctttcaggagaagagaatgtcagatacgaaggcattgagctgaaagagccttcattgtgtttttgggaacatgtgactggaacataggcagatgacagactactggaaactgaaaagctctgcatatcatgtgaatttgtccttctgtcagcaatggggagtcgttgaaaagtttcaggccagggagtgacacaatagtatttgtgggttagattactgtgttgaaaatatgggctaagaactggaagaagggagattggaatcaaggagattaattaaccatatcatactgtggtttcatcaaagagagtaagaataatttggaagattggaaaatataattttaaaataacctagaacaatgatctcaaagtaggaccttggatcagtagcatcagcattacctggcaccttgttagaaacgtaaattcttggggtccacattgagcctactgaatccggagcccagggtaagttccagcagtgtgagttcataagccctccaggtgactgtgatccacatgaaagcttcagagccactaaactagagcaatggatgcttaagggtgaaagacagcttggagatcacccaatctgatacagccaatctgcatatcagaatcacctggggagcttttacatggcaactaaattgcccacacctcctactccacacagcagaacaactaaatcatgatcttgggggctgggacccgtgcatcaaattatttccaatgatctcaagtgtttccaatgagcagccaggtctgagtaccattggtcttatctaacccctattgatgggaaaactcaggattcaaagaggagttactcaagggcgtatagcaagctcaggtaagaactgggtccttgaatcaatttcataagctgtcatctccatgaatgccttaaacactatcccaactttttaatttttaaattatattaaaaacttttgtggctacatagtaggtatacatgttctatcctaactttttaatgatttgcctgaagataatcattcacggtgacaaatacaactgccaaatttttagaagaaaaataggttacagacattatgaaaaagtcagttctcttttacatgaacagtattacacactttaaaaagttatcctttttgtaaatattttgtaagaatacgtatttttaacaataatgaaaagaatatagatacaatagggtagagagtgctttgttatttgtgtgtataagtaataacccttttttcaaactctagatggagctctttggtttttatatattcttttatttataatttggtaagtctttgttttaaaagaagcagctattttgggatttttttaaaaacattaaaaattttataataagtattctcaacatttctcagctctccttttcttgttgtttcacaaccatatagattcttacttttttttgttattgttcaattgctggaccaaatccaaattcaggcctcagagagtcatttctcaaatgcatcttaaagttgtattttatctcacagtatttaacgaatgggataagtttcccatgtttattgtttgtaataggtctcaaagttgtaatagaatttgtgtaagatggacctccctttatgaataatgccaggagagaaagtctctgaggatattatagctgttgctatagtaattccttcagctatttttaccccactgtgtacaaaggagtgttaacagctaccttcttgtaacataaatgaaacattttgctgctgcttctttttcttttccgttttactagctcagtattctctcttctattggaagtgcacttggagcaaaattcccaaaatatgaggcctgttgtttttaatggtataagcctgtggtgtggttcctaggccagcagcagcaccatggatatcacctggaagtttgttagaaatgcagattctcggctcccaccctagacgtactgaatcagaaaccctggggatggggcccaacaatctgttttgaaaggctgttttgaaaggataaaaatcctgtactcaccggaacctacataaaaaaatttcctcctgtacaggccaggcatggtggctcacccccataatcccagcacttttggaggccagagggggaagattgtttgagcccaggagttggagaccagcctgggcaacatagggagatgcccatctcaacaacaacaaaaacaacaacaacaaaaaatcagaaagttagccgggcgttgtgatgcacacctgtggtcccagctgcttaggagactaaggtgggaggattgcttgagcctgagaagtcaaggctgcggtgaatcgtgatcaccgcaccccagtctggagccagagtgagaccctgtctcagaaaagaaaaagaaaaattactctgtacagtcacttttgctcgttttggatttgtccagtgcttttcaaatcacccagggcttttgttaaaaggaataattttcattcagtaagtttgaggtggagcctgatattctgcctctaacaaactcccaaacagtatggattttgcttgtccccggatcacattttgagtggtgaggccaaatagcacatagtaaggccataaccatgcctgcatgtgagttatctgtgatttatgtgtatatgcttttgatttagtatacctaaagtcagtttttccttttcaatcacagtgggaagagacaatttatagaatgtaatgctttcttgtctaattgtaagtgactcaatcatattaaatgctacaagagggtattgtttgccaggatctgtctctgagaccctctgttataatcagcagtggacacccttgaaaattacattatttaaaaaactgagactcattcatagcattatgaagtcagagagaaagtcctgaagtttgaagaagttttcagacaaaataatttcagacaaaaagaagtggttcataaatgtttgttatcggctgggggcggtggctcacgcccgtaatcccagcactttgggaggcctaggggggtggctcacccaagggcaggagtttgagaccagcctggccaatgtggtgaaaccccgccactactaaaaatacaaaaaattagccaggtgtgttggtggatgcctgtaatgtcagctactagggaggctgaggcaggagaatcgcttgaacccaggagacagaggtcgcagtgggccgagattgcaccattgcactccagcctggccaccaagagcaaaactctgtctcaaaaaaaaaaagttatcattcacttattatttactgagcatctgccgtggggagcattgtgctaggcactttaggaaatttttttaaaaaggataaagtccttgaccttgaggagataacagtctagctgaggcaataaaacttatgcctgtgaaagttaattaccaaaatagggagtattctgtcaaatggtaaagaagcgtggtagaatttcggaagaccaaaggatagctaatggctggtaaggctgaaagagggatctgattagggctttggagcatgtatagaacttagacattcagaggagagggaaggtgggggaatgctccatggaagagagatggcatgggtcagggtgaagcttctaggagtgaatcatggatgcacacaggaactggggagaagttcagatgacatgaatcttaacttcttgtctaggagccagataggtgaggatttaactgccaggcttttgagttttgacttagtcccttgtgcaccaaggaatcattgaagaatgctttcagctgggggcagggtgacccaatcataatgatgatttaggaggagtcattaatggaatattcaggatgaattcaaatgacagactggaggctgaaacacttgttggtaggcaccggcactgggtacatagggaagagagaagactgcaggaaatacagtaaggaagagaactggcaaagggacaatataaactgaaaatataaacagattaatgagaagttaagaaaaattaattcatatgaatggaaaccaggggtgtttgggaccacatttgtccttttgaggtgcctcttgtggcaaacagcgtttttttgttttgttatgtttttgtttttagttctgggatacatgtgcagaacgtgcaggtttcttagataggtatacatgtgccatggtggtttgctgcacctatcaacttatcatctagtttttaagccccacagccattaggtatttgtcctaatgctctccctcctcttgcccctcacccccgtgacaggcctgggtgtgtgatgttcccctccctgtgtcatgtgttctcattgttcagctcccgcttatgagtgagaacttgggatgtttagttttctgttcctgtgttagtttgctgagaatgatggcttccagcttcatccatgtccctgcaaaggacatgaactcattcctttttatggctgtatagtattcaatggtgtatatgtgctatatttttttttatccagtctcttattgatgggcatttgggttggttccatgtctttgctattgcaagtagtgaaacagccttattttctaactaaccatcttggagacactgtatagactagttgatttcagtggcattaccttgctaacgatttgaagttgatatattatttcactcacatttacctttttggttttgtatctccttttagggtcctctgccttatttcctgcaatcatgaatatgttttgaatactgctagtcacaaattccaaagctggccattcattgttagttagtactttcagaacaattgtcttaaaattttagatctagaagggacctgagaggtcatctggtctgtctgtctgtctgtctctctctttctctgtgtgtgtgtctgtctctctctgtctctctctctttcactctctctctctctctctctcacacacacacacacacacacacacacacacacacacattagagacaaccaaagtcttctaagacttgaggcaaaggaaagtacacttgaaggcaatactatatgatgccccatccatgttaagatggttcacagagctgatctgacctgatcattggtgccttagactggagaggagactgggtgccaggagagcaaaccagtcttcctgttagtttcttccctacccctgccccaagggaaagtcagtgcatcttggactctggatgaaggaatcttctggcggaaatctaaggagtttatatatatctattttaaatcaatgattaccggccattttacagagggttatctctctaaaagtcctagaaacccatgtaagcatattgaatcagagctattcagcctgacttgttgcagaaaacatactgccttaatccaccaaaacacacacatgtgacactgcattctaaaagtttgaagttttacattcagtttaaacaaccatccagcaatatcagaccctggtccattggcttagtggtgcctcattcttaatgctcttatctaggtgcagcctcaattactgcctggttagtcagtcaaggaaaccaaagtgtgtgcgctccacttgaccatggtgttgtcagagagcacccagagggccatgtagtctttgatacagcatgaggtgatgcatttgattattacctgtgtcctctgggcaagcatttattcattccacaaatattataaagtatctgctatatgtcaggcagagtgttgggaactgtggatacaaagatgagtaatacagtctctgccctcaaggacttgaggaaagatggatgggtagacacagaagaatgtgtatacagaatgaagtaagacatggaggatttgatccagaaaactcttgagactgaataaaggattttaacttttgtacaaactgagatcctcctgtttgccctgtcaatgccaaggcgacctacattcagatactgtgactttaaaaaaattgctcattatcatgtccacatctccagtttggctgacacatctgtccttgtgaaatatgccaagcacaggataagataatctctgaatttggacccagtcaagtgcttgagttcgatgccaagatggttaggctaccttgctactcaccttgaagatttctcataatgatggaaacttacttcaagattctatagcaatttggcttttgtatccccaccttccaagccccccacctccatttcttagtctcacatttgccaccccagttcgctggcaatgctcatctcacaaggctaacagatgcagctcacaagccaggagggcagcaggcaggccctcttgataaaggactcttaaaatttattttaatttttctttttttgtgtgaggtattttccagtgaaaaccagaaaacctgctggacaaattctgaaaaagctgtaacttttttttttttttaatgcttcaggcaattccatttgatctggccatcaccaaagctactggtaatccataggacccttcctcatgacggcatctatcgacctgtgaccttttgcctccagctcttactgaacaaaaaaagcacccagtgtatcaccactcatttcctcagcagtctgctatatttagtttgtcaaagtgtttttggatcttgattcagttatctaacatgttcattgtttctcctagctcatcaactgagaaatttgataaggatcatttctatatcattgtccaaataattgaggacagctttgaacagcacagggcccagtagcacagtctagacaacactctcctctgatacatttataatcatatctgaaaagatataatggtggcaatcttttggacactgtattacaaaaaatctcaaatccagagaaaagacagagaatagcgtaatacccacatttagatttcacagttgtagtatttttctatatttgtatcacaaatgttatatagatacagatttttttttctgatttggataaatttgctgtaagagacatttgggggaggaactactgaggcatttgaatatggcctgggtatgaaagaacgttaaggaattagtattatatttgttatgtgtgatatcatcatggttatgtaggaaagtgtctttattttttatagctgtatactgaagtatttgggtgaaatgttatgatatccataattttatttaaatactttgggcttttataaacaataattcagagggaagagagttgtgtaggagatatctaaagaggttcagagagaatggctaattgtttatcagtctgtgatggaattgttttgagtttggaatattttgataagttctaaataataagccagttttaaaaaattaccacataatatgaaagacagaagtcttcatcctgttcttgggcccagtgccaccccagagcctcattccatcccatttctccatcccaattattactgtcattttttataaaaattgcttctatattttgatgtacatttctcaaaactgttttgtcaaaatattcactttttccattgtcttcagacaaaaccactgtgtcaaatctgctgtgtccaggccaggcacagtggctcacacctgtaatcccagcactttggtaggttgaggtgagcagatcacttgaggtcaggagttcaagaccagcctggccaacatggtgaaaccacgtctctactaaaaaaataaaaaaatcacccaggcgtggtggtacatgcctgtaatcccagctacttgggaggctgagggaggagaatcactgaaaccgggaagcagaggttgcagtgagcagagatcacgacattgcactccagcctgggccacagaagcagactccgtctcaaaaccaaacaaaataaaatagaatagaataaaataaaataataaaataatctgctacatccaaatgtccaataaaggaaaaaagccacatgaaccgtgagttagaaaccataaaaagtaattggatattaccaagagaagtgttactaatataatttcagatacattacggggataatatttagacaggtgtagtagagccattattgttatatatcagctgagttattttaaaatagatatagtaatcattgaattaaagaaacccaatgaattttaaaaagagaaagagcagtgaaaatgaacatacagtatctcttgggaaaatgtaaaatggatgataaaacaggaagactgtagagggtgtattatagataacacattaattgtaattgtattagaaatagaattttaagcattgccattttctggatagctgaggatgacaaagtcaaaatttttagtgcatgctttcacttaaatggcctataaaatagacaactgaggtgaaacactggtaagatgagccaaagctttatttttggcgtcattttcctttaaacctgttgggatttgtaaagcttggttttcctgtccaaagaaccaatcaggagtgttacagaagaatttttctacctaaataattttgaacgctattctttctaaagtatgttagacttatcgcttacctttttccccacagaatggaagctatttagcagaggttggcctttttctgatgactccagtagatagtttcagcagtgaatcttccagggctaattagcatgtgtggtgccattggagttgcatgcttgcgttcttgggtcctggtgtgttgttcctctttgttaggtctgtctgattttgatctgtttctttgatgcttggagcacacccatgagagcctcccctatccccctttgacttcagtttcaaatttatggacattactgaaataaatacacacatgctcaccttcgtttggatcctacatcaaaaaatgtgataaacaatcctcagcctctagaatttttttttttaagagagaataggtcttgctatgttggccatgatggcctcatgcaaccctcctgccttgggttcccaaagtgctgagattacaggcatgatccacttcacctggccaacctctaggaatttgatgtaagtctagctactacctaccagccatatccatgtactctagacaacatttttgacaaacagtgcacaggaaaggcccatgaaacttacggttttttttccatcgagaaaaatattgccttctatttctataagttaattttatttttcaataattctaataattaatgaaataatacctggatgctaagagtcaaacagtgctaaaaatatttaaaaaccagcaactactgcctcttcaacccatcccatcccactcctcaacaatagttttagcgatttttttgagtattcctcctaatttcagattaactggtatctcttaaatcattaactttagatattatctggtgactttttaccgtgatagacaaatctattgatgtcctattatgatagatgaagatgtgactcttaaactagtctttccttccctcatttcctcattatgcttttatatgacttttggttaatgcatcagcagtcagtttttatatttttagaactatgtaagttgtgtcctaaggtgccctcaaggaggaatctggctccagttgttcatttcttctttttattttgagacagactctcactctgttgcccaggctggtgtgcagtggcgcgatcttggctcactgcaacctccacctcttgagttgaagtggttctcctgcctcagcctcccgagtagctgggattacaggtgtgtgtcaccatgcctggctcatttttgtattattagtagagacggggtttcaccatgttggccagcctggtctcgaactcacagcctcaagcagtctgcctgcctccgcctcccaaagtgctgggattacaggcatgagccaccacgcctggccagttcatttcttcttttagcgttttgtgacacttggtgatacttggttgccaataccaggtgatagaaaaactttacctccaaatcctgttgcagaaatttttcttaaaacagtttttttttttttttaaaatcacagaatagacacagtctcttaggcggttggaagtatattcacatctccagctagatgggaaaatcttgtgggcagggattgtaatatgactttgggattgtaatatgacttcgtaaagaacagggatttttaaaaggaaaggttaagatttggataggcaaaaggaaggaggatatgctttatacttttggtctcttgaccttatctgaaggcctggaactcctgtaatgaagtagttacacagtcaaaggtgggaggagggtctgttagcatccatctgcaggtctcagtaattctccactgcctgacacaatcacctcctcactgcccctgtgaggtgcagcgccatccaagtcaatcacagggaaatgccagggctcactttgtttatttactggagtggctggttgtactgggaggctatcaagactatcgggagggctcggcatttcatactctttgggctgccttctgtgtgtatgtgacagatcctgggccgggatctctgagccagagctcctctcaaggttaaccttgtacatccccctccccatatgtgatcagcaggggacaggctggagtgcgcaagccggagtgcacattcccaaaggttcacgctggccttccttcgtgtctgctgtccagccccaaatacgacccttttaatctcataaaactactcagaagggcttcaaacataaagaaatacagtccacagctttcctccccatactgaagatagcgaatggaatatgggaatgttatcggggggcgagctgttacccatccactaagagccctagttcctgatggccaaatgcatatcttctctattaagcaaatttatctgccaaaaagctgtgttatgccaaaaagttatgtccacaaatttaggacactatcttgtgtcgtttgtggttgtataagaatcacaatgtggcgttggttgctaaatacattattaacctgtttgagagcaactctgttgttttctttgctcatgaaggtcaattttcaccagtagaagcattacaaatttaacttgaggatcttagtttttttttcctgtaagagcttttttcacccctttcattagtaattctaaaaattttgaactggaaattttaataatagagtaagtaaatctaagcttctttggaagttgtacttgtcagttctatttttcggtgtcttaggaaacaagttaaaaacggctttttagttcttaatacatttctaattacagttctttctcctctttaaggggcttgcttttctttaaaaaggtgccgttttctttccctgtactaattggaatgttggttttaaaaattgatattcttgggttgggtgtggcggttcacacctgtaatcctaccactttaggaggttgagggaggaggatctcttgagcctagcagtgcaagatcagcctagtcaacatagggataccccatctctacaaaaataaaaaatacaattagccaaggatggtgggatgtgtctgtagtctcagctactcaggaggctgaggcaggaaggatcccttgaacccaggagtttgaggctgcagtgagctataattgtgccactgcacttcaacctgggtaacagagcgagaccctgtctctagaaaaataaaaattatattccttctaaccatggtcattaaaaaaatatgtatataaatatacacatgtatatatatttgcttgcaaagagacaaaagtcattacttaaggcaaagcttttaaaattgaagatgtttcatatgatcatgtgctttgtttatgaacacatttgtaccaactgaagtgttggccttggttgaatttccttcttttctccaaatcatcaaaactgatgaaatgtcaatcatgttgaccaatttttcacaacaatgtgtgtaacccatggcagtgaagggtgtgaagacaaatttagcttccacacctggagagggagcagtatgtggatgagtagaataaattgaactctactaatctcttttttcttttatttatttattattatactttaagttctagggtacatgagcacaatgtgcaggtttgttacatatgtatacatgtgccatgttggttagctgcccaccacccactgacaggcccctgtgtgtgatgttccctgccctgtgtccatgtgttcttactgttccattcccacctatgagtgagaacatgtggtgtttggttttctgttcctgtgatagtttgctgagaataatgtttcccagcttcatccatgtccccgcagagaacatgaactcatcctttcttatggctgcatagtattccatggtgtatatgtgccacattttcttaatccactctatcattgatggacatttgggttggttctaagtctttgctattgtgaatagtgccgcaataaacatatgtgtgcatgtgtctttatagcagcatgttttataatcctttggttatatacccagtaatgggatcgttatgtcaaatggtatttctacttccaggtccttgaggaattgccacactgtcttccacaatggttgaactaatttacactcccaccaacgtgtaaaagcattcctatttctccacatcctctccagcatctgttgtttcctgacttcttaatgatcgccattctaactggtgtgagatggtatctcattgtggttttgatttgcatttctctgatgaccagtgatgatgagcattttttcatgtgtctgttggctgcataaatgtcttcttttgagaagtgtctgtttatatcctttgcccactttttgatggggttgtttttttcttgtaaatttgtttgagttctttgtagattctggatattagccctttgtcagatgggtagattgcaaaaattttctcccgttctgtaggttgccttttcactctgatggtagtttcttttgatgtgcagctctttagtttaattagatcccatttgtctatttcggcttttgttgccattgcttttggtgttttagtcatgaagtccttgcccatgcctatgtcctgaatggtattgtctaggtttttttctagggttttatggttttaggtctaacatttaagtctttagtccatcttgaattaatttttgtataaggtgtaaggaagggatccagtttcagctttctacatatggctagccagtttttccagcaccatttattaaatagagaatcctttccccattgcttgtttctgtcaggtttgtcaaagatcagatggttgtaggtgttatttctgaggcctctgttctgttccattggtatatatctctgttttggtaccagtaccatgctgttttggttactgcagccttgtagtgtagtttgaagtcaggtagtgtgatgcctccagctttgttcttttggcttaggattgtcttggcaatgcggactcttttttggttccatatgaactttaaagtagttttttccaatgctgtgaagaaagtcattggtagcttgatggagatggcattgaatctataaattaccttgggcagtatggctattttcacaatattgattcttcctatccatgagcatggaatgttcttccatttgtttgtgtcctcttttattttgttgagcagtgatttgtagttctccttgaagaggtccttcacatcccttgtaagttggattcctaggtattttattctctttgaagcaattgtgaatgggagttcactcatgatttgactgtttgttattggtgtagaggaatgcttgtgatttttgcacattgattttgtatcctgagactttgctgaagttgcttatcagcttaaggagattttgggctgagacgatggggttttctaaatatataatcatgtcatctgcaaatagggacaatttgacttcctcttttcctaattggataccctttatttctttttcttgcctgattgccctggccagaacttccgaccctatgttgaataggagtggtgagagagggcatccttgtcttgtgctggttttcaaagggaatgcttccagtttttgcccattcagtatgatattggctgtgggtttgttacaaatagctcttattattttgagatattttccatcaatacctagtttattgagagtttttagcatgaagggctgttgaattttgtcaaaggccttttctgcatctattgagataatcatgtggtttttgtctttggttctgtttatgtgatggattacatttattgatttgtgtatgttgaaccagccagccttgcatcccagggatgaagcctacttgatcgtggtggataagatttttgatgtgctgctggattctctttgccagtattttattgaggattttcacatcggtgttcatcaaggatattggtctaaaattctctttttttgttgtgtctctgccaggctttggtatcaggatgatgctggcctcatgaaatgagttagggaggattccctctttttctattgattagaatagtttcagaaggaatggtaccagctcttctttgtacctctggtagaatttggctgtgaatccgtctggtcctggagttttttttggttggtaggctatgaattattgcttcaatttcagagcctgttactggtcttttcagagattcaacatcttcctggtttagtcttgggagggtgtatgtgtcgaggaatttatccatttcttctatattttctagtttatttgcatagaggtgtttttagtattctctgatggtagtttgtatttctgtgggatcggtggtgatatcccctttatcatttgttattgcgtctatttgattcttctctctttccttctttattagtcttgctagcggtctatcaattttgttgatcttttcaaaaaacaagctcctggattcattgatttttttgaagcattttttgtatctctatctccttcagttctgctctgatcttagttatttcttgccttctcctagtttttgaatttgttagctcttgcttctctagttcttttaattgtgatctcccaaagtgctgggattacaggcatgagccaccgtgcctggcctgtttttgcttttttactgtaaatttactgattatcaaactaatacatactgtggtagaaactgccagttatttcccagcatgcatctgtccccttttttctttagtaatagaaaccctgaacttgcgctgtacacatggtccctactatggtctgaatgtttgtatccctccaaaatcatatgttgaaatccgttccccagtgtgatggtattagggagtggggccttttggtagatgatcagatcataagggcagagctctcacaaatggggttagcacccttataataggccttggagagctctcacaccccctttaccatgtgaggatacattgaaggcaccatccatgaggaacaggcccttatcaggcactgaatctattggtgcctcaatcttggaattcctggcacccagaattgtgagcaatatgtttctgttgtttatataaagtacccagtctaaggtattttgtttagtagcccaaactgactaagacatccccctagcataaggaccgtatttcttagcctgtttgaagcttgtatggccaccaatgagatgtgaatgaaaataatgcatgcattgtctcggttatgcccttaaagggaaagggtgtgccctccactattttctttcccctttcttgccagaatgtgaagacaggaattggagcagccatcttgaactgtgagatggaagccatacattgaaggtggcagagcaaccaaatagaacgaccaagtgtctctgatggttgttgagctgtcataccagctgtggactgctgtctgaacttttgtaggacagaggaatacactatttaagtctgttgtaacacctgaattgctctgtattctaatataatacttgttttagaacacttggaacaacagaaaattagttttgttaaggcaggaaaaatcttatgtgtaattctatcacccagagtcagtcatgtgttaactgacatcttagtggatgttgtagcatgcttccctcagcctcatccccacctctaccttcacgatgacatgcttagttgctcagtgcctggagtgttagctgctaatggttctatccaggaattgaccttggcctcaggggggcagcctgcatccaagaatctgttgttgagagggtaccaaagtctagtcttcttgctttattcagtttggacaactctgaagggccatcctagctctagagctcgatgtagaagtggccaaggtctctgttgcaactgcattacagttcacctctccctctgtcaatccagcttccctctcctttcacaggcactcttcccaagggcacttcacaacaaacccgcatgcaaatctcagaatctttgtgctagggaacctgacctatgacatatacagatttagagatttgggattataatactttgtttttcactaaatattttgctgggtagtctccatttgcctttccagacacattctcctgccctccatccacctctgttctgggaggctgaccacgatgggatacattaatgagctcctttgccctctaccttccagttgaatgctgccagtggaaggcactgataggagatcagatggtgggaggacagagactgggatatccctcgtcaccaggctgtgtgttggaagaggcatcattcttctactaaatccacagctcatggtgtgaggtcttctcctagagctacaggtgttagtgttttgctggtagttacttcctctggccctttcatgcctaggaatggaaatagctccctagtgctgccagccctggggtgcttcatcagctccctggtttcttatccttgcccacaccttgcaattagtcagtcttctcaatcactccgtttgagtatgccatctatttcctggcaggaccaggactgatacctactattttttttttttttttctggaaacggagtctcactctgtcacccaggctggagtgtagtggcacgatctcggctcactgcaacctgtgcctcccaggttcaagtgatgtttgtgtctcagcctcccaagtagctgggactacaggcacgcaccaccatgcccagataattttttgtatttttagtagagacagggttttaccatgttggccaggctggtctcgaactcctgacctcagatgattcgcccccactcggcctcccagagtgctgggattacaggtgtgagccaccgtgtccggcctcctgtttcttttctttctttctttatttttttttttttttttgagatggagtctcgccctgttacccaggctagagtgcagtggcgccatctcggctcactgcaaactctacctcccagattcaagcaattctcctgccttagcctccagagtagctgggattaaaggtgcttgccatcacatccggctaattttttatatttttgctagagacatggtttcatcatgttggccaggctggtcttgagccttctacttcttaatgattcttctaaaacatgatttttattggccatgtataatttcatcatgtagacttaaaaggatttctttaattccctattgttatatatacactttttatattgatttttatcacaatacatcaaagcatttattatgccattgaaaacttccaataaacacatttttaaaggactgttatattatggctggaccgtgaaccttgagttgtttatccagtagtgctaagagatttgttctgatccacctgatttcttttgtgcagtgtttatagtgactaaagaaacgtattttcaagatgattgggctggctatactctgtagctgccacagaagaaagcaaggctatgccccaatcccaccacattaagatccccagttcagggctcttcattaaaacagctaaacaaactggtgtaaacagtacttttacttgaatttaacatcttttatgttttctgggccagactttgtgtggatattggataataggcttggtggcccttttatatcccttgtgtacttgtaattctaggaaaaatacaaagcatttagtgggaaggatttgtaagagaatacagtttgatcaccatgtaacttgagtaaaaatagcaccataattgaaaacactaagagtagggttttaaggaaagagagtaagattggaacaaagtaaccatgaacttttcagttctgagctgcgagttctgttcattattcagtgaccctttgtgagatcttgtcttagtccattcacgctactataacaaaataccatagactgggtgacttgtaaacaacaaaaatttacttctcatggatctggaggctgggatatccaagatcaaggtgccagcagattcagtgtctggttggggcttccttcttggttcatagacagctgtcttcttgctgtgtcctcacatggtgcaaagggtgagggagctctctagggtctatttaataagcacattaagggaatgccttaatgcgcttattaaatgaagttttttgagaaaaaactcaaagtgctttctaaatttatctcactcaaccacaatcagtgcagacctgtgaccaaatgtaggtggtgtgaggggtgggtgggtgggtgggggaggagcatctccccaccaccaagcaagcaattagttttgtagcagataccaactggatatcctccaattcagttctgacactatctacttggagatagcatcagatcgttaccggaaaggggtcctgatccagaccctaagagagggttcttggaaataattcagggcaagtcggcggagtaaagtgaaagcaagcttattaggaaagtaaaggaatgaaagaatggctacttcagagatagagcagccccaagggctgctggttgcccactttttatggttatttcttgattatatgctaaacaaggggtggattattcatgcctcccttttttagaccatatagggtaacttcctgatgttgccatggcatttgtaaactgtcatggtgctggtgggagtgcagcaatgaggatgaccagaggtcactctcatcaccatcttggttttggtgggttttggctggcttcttgactgcagcctgttttatcagcaaggtctttatgacctgtatcttgtgctgacctcctgtctcatcctgtgacttagaatgtcttaactgtcggggaatgcagcccagtagttttgaggcttattttacccagctcctattcaagatggaatttttctagttgaaatgcctctgacaagatcccacagattgggggctcagtccccaaggttccctcttaagccctagaaatcagtagcaagtctcggcctctggaacttctgaccaactgactggcttcaagtgggggttcccatgacccctccttgaattcaattaattttctagggtagctcatagaacttggaaacttacatttaccagtttattataaaggatattaccaaggatgcagatttagagatgcatagtgcatgcagcttccatgctgtcctgggcgtaccaccctccagaagtctccaggtgcttagctatctggaagttctccaaaccctgtttatttatttctatttttatttttaattttttttaatggaggcttcattcagtagccatgattgattaatcattggccattggagatcagcttaacctttagcccccctcctttccctggaggttagcgggtggggctgaatatcttaaacctgttatcatgccttggtctttccagtgaccagcctccatcctgaagctaccacctgggggttgccaggcatcagtcaatcattagcatatgaaaagacatcacttcggagattctgaggattttaggagttctatgccagaaatctgtgatcaaagaccaaatatatatttgttggttttctttctttttgagacagagtcttgctgtgtcgcccaggctaaagtgtggtggcatgatcatggctcactgcagtttcaacctcctgggctcaaacaatcctcccacctcagcctcctgagtagctgggaccacaggcacacaccaccatgccaggctaatttttgtatttttttgtagagatgggattttgccatgttgcccaggtctgtctcgaactcctgagctcaagcagtcgcctgcctcagcctccgaaaattctgagatttcaggcgtgaaccactgcgcccagcccaaatatatatttgttaatatcacagacattcatcccattcatgaaggctcagccctcacaacctaatcaccttttaaaggacccacctccagatactctcacattgggcattggatttcaagataggaattttagagggacataaacattcagaccatagcagatctctttacttaggttaaccttgttttagtattacaaaaagcacttcagtgtgttcattcattgtattcaaaacatatttatcaagaaactactatgttcaaaacactaggatatggctgtgaacatctagaaaaattacccactctcataccattaacatttctcaagggagtcggataactaacaaataaacaagattattgtgaattgtgacaagtcctagaaggaaataaacaggatgatgaaagacagtaagtggggcaggacactttagactggatggtcagggataatacaaacctcattttatgtgttatggaaggtagtgtgtttgaatggagtgagagaaaactagaactgaagtccagctttatcaccttgtataagtttcttaaccttgctgaacaccatgacaggctgaaaatataacaagaacataatgataataatccctactacttatagtagtagcagaattaaaccagagaaaactcctggcattgtaagcatgactttctgccaggccccacataaatattaatttcctgttaactttcctaaaattacatataatctgaattctgtaatacccatttccaatgatataattttaagaaactgttctatacatcttcaaatcaatttaattcatcaaatatttattaagcacttactatgtgccagtctctggtgacctgatggtgaatagaataaacagtatccctgcctggtcagggtttaattattgttcttatttggctgagactcacaaagccatttctgtccactggttctcctgactagtagtaatgaatttttaccccactgctatgcacattttatgttaaacttttttttgttgtaaaataaaataaacatttaaaaaggttcataaaacataggccataaatcttaaaatctgatggaccctctcttacaaaaccctatatacttatttatgtgtcagtacaaacgtctaccattctgccactaaaaataacaaagaaaacagaaaaatagaagataattttttttttttttttttttttttttggttgagacggagttttgctttttcacccaggctggagtatggtggcacaatctcagctcactgtaacctcagccttcgggtttcaagtgattctcctgcctcagcctcccgagtagctgggattacaggcgcccgccaccacgtcagtctaatttttgtatttttagtagagacagagtttcgtcatgttggccaggctggtctcaaactcctgccctcatgatccacccgcctcagcctcccaaagtgctgggattacagggaagataaattttgttgttgttgttgacagagtctcactctgttgcccgggcgggaatacggttgcacaatcatggttcactgaagccttgaccttccaggctcaagcacttctctcaccttagccttctggctagctgggactacaggcatgcgtcaccacgcccagctattttttctattttttttgtagaggtagagtctgttgcccaggctggtcttgaactcctgggctcaagcagtcctcctgccttggcctcccaaagtcctggaattacaggtgtgagtgaccattcctggtagaagataaaatctgtgaccaccgtttggtgtctggacagccttgtctcttgggcctggaggggtaaagcagagtcagtcacgcaaagtcacataactggcagagactccttgaatttagaacagtttgtttaaccaagtggaagttgtttttttttctttttcttggcttattatttgcctatagcggcagtgcccatcttggggcagatccaggtttcacaaaacttaccagggagacctggccccatagctctggaaatacttcatatggaaaggataaaggatatctatgttaaaccaacatcaacatgataatgatgaaatgctaaaggcaaatataactcaagctaggaacaacttacagatatttgccatcaccaccatttaacataaacggcccacgatccttatttccaaatcttgagttttaagtcaagttaataagctgttaaaggaaatatgttctgtatgttctatatctccgccttgataactaaacctttcatgacttataaatcaaacatacaaatcaaaattgtaaagctatggtttccatatgactataagttaacaaaatataaaaaatgattgaatttaataattgttatacatgtctgggtgttctgatgatgtggtagcatttttagatgagtaataagataatgagttgtaatttattctataaaatttattttccttgctttcatttcagcaaaatcattaagtttattataatcaagatattcatatcaggcacatggcttatgcctgtaatctcagcactttaggaggctgaggcagaaggatcacttgagcccagaatgttcaggctacagtgagctgtgattgcaccactgcacttcagcctgggcgacagagcgagacccggtctcaaaaaaaaaaagaaaaaaagattaacttcatttttttctattcacagtaatgacctcaaatattttaaaaatgtaattgtattaaaatgtgcctaatttgaacatattttcataaaagtaaattatagcaattgcaaaaatgtgaaatattaaattatatttttcaaaaatgtcatttatcttctaagatatctcaacttgtctattgtaagatgaactaccaattataatttatgaatgtatttaatctgaacatttaaactttaatctattgaaaatcttataatttaatcttatattttcatgaaaataaaattattcttaattttagtgctaagtgatcatctagttatcaaggtaaagaattggtatcacacttggagcatgttatagctacatgtacagatgttcacatttaagagtaatgcgagttatttctctagaatcacaaattggaaaccaaagagaagcaagatgatagatgctcaacacttccagaaagatacttccttatgcaagaatcttttgcattcgtttagtctaagagaaaggatttgacaaggtaatttgtcaattctttcacctaagcattcctacttagatcctcccagtagttggaagcagggtctgtctccaaggccacggtaatacaacatttagaaacagtaattttttattttgagaactcagggccagacatacaaagaaacatttctcagggacctgagtggtattagcaagagaatggatatttagcattgtgggttgcatttgccagttctaagcgccacattcggagtgacagaggcacttacacatattccttagtaagttaatttttttatatttttgttcatggggaccttatacagtgtgagccccaagcagcagacctcttgcttagccaagggcatcctggccaggacttccagttatataaaccagtaaatgttttcatgcttaagctagtttaaactaaaaaaagagaaagaaaaaaatcctaaatcatacaagtaggtagaaaatataacagaaaataagataccattcatggtagaactctaaataaaaatatctagaattaaataaacataggtgataaatacaaatatgataaatataattaaataaacgaatgtggtaaatagattatgtgcagaatatatgggaagacaatttactagcccttgctgaaatacatgttagaaaagcagaaaacttgaataaatgggaaggggtgctatgttttagaagaaaagactccatgttataacaatatcaattcatttcaaattaactaatgcatttaagcaatttttttttttttttttggagacaagagtttcactctgtcacccaggctggagtgcagtggcaccttctcggttcactgaaacctctgcctcccgggttcaagcagttctctgcctcagcctcccgagtagctgggattacaggtgcccaccaccacgcctggcttattttttgtatttttagtagagacggggtttcaccatcttggccaggctgatcttgaactccttaagcaattctaattataatgaaaattgtgattgtctccccaacatccattctatgccaggtctatgggtgcccctgattaatccaagcaaataatctaaatcctttccttagtcgtgattgataagagaatgggcaggtgacaggattcagattaatgacacacaaaaaatggtttgctggtagcttttactcttctgccagatgtgaatgaggatgcaatgatccaggctgctcctggcagccattctatgcccatgaggagatctagctgcagggtgagcttgacacagtggatggcagagctggaagataggagatgaaaatacatgtgttattcagtggtattgagggccattgttttgggaaaccctgaaatttggttatcaatgccaacaaatctctattgtttaagcctcttggaattgagcttttggttatttaccgcctaaagcatagggatttttttaaaaagaaacaacaaaaatttagaatgaggaattaaaaatcctacagtgattttagcagtctaatttaatacagatattggccagttaggttaatgaaatagaatagaaagtctagatagataaatatgcatttatttggtgaacaatgctgagaacattgatagttatttggaaaaataataaattcatttcctcctacaaaaccaatcatatgcagattaaaggattaaactattaaagagctggaagaatatacagacaccaagtcttagagttagtgagggcctaataagctgaaagtcaaataaaatatgaaggtgtaggatcgtcttgaagtatttaaaacattatatgccaaggaatactataagcaaaaggtaaattgttaaaatacagttgaaatatatgtattataaatataatattaaatatttgaaatataaaacactgcaaaaaacatccaaatataaaaaaagttcaggtagctcacaagagaagaaaaaacattgatctgcaaatgcatgcgaaatgtttaatatccctagtagttaacaaaattgaatataaagagagaacttttttaaaccattaaattggcaaagattaaaaagaatgctagcacaacattgtgaatgactaaatgtcattgagtaattgttcgctttaaaatgttgaattttatgttacatatgaaattcacctcaacttttagaaaaacaagaggagaaaaaaagaatataatggagtagccagagtgggaagtatatagagaaatagcttctctcaggcactgcagtttgtattgtaaattggtatgtaaattttgcaagactaattaacagtatgtagatgaagccttgaaaatgtttatattctttcctttcttcctataattacacgtatagaaatatgtacctaggaaataatcagatattagatttatatataaatagcattttgttgttgttgttgttgttatcgttttcagagatggagtttcgctcttgttgcccaggctggagtacaatggcgtggtctcagctcactgcaacctctgcctcccaggttcaagtgattcttctgcctcagcctcccgagtagctgggattacaggtgcccgtcaccatgcctggctaatttttgtatttttagtagagacggggcttcaccatgttggccaggctggtctcaaattcctgacctcaggtgatccacctgcctcagcctccccaagtgttggcattacaggtgtgagccaccgtacccggccaatagtgttatttttaaactgtgaaaattataattcgtgttcagtcatagcatagtagttaaataaattacaatatactatatagtaaaatactgttcattaattaaaaaaaaattatgtaaccaagtaatctttttgagttactgcaccatggaaggaagaggacaaaggcacattgtccagctttaagtttcaaattagaattttttttttcatccataggaaaataatagtcttaaaagctagccttgcctctaatttccaagaattcttcacacgtcaggaagaaaatttggcagcctgaatgtgtacgtttactataagccaagacgtaagggcacatgcaatctggggcaggtagcttcccccttctgaaggacagaaggaaggaagaaaggcttttaggggagctgttacagagagcagcaggggttcagattgcagtgtgtctctcttgccctcccagagttacaaacctcagggatgtcattggcgtgatccatggtggcaggccttggggaacccaagaacccaggagtggtctgtacttccttggtgtagtccgcacatcttgggagtggcagggtagtgttgccggagggagatgtctacgtggatggcctgagactacgtccagggattcacagcttgtgtgtgtgatgcagaaccaggggctgcttgcgaaagggctgagtgaacaggtaacagaaagagatgtagggaaggataagaaggtcacagaccagagcaaatagcaaggtccagggacatacatcagggctgccatgtgcctatgaagtcttggcagaatcagccattgcacagcaggcagcactgcatggtgcctggtaagcactgggcacaaggggcttctcagtagaggctggtgaggatccagggagccacacccagagaagaggccttccactgctatcagcataagccaagctctcctttgcactcttctaggtctgagggtgtcctccagaattcatgtgttggaaactgaatccctagtgccagtgttgggaggtggggcctaatgggaggagtttaggtgggatcctcactgatggataatgccgctatgaaaagggtgtgtgggaatgggctctacgtttcttttcctcttctgccatgtgagaacacaacatttctacccactggagaacacagccttcaaggtgctgccttagaagcagagagaccgggcacaaacctgtcgtagccctgatcttggacttcgcagcctccagaactgtgagagaaattaaatttctcctctttataaattatccaatctcaggtattctgttatagcagcagaaaagagacacacccaggtgtcatcctgggggaaaaggagtgggaagggagctttttggaagggagaaaatacagttctaatagagagtgtgaaccttaaatgatagcatatttacttaaaacacactctttaaaacctttaaaaatatccaggaactaatacatggagaaaagaatttaggatacatacacagaaactcaataaagttaaatattttttccatatctcagttcgtataacttgatttccttgaaatcatattttttaaaatgtttaaggaaattagaagatgctcactattatattgttaaaagagcaagcagtagatataatattcgaactttctaaaatgatagtagttattaatattatacacacaaacacataaacacatttttaaacctttgacaaatacttctaaatattaacaaggattatttctgggtatagaattttttatgtagtacttttcgtattataagatgaacatacatttcttcttataatcagaaattgttgtttaaagaaacaaaccatacagccttgctactcacaagtatggtccatggccagcaaccatgggagcgtgttagaaatgtggattctcaggccccaccccagacctcccaaatcagtgtcttcattttaacaagatccccaggattgtgtgcttgccagcagcactggcgtaggcttcacactcccgttcccagcctactgatgtccatacctgacgctctgctttctcctgtttctgcagacaaacagcccctccgctcgtactctggatcctagcccacctgcctacccaaggactttctcctgcacctgtcacctctctcttctcctggatcattcccattggcaaacaaacatgctgtgatatctctttcacaattttttaaaccaaattttattttatatgtttaaaatacacaacatgatgttctaagatacatgtggatagtaaaatggttactatagtgaagcaaattaacatacccatcatctcacagttgaccattttgtgtgtgtgatcagagcagctataatctactcatttagcaaaaatcccaaatataacatgctattattaactgtagtcatgttgtccattaggtctctagacctgttcatcctaatatctactactttttgtcctctgatctacatttccctgtttcctccccctcaccctccacctaaccactgccttattctctaactttgtatatttgactttttaagatttcacatagtaagtgatatcatgtaaaaattttctgtgtctggattattttacttagcataatgtcctccaggttcatccatgttgtggcaaatggcaggacctcctcttttttaaaggccaaattacatattctatagtattctatagatcctatattctctctataattctattatatttaatatgtatatctgtgttttttttccatccttctgtcaacggacattcagattgtttctctatcttggctattgtgaataacgctgcaatgagcatgagagtgcagatatctttacaaggtggcaaattcatttcctctgggtgtatacccagaagagagattgctgggtcatatgacagtactacttttaacttatttagaagcctccctactgttttacataatggctgcaccaatcttcatccccaccaacagtgtacaagggttctcttttctccacatccttgccaatacttgttatctctttttaattatggccagcctaatgggtgtgagatggtatctcacagcagctttgacttgtgtttccccaatgattagtgatattgagcatcttttcgtatacctgttggacatttttacgttttgttttttgagaaatgtccatttaggtccctttgcctattttaaaaatcaagttatatgttttcttgctattgagttgtatgagttctttataaattttgaatattaatcctttatcagatacagggtttgcaaatacttttttccaatccataatttgccttttcattttgttgattgtttcctttgctgtgcagaagctttttagtgtgatgtagtcctatttatttatttttgcttttgtagcctgagcttttggtgtgatatccagtctcatcctttaaaacaaacaaaacaaaaccccaatccactttccagacctctgtcttcttcacatattgtcccatttttttcctgctcttcatgtctaggaaaacttgaaagacttgtctctcattgtctcccctttctctcctccctttctctctcactaatccaccgatactgctcttgttaaagtcactgatgacctccaagtgttaagtccagtggccaattatctgtcttcgtatctcacttttacctctcagcaacatcttttacctctctcttctccttggctgccaggatactctactgccatgatcttctgcctctcttactgacagcccgcccctcccagtctccttccatggttcctcctcatctcctgtttctggataggctggagtcccagcgtatagtgcttttctccctctacagttccatggctttcagtctcctctataaatggatataccccagatgtttatatctagacctgaactccagagtcacatgtcaagctgcttcacttgagtgtctaacaggcatattaaacttagtgtgttcaaaaccaaagtcttaattttctcccccaactcattccttacccagtactccctatatgagcaaatgcctatatgagcaaaagtccctttcttatagttgctcaagtcacaagcttggtataatccatgaattttgtttctttctcttccatctctcagccattactaaattctgttctacttgcaaaatatatctggaatctagatatcaatttctcatgcccccactccagtgatcccctcctcagcctgagtcatcatcactctcttctgagactattgcagtagctgtaagactcagctccctgctttcccctgtgcccccaacagtcttttctctgcacaacagccaccctaaccccctttcactcagaataaaacccaaagtccttgccatgcagcagttcaaggccccatgtaaactgccccctgctctccgccgtaccatcctctctctctgatctgatcttttatgcccatccaccttgctccctgtactccagccatgctggcctctccttgctatttcttgatcttggcaaacaaacacacaaatgctgcctcagggtggcacttgctcttcccgctgacatgcagtagaacatagtggtagtggttaagagcaagactctttggagccagactctctggggttcacttttcagctctgctcttcactagctgtgtgaccttgcacaagttaattaacctttctgagcctcagttttctcatctataaaatggggataataaatgtacctatatacagtccttaagagaatttaatgaatttatgagaagcagttggaatagtcactggcacaggagtaaatgctgtgtaactattaaccattattattactggaggtgtccatataaccctctcatttcattcagagctctgctcaaatgtccccttgttgaagatttgtttgaataccctccctccccctccattattctctgtcatcttaacctgcttcatttttcttcttagcatggatcaatatgtaagcatacgcttgttattagacagataataaacatatgtagacaggtttgcctattatctgtccacccacaggaatgtgggctccactgagaaaatgctcacagtcctggtgtatggcaggcacccaatacatatttattgagtgaatttctgaccagtaatgtttccttcttcagtaattgataaatgtaattaatgacataaaatcttaaatctctcaaaaatcttgtttctacttaaggactcccaaatttaaatccaagaactaatacatggagaaaaaaatttaggatacatacacagaagacgtgtatatatgtgtgtatatacatacacacatatcagtgtacggaagccagctattctttcttgggaaatatttttttctcctgtatctgaaagtatgtccttctttttatagtgttagaatattctttctttaattaaatgctctagatagtagaagagagttttaaaattttccctagtatccctatatttattactgttttaaaatgtccctattacacagtacttatttttaatttttttaaatttcacatataaaatgttgtcaaccttatggtgcttttcaaaattaaaaattactagtctgtgaaatccgaaagtctgagcactgtttaaaatacaaatgaagataacatatccagttttattgatataagtttctaattccagccagaacctgggaagttgtgtcattagtcaaaaaactttgatgccactttgttcattatatcttacctgttatatttaaaaaaagaggcttgtaatattttttaaatagaagatgaaatatgggctttgtattagtctgttctcacactgctataaagaactgcccgagattgggtaatttataaagagaagaggttttattgactcacggttctgcatggctagggaggcctgaggaaacttacaatcatggtggaaggcaccccttcacagggcagcaggagagagaatgagtaccagcaggggaaatgccagacacttataaaaccatcagatctcctgagaactcactatctggagaacagcatgggggaaactacccccatgattcagttacctccacctggtcctacccttgacgtggggattattacaattcaagatgagatttgggtagagacacagagccaaaccatatcaggcttcaattagtagtccctatgaaaatattgcaaatgtgacttaaacatgaaaacaaaattgagcaaaacctttcacataatgctacacttggttcaagttgaagtcctggtttaaattgttttaagacttattgaagtgttaactgtccttttaaagaggaaaagagacctccattccctgtttgtcaagtaccgtactttttagttttattttgttctaataacagaagaagaagtggtaacatttgctgaatacttatgtatctgttaccacattaatatctttattatctcatttaattcttaaaacaagtctataaaatggaaatgatgatcaaacttcgttgatagaaggaaatgtaagtttagggagagtgaaataactcatttaaacagataccacttgttagatggtagtgctgggatgagctcccagagctgactctaccctccatctgaatcaggtgtgtatttcttgaattggcacacacttagtcgtgacaagtactcaaaagataaaataaaaattgtattgaatgaatacaatttagctttatatttgtttttttctttcagttgtattcttgttttgctcataaggccaaattttcatttaataatatgtgaatttatactcatgatgaaaatcaatcttatatttttaatctataatataggtgggaatgtagcctggaatgactgacagctgttattatacaaatagcacatgctggcaaaatggcagcaatttttgtgatctgtaattaggatattactgttgtctttatatctgcaaataagtagtaatgtattagaaagtaattggcataatgagttgggaaaaaatagaaacactctcatttatgattcatttaaaacttgcttaaacattatagagtaaaatattctgttcatgtgattttatttgtgctgtgcttaaaatattaaaaatcagatttccaaataggcatgatatatgaagccttaggactgatcatctttcaccccatcaacattttcttttttttctttttgagatggagtctccctctgtcacccaggctggagtgcaatggcacgatctaggctcactgcaacctctgtctcccaggttcaagtgatttctcctgcctcagcctcccaagtagctggtaccacaggggtgtgccaccgcacctggctaatttttgcatttttagtagagatggggtttcaccatgttggccaggctgatcttgaactcctgacctcaagtgatccacctgccttgggctcctaaagtgctgggattacaggcatgagccaccgcgcccagcccccatcaacattttcttttgggaacactgtgtaatggattttagtcaattctacaggaagtaaaacatcaatatttggaagtgaaaaaaattaactgcatacttttattgagttaaagctttcctttaactcagctttttcatccaggaggcacgttattaaaatcttgagtgcactcattgattatttttcttttatcaggaagtccataatgttatataataatatattatatgaacatatagtacaaattatatctattgagtaataagtaccatcaacatcaaagactatgttatttttcacctttaattttgttctttttttctctttaatatatttacaagttctgcaaacactttctgttgctttgtcatgttattatcaatttgtttgcaagtgtcatgtttggtattcctaactagatatgaaagctatttaggttaggaatgaactgtttccttcttttatgaacctttataccttcttacaatgctatccacatagtaggctgtcacttgactgtatattactagaagtgtatatattcagagttggtatcactagtggaaactctagaagctattttaggatgttgtgttttctgataatgaatattcaaatgaaggtaggaatagagagaaccatatgcattgacttatttttggtacctccccaaactaggtcagaatagagacctcaaaattcagtggctaaactgcttcactcttttctttttagtcatatttacaatggcagtttttgatcttcacagaacttcatgtgcatctgcctacagggtgtttctcttctgttggcctcattagctcctttgggaatgtggtcactgctataaaagggccgattgttagattctatggtatagagggcattgccagtcacaaaccaatttacctagcttcatggacctccgcagatcttctcagatccttaaacttctttgttgctagtgataattaactgagagatgatattaatattttagatatatatcctttgacagtcagcttcctttcacgactatagttaatagatttaatcccttaagtaagtgtcactggaagcccaagtaatactagctgaaacaaaagagagggtggtttttctcttacgtaagagaagtacagagatacacagttcatggctcgcatggcagttccctgcttacaaggatcccaaactccatcctccagggcacctcatggttgccatgtggcccccgcagccccagctatcacatccgcagccacgttgcaagaatgaagactggccaaaggcaaaaaaaaaaaaacaaaacactgtactaactgggtcaattgtctttaaagctttttcttaggagctgttattcagtgacatgtgcttcatttagttgcaagagaggatggttaaataattttttagaggggtacattgtcatcgttttgttgtgggtttttttttttttttttttttgagacagagttttgttccatcgcctaggctagagtgcaatggcgcgatcttggctcactgcaatttctgcctcctgggttccagcagttcttctgcctcagcctcctgagtagctgggattacaagcgcctgccaccacactcagctaatttttgtatttttagtagagacaaggtttcaacatgttggtcaggctggtctcaaactcctgacctcagatgatctacccaccttggcctcccaaagtgctgggattacgggcatgagccaccatgcccggcccacattgtcatcttaattaaaattggattttattactaaagagaaagggctgaatgtgtattaaatgggcatctagaacttctgccataccttgatatttaacatattttattttttcagacagggcctcactctgtcagccaggctcaagggcagtagcacaatcttggctcactgaaacctccgctcactgcaatctccacctcccaggctcaagccatcctcccacctcagcttcccgagtaactgggactacagacttaacctattttaagatttgtcctttaaaaaaaagatttgtcctttttcccaaatgagccatggatgtgtgctttatatggctttgtttctgtggtaaacatacacagacctccagccaagatttaattttcttcttctgatgtgattatttcaattttttttaagatttggtgaattacattaaataaatatttattaagctcctctcatcatcaggatactgtgctagatagggattctcagctttggtgctattggcatttggggctggataattctttgttgtgaggggctgtcctgtgcattaggatgtttagcagcttctctggccttcaccctctagttgcaactagcaacccccagtcgtggtcaccaaatttgtctccatatattggtcacatccccagtggggatgaaatcgcccccagaggaccatggtgctagaagatagccccacatttatgtgaattgcctgtttgatttcctgtgaaagtgtatcatggtagattaagtgttgcttgaactgttgcttgctgttggtattacgagcgaagtagtactggtggaattttcatgtgtgctggacaccatgatgagaactgtccacgtgtcacctcatttaatcctcatagcacaacactgagttaaaacagcactgtgttaggagaaggtactaacaagattaggtagtattataacccccctttacagaggagcaaaatgaggcttagagattattttagctgagatctccctgagagcaagcctgagacagtgagtggttcgttgggaggtgatttcaggaagcagaatgatggagaggggagaatgaaacagggaaggaagaaaagctaatacaggagttgatgttgggttgagagctacctcaggggtcacccagggcactgtatatctgaggactctgaggaacagtgaacaatgcatctcagaattagttctctctcccactccctacaggggttgcgggggaggaagctggaacttctccacgtactcccatcttccccaggggcatgaaccccctttccctttacctataagagtagtgagcagtatacacaaagatccagcttttgaggagcttatagtcttgaggagaaagcaatacattagtaagcaacatagtatccaaaaccaatgcatgctctgagaagacagaacgaaggttgtgtgacaggagtgcttggggaactccttagatggggtggccaggatgagggatgagctgagaccccaatggcaaggagaagccagtcatacaaagatctagggtaaaggcattctaggcagaggaactgcatggtgcaaaggccccgaggcaggaacacattttctttgaggaataagtagaaggctagtggggtggaaggctgagaggaaggggatgtgtggtggaggatttggtcaaaagactggggagggacagtcaggtcttgggtaagaaacatattttattgtgcgtacttcttcctacactggagggttttaagcagggttcaagtgatctgcttaggattttattttattttattttattattttattttatttatgtatgtattatattgtattgtattgtattgtattgtattgtattgtattgtattgtattgtattgtattgtattgtattgtattgtattgtattgtattgtattttaagacagtttcacttttgtcacccaggctggagtgcagtggcacgatcttggctcactgcaaccttgggctcccgggttcaagtgattctcctgccttagcctcccaagtatctgggattacaggcctgcgccactgcacatggctaattttttatttttacagcatggtttcaccatgttggccaggttggtctcaaactcctgacctcaggtgatccacctgcctcggcctcccaaagtgctgggattacacgtgtgtgtgccactgcgcctgggcaacttatgattttaaaaagaacactctggctgctgtggagaaaggagtgtggcaggggaagagaggaagccaggaaccagttaggaaggaggctatcatatggttcccacagggccagctacatagtttgtggggcctccagcaaaatgaaaatgtgggggctcttgttcaaaaagcagggggaagagagtactattaaaggtactaaactataaaactttttgtttcacagtccatcaacttgtcatggtgtgtttttgtttgttttgttgtttaatgtcattctaagtaaagaaaaattaaagcttaaaatattagtatgaattttaccattcatctgtatattgtgcaatgctggttttaaatgcaaatataagacatttttagggataaaagacttataaaaaatgaacaaaaaccaataaatcaaagaaaacatttagctcatatccagaatcactgatattaccgaacttacatttcatagttcatacatgcatatgtactttgttcttaccagaactgtggaaatgtggcacaaaacaagctcaactgttttatttcacttctcgttccgtgcccattctaccaacactctctcccctcagcttcctggtagataaaagatgggcaaggaaaaggagctctgggttgccctatgattccctttccttctctcgtcattttcagcatgggtgctaggttaacacagggaagtaacacaaataagagaggatattatagggtttcttggtcatttaggtttctcagaacaccattgccttttttctgtgctcacagtcaattctggttcaaaaggcaagcatggcccatcagccctgtgaacggtccttgctcgctgagttgtagatgtaacactcttacttcatacttgcttctaggctcactaagctcccatgcattgtggtaagctaaaattctgtgctcatgggacatcgtgaacaccatacccacatggggtcttgaggaaccacagacacacatggcacctgtctcctctgctcgtgcacacgtgtcattgtcccatcagatttcacttgcccaagatcaaagattattaagattttcaggatggtgacagcagagcatcagactaagtctgggacctaagtgaggggccctgaaccactgcacaggctacacacccatgaggcctagatcctggtgagagaagacaggatagagacttggctggtacaagtggagaaaaacaaagtgttgagtaagttttggggttagatggtattaccaagacttgttgtggattggatctgcttttggatagggacagaagagaaatcgaggatgacttacttctaggcttattacttaggaagatggaaaagactataggagaaataatttttgaagtgagggaaatacagagttgtgaagtttggatttaccttggtttaagaactatggagctgcagagccaggatttcaacccaggcagcctgacttcagagtcagtgcctttaaccactgcactgcactgttctgtcatgcgggacccacgctgatgggtgcctggtgatcgttgcaatggttctgtatcttactattctctgccctctctggacgatccaccaactgtgtgcagtgagcatccatgcagaggcatgcttgaatttaaacacagttttgtattgaaacctagttaacaaatattcctttaactcacaagcttctcttttgcatctcaattatatttgtttttatagaaaggatatctttatacagctttgctcattcacatgaaaaggaaagtgtgttttcagttggaagatgtggagtcaaaaaatctgaagctgagtttggtatctctcaattgctagctgtgtgtccttgggctaattaattgctttgatctttggtttcttcatctataaagtacagatggttttgtgtgggtgtatgtgtttatatgtgtgtgtacatatatacatgtgcatatatctatatatatgcacatacttgccctcatcatatacaaggctactgtgaagattaaatgagattatagaggaaatccaactcaacaaggcttgagttggatacccattggcagtcactccctatttccctctaccctcaaaccctggcaaccactaatctactgtctgtctccatggatttgcctattatggacatttcatataaatggtatcatgcaatatatgccctttggtgtctggcttctttcactgaggataatgttttcaaggtttattcatgtagtagcatgtatcagtgatacattatattttatggccgaataacatgaatatgccacattttgttgatccattcatcagttgatggatatttgggctctttccactttttggctattacaaataatgctgctatgaacattcatgaacatacttttgtgtgtacatatgttatttgttctcttgagtgtattcctaggagtagaattgctgggttatttggcaactctatgttaactttttgaggaactgccaggctgttttccaaaagtgtctgtttcattttgcattcccactggcagtgtatgagtgttctaatttctctacatcctcaccaacacttgttattttgtcttttttattataactattctagagtggtaagtggtatctcattatggttttgatttgtatttccctggcggctgatcatgttaaaatcctttcatgtgcttatcagccatttgtatacactctttagggaaatgtctatccagattctttgcccattaaaaaatttgggttctctctctctttttttttttttttgagacagagtctcgctctgtcgcccaggctggagtgcagaggcgcaatctcggctcactgcaagctccgcctcctgggttcacgccattctcctgcctcagcttcccgagtagcagggaccataggcgcccgccaccacgcccgactaattttttgtatttttagtagagatggggtttcaccatgttagccaggatggtctcaatctcctgacctcgtgatccacctaccttggcctcccaaagtgctgagattacaggcgtgagccaccacgcctggctggttctctttgttttaattgtcgaatagtaagagttctttatatattttgaatactagaaccttatcagatatagaatttgcaaatattttctcccattctgtaggctgttttttcactttcttggtcttgtctttcgaagcacaaaagttttaaaattggatgatagccagcttctttttctttctttctctttctttctttctttctttctttctttgtttctttctttctctttctttctttctttctttctttctttctttctttctttctttctctctctctctctctcttttttcttttcttttctttcttctttttttgagacagtcttactctgtcacccaggctggagtacagtggcacagtctcagtcaccgcaacctccaccttccaggttcaagcaattctcctgcctcatcctcccaagtagcttggattacaggtgtgcgcccccacgcctggctaattttgtatttttagtagagacagggtttctccatgttggtcaagctggtcttaaactcctgacctgaggtgatccgcttgcctcgacctcccaaagtgctgggattacaggcatgagccactgtgcctggcccacttatttttcttctaagtttctgcttaaagccctgacgtttaggtattcgattcatcttgagttaacttttgcatacagtgtaaggtagaggtccaatttcattgttttgcgattggctatccagttgttccagtcacccaggctggtgcagatcgtgcagtggcacgatctcagctcactctccgcctcccaggttcaagcagttctcctgccttggcatcccaagtagctgggactacaggtgcgtgtcaccatgaccggctaatttttgtattttcagtagagacggagtttcaccatgctggccaggctggtcaaactcctgatctcaggtgatctacctgcctcggcctcccaaagtgctgggattacaggcatgagccactgtgcctggcttttttttttttttttttctgagatggaatcttgctctgtctcccagtctggagtgcaatggctcgatctcacctcgctgcaacctctgcctcccgggttcaagcaattctcctgccttagcctcccaagtagctgggattactggtgcccaccaatacgcctggctaatttttgtattttaagtagagacagggttttgccatgttggccgggttggtttcgaactcctgacctcaggtgatccatctgcctcagtctcccaaagtgctgggattacaggtgtgagccacggcgcctggctttttttttttttttttttttttttttttttttttttttttgagatgagtcttgctatgttgcccacgctggccttgaacttttgggctcaagtgatccttccaaggagctaggattacaggtgaacaccactgtgcctggctcagacagtcttgattactgtagttttatagtaagttttcaaattgaaaagagtgagtcctccaactttagacttctttttagattgttacggctattcgtgttgccttgcaaatccatatgaattttaggatcagcttgtttatttctgcaaaaaaggctgttggaattttgataggtattttattgacactatagatcaactttgggagtattgctatcttaacagtattaagtcttccacttcataagcttgggattgtctttttatttatttagatctttttaaatttcttccaacaatgttttgtagtttcagtttatagtcttgcacttcttttgttaaatttattcctaaatatttattcttcttgaagatactgtaaatggaattatttgcttaattttattttaagattgtttattgataatgtataggaaaacaatttatttttgtatttgatcctgcaccctgcatacttgttgaacctgtttactacttctaacaggtttttggtggagtcctcagaatcatctatatataagatcatgtcatatgcaaatagagatagttttacttcttcctttctaatatgaatgacttttatttctttttcttgcctaattgctctggctagagttccagtaattgatgaatagaagtggcaagagtagacattcttgtcttgttattgattgtaggggaaaaataatttgttcttttataatcatgttagctgtgggtttcttgtagatgccctttctcaagtggagaaagcttctattactaaattgttgagtggtttttctcatgaaagggtgctagattttgttaagtgctttttctgcatctgttaaattggccagttggtttgtttttcctttttctactaatatggtatattaccttgattgcttatcatatgtcaaaactggaatactcttctaatacccccttttttttttcaaaaaggataagtggtgatttactttctgaatgcttataaatataaaatttcttccaatcaccttatagattatattaagcttgtccaacccacggcccaggatagttttgaatgcagtccagcacaaattcacaaattcataaactgtcttaaaacattatgaggtttttgttgttgttgttgttattgttgtttttaagacggagtctcgctctgtcaccccggctggagtgcagtggcacgatctcggctcactgcgacctctgcctcccacgttgaagtgattcacctgtctcagcctcctgagtagctgggactacaggcatgtgccaccatgcccagctaaattttttttgtatttttagtagagacggaatttcaccatattggccaggctggtctcgaactcctgacctcatgttccgcccacctcggccaaagtgctgggattactggcatgagccactgcgcccggccatgggatttttttttttttatgattttttttttcagctcatcagctgtcagtaatattagtgtattttatgtgtggcccaacgcaatttttcttcttccagtgtggcccagggaagccaaaagattggacacccctggattatatcttgcctggacacaagattcttggaatgcagtccttttttcttaaaagtttatatacttattctaggttccagtgtggcatatgaaaggtccgatgccagttgtcattattttgcttttataagtaaatatcctgttcttgctgtcttgaagcctaaaagacttgttctttctagttggagtttaaaacttcaccataaaaatgtgaagaatgtgtcttttatttcccttataactgcctggcattcggtgagctcctttgatctaaaaaactcaattctttcttcacttcagggttttcctatttgattattgcttctgctcttttctctcttgctggaaatgctatttgcttattaggcctcctgaatctgtcctgtatgcctgttatattttcaccactgattgacatttcattatttctgctttgtgatgtgatagttcctttgcttcatattccagtttactagtttggtttttaataccagccattcattttacatccttttggaacttaagccccagagttcatgtttctcataggcaccttctccttgagttttcgtagttattctccttgtgtatccccttaaacattcttattacatttttattgtttcttccattaatttggcttttgtaaaagttgcctatctctccattctggtttccctcctttgaattgctaagtcccttaaatgtctacaaagtttctttgctttgttaggtcagggagtatgtattctcaagcacctgcataggcatggtgggtaaagtctgtgaggccatggtggatattgccagtaacccatgggagctggtctaaaaaattctgagacagcatctgggcctagagagggaaccaccagaaaaagcagtcagcatctgagatgatgcccggagagaagcagatagaccatctgcaaggaagagaaggcttggtttcttagagggtgacctactgttttctgttcttgtccttggtttctcacaaaacctttgcatatcctcttatgacatcagtatacattctcctctccccgcctactcctattatacatctacccttcacctctttgagatggcttgagttgatctgtcttcccagatgaggcagcagtcacatcctgttgctgtgaggtattttcagctcttccacaaagggcctagatggtaaagacccatctcttcaaaattctttctatagtgacttagatttaccttcccaagtatctcctttttaccaatgtcttccaaatattttcattcctttataaatcccttttctgaaatactcctcccctctacccctctgaagttcaactttcttctcagagcctttagtctacacagatttaccagagtgtttgcataattgggtcaggatattcatctgcagctaattttgcacttttaatgtgatacaagctttggtttagggttaatttgtatcaataattatgaataatgtacttatcaaacataaattccttttttgagtgtatatatttcctggatatttatggccatgttctctttaataattcctatatttatcattctaatttacttctattgcctagtccaaggatcattctgcctagtactgattctgcctagtactgatgcattcttttgagaaggaataaagttactgcattattttaatgtaagcttgctttttgatggggcatgcacactgcctcctcaccctcttatacctgaaactttccatatttttgttaattcccctgtccttgaagacatttggattttaagtttggggccttgggctcagtatatcgttgtaatttatttgtttgcaaataattttcttaaatattcataatgaatgacattgtgcattagaggcagataccatgaattgtaatttagatctgttatttaccaccattgctggtcgtgcttggaaaactactttgaattattctcctatccacttaaaatttattttcaagtcctgtgattctaaaatgcttttattcagattatgttatcatatgttcttgtttaattaggttgcctgtcactttgctaaaggtctaattagaaacgatatctctattgtgtttgattcagaatgaatgtactaaaaggcactttgaaaataagataatgtcctcgatgatgatatcctttatttatgccaggtgcctattagtattttgtaaactctccatttcactttagctcaatctaatcctctttgtgatttttttccataattgtagagtaaataaaattcacctactggctccaaaatgtaatttagaaatgcaaactaaatgttcccctgtagggggtgcaatctgttttaaactctcaatatgtgtaatgaaagctataaaccatagagggaactttcgtgggttccatccatattgttcggggcaggctttttgagtgatttgaaaactttgtaaatttgatggtagccaatgtttttctcaagttataaaatttacataatattaggatgaatgcagtacatttatttttttgttatgatttggggcattgtattagagttctctagagaagcagaaccaattgtgtgtgtgtgtatatgtgtgcatgtacatgtatatatatgtatatatgtagagggaaagtatgtgtctgtatatatgtttatatagatatctatatatagatatataggtatatatatgcctatatctcaagttattatatgtacatatatacaacatgtatatgtgtgtgtgtgtgtgtgtgtgtgtgtgtgtgtataaagagaatgtgaggaaatggctcatgcaattatgatggtgggcaagttggaatttgtagggaaggctggcaggctagaaattcaagtaagagttgatattgtagtcttgattctgaagcctggaaatggttagaacttctatgttgtagtctggaggcagaatttcctctctcagaagcctcagtctttgttctttaagttcttcaattggttgggtgacacccacccacattatggagggtaatttgctttacttaaattcaactgattgtaaatgttaatcatatctacaaaatacttttacagcaacttctagactaaaatttgaccaaacaattaagcaccatagtctagccaagttgacacataaaatgtaacatcacaggcctcttgcatatgttattgtcagtaagccaaattaaagataatggtagctagcatttttactaacttggattcaatatttagtgcaactctgcagtaataaagatgtgaattatactgtagcactccaaaattgagtgaataggacatgaaacaaaagccatgaaccatgattcttatcagtttggattttttccagaacattttttgagtcggtcttctgcaatggtattgttctagtttgttctttgaaactcagctttcaagttctgtgtgtgcattcaatattgggcaattttgaacgcatacttagaagagcggccaaaatgtagattagagagagaaggtcaaacaacttctcatcctgtgcaatttctgcaatcctaagcctgttataacacagagtgttccaggacctcccacagatccatgaaatgtattctctgggttatggtctgcatgtgatttgctgttccttgatgtcaagcttgctgttcatctgaccctcaagatccagtcagagtcttcagtcacactcaccctctaatttttttgtatgtgtgtcaccaagtttttgtcttctgtaattcagttcacactaaaaaaaaaaaaactttttatttcccccctatatccctaaagtggttcttcctctttccctcccctcttcttccctctgtctctctgatttctcagtttgatcctgatgtgaataacatactacccttagtcttacatttctaatttttactttctgtgggaaacttccatctatgtttttcttttttcttttttaaatccttagcatagtaaatggaggtttgttgtgtgggtgtgggagccgggggtgcagggggtgggatgtttctttttaattgttagagcttgatctctacatgactttccattagcttggaatcatgtgactcccagggttgggcaggaaattagcttttgtccagaagagcaggatacaacaaaaattattttcttagctccaaaggcctctttgctgcagaagcccaaattgaaagagtggcttagtgattcacttaagtcattagacagcctgctgataagaattagtttagattttgaaaaaaaagggagacttttttttttcagggctaagtataggtctcagttatagagaaaagtaagaggaaaaattgtcatatgcatacagtattacataatattctatgtcataaatcaaattttatgggagtaggcatttgttgcattgtgtcctcatacccaattgtgtgattgtgtgtgtgtgtgcatatatgttcattgaggcaatttgtaatagaaagtttattggattttactttgatttctcctttattaaagtattgaggaaatgacaaaaacaattctttgcttttactttttttttttggcaagctccacttttaaaactgtttatttttacagatgtatttcatcagttcttaagaatgaagctaggaatgtttgctggcttctcagttagtaccacccagaaactgaaaaaaatctgttttcttaaaatatgacattggggggaagtagagaaacttttcatttttgtgacctattggatttaaaaaaatatatttaaataatgcatttttaatattgctgtttaatgtactgcttatcttaattccatattgctttctgactcttggttgttgtacttattattttatagttaataattgtaatggaagggggataaaagttcatgttttattttctctggaaaatttgaataccctgtccatcctagaattgtttcttattcagagagcctcctccaggtaagtctccaagaattttgacacttaataatcaagtgtgactctctgatcagtcaacaagtacacttcttataaggtatgtcttaaaataacaatattaagacattgtttggactcattttctttggaccagactagaataagctgagtgagaaaatgacctggaatggttcattccttcatttcgcaaacatttattacgcttctcagttgtaacaggtgttggcaccgtcctatctcttcagaaactgacagttcagtttgagacaaaaaatgaaagcatttacaattcagtatagagactgttaaaaaaggggttccttttcctgattgcatcccaccatttctggccatcttcactctattcctgccatgttgagctttgaagttgaggaataaagcagaagcaaggatggaaaaaaacttactttgcaatcaataaataaaatttaaatcaaggccggcgcagtggctcacacctgtaatcccagcactgtgggaggctgaggctggcggatcgcttgaggccaggagttcaagaccagcctggccaacatggcgaaaccccgtctctactaaaaatacaaaaattagctgggcatggtggcgggcacttgtaatcccagatattccggaggctgaggcaggagaattgcttgaacctgggaggcaaaggttgcagtgagctgagattgcgcccctgtactccagcctgggtgacaagaatgagactgtgtctcaaaaaaaaaaaaaaaaaaaaaaaaaaattaacagagaaccatggtactacattccttttctcttaaatccttgataaaactaatgtatatcataaagcagagttccccaagttgagaaatagatcccatcctcttttagaaaaataaaatccctggacttccaatgttgactgaaattgcttttattatgttacttacattacttatattgtttattacattacttaatatatacaaacatataatttttgtgcttataactctatacaaataaaactaaaacaataaatataaatagaattacaaaaccattacattcaaatgagcggtgttataattcacttccaatatgttttagtgggatgggtgactctgctttgttgaaatagttgttgatttaggggattatagtagaaagatgttgccacaagtctagttctatggttcatctgtttctgtatttgaattttgataatacatatctaacaaatacctatttgcacaagtattgtaagtacttatgagtattgtttattcaaaacagtattaataattttcagtctctaattggaaattaggctcattaagtctttttttttcagtaaaactctgccagtgaatagtcttggaatagcagattaaagatgtatcacttggtaactctttaaagctccattacttgagagtaaagttagcctgattgacatcttcattaaataggcatctgatgcaattgctgctaggcccaggaatagaaaaaaaatttttttgcatacttatgaccatacttatttccaataaattgatatgagttggtataagcaaagatggcactggtctctttcacctctctgcttatttggaccatagggccttccttctggccgtacagatttccctgaagtcaactgatgtaaactcaattgtacatacaaacgactgcacaaagatctcatgaagtactcagttgcatggggtcatctgaaagacgcagactatctttaaatttctttttatagattatcataaaaattaaaacagaaatattttttaaaacatcaataatttgaagacctttaataatagattcataaatttttgttttagaaatactgttagagtttcctgatggcaaaaaatgaataaatactttgggctccaaaaccaaatttctatgcatttaaacatgcaaatagtttttcaattctaaagccacttaaagtatagcattacagtgatatttaactaatatgaaatatgcattttatgtaagtttgatgtgtgttttattttaagagaaaaacctaactgctgttagttcttgctctgctaatcccatctacttggtatcctgatctacctagtttggtttaaagtatgattgggaagctcagctttggtgtcttttatatccagtcctggctatggttagtgttgtcagttctatgtttgagcatataatttttattttattttactttggaaactatgatgttcaaatcttcatgtattactggttatatttaatttgaatatttcaatattagaagaagtgatttgtttaccaaactctagactcaccagtgtttcaaatatctaaatgatgtctaccatttctttgtctatgtattgcattacagtgcaactttaaggctcattatttcatctttaattgaccagcagggtaagacataatcagtgcttgaaagtgcaaatagagcaaacttgtatgcttcatgatgccaggaactctgctttctttctgtctctctctctctctctttttttctgacttatttctagctaatttatttcgggcaggatttcaaccaggggctgattgtaagctccactcactgcctgccatagtgcttggcacatagtaggtgttcactgtagatgaatgaagggataaacaaatgaagaatgaatgactggtatactagtagtggtgatggcgtggcagtgttagttttttagcagaggcaaattttggattttttttaaaaatctgaagctggagagttttatctcactgatcttcatattgcccaagcttttatttattttgggggatgcaaagtcttttagaaaatttgctaatttcattgactaatacacacagggtgaggatgatctttggaaaatcaagtggatggattgcctttcacattgtagtaaataattgtcatagattacatatcaaattgcacatagaatttctgcttttcaattttaatttgagttcacctgtcatcctgggacctcagctgtaatctccttttccctgcacggctgactgagaatgcatttccttgtgctttactaggactggaaaaacccagttatgatcatcttagtagtggtctgtcttccaggctttattatctgcttcccaactctcagcatcaaaacaggagttaccatatccaatgaatacaaagaaaatggcttaatttctgacacatagcttattgaatgtgacccaggcagcaaggatgtggtacagaggagctaatatgcattcctcattagtcagctcacccatgtggtcagcagattccttttctaaagtagttgtgtaatctgcagcagcacagtagccaaacacagttgataaattacgtttatttcattttgacaaaaagagtaaatatattcttgtacaaaaatattcaaaaagtttaatgtaaagaagtaaatttaaatcacctgtaatctcaccatctagaaatacactcatttaaatagaagctgccactttactttttttttttttttaaatgtcatggctgttttttctccaacttttattttaggttcaggggatacatgtgcagatttgttacatgggtaaattgcatgtcacagttgtttggtgtacacattatttcattactcaactaatgagcctagtacctgatagtttttcgatggtcaccctcctcccaccctccaccctcaagtggtcgctagtgtctgttgttcccttctttgtgtccatgtgtacccagtgtttagctcccatttttaagagagaacattggtatttggttttctgtttctgcattaattcgcttagcataatggcctccagttctatccatgttgctgcaaaggacatgatttcactcttttttgtggctgtgtagtattccatggtgtatatgtaccacattttctttatccattccaccattaatgggcatctagatggattccatgtctttgctcttatgaatagtactgtgataaacatatacgtgcacgtgtctttatggtagaatgatttatattcctttgggtatagacccagtaatgagatttctgggtcaaatagcagttctgttttaagttctttgagaaatctccaaactgctttctaatttattcccaccagcagtgtataagcattcccttttctctgcaacctcgccagcatctgttattttttgactttttaatagtagccattctgactggtatgaggtggtatctcattgtggttttgatatgcatttctctaatgattagtgatgttgagcattttttcatgtgctgttggctctgtgtatgcgttcatttgagaactatctgttgatgtcctttgccccccaccccacaccccctacttttttttgagacaggatatcactctattgcccaggcaggctggagtgcagtggcatgaacgctgctcactatagcctcaacctcccgggcccaagcgatcctcctgcctcagcctcccaagtagctaagaccacaggggcatgccaccacacctggttatttttttatttttatttttttgtagcgacaagatctccctggtcttgaactcctggactcaagcagttctaccacctcagcctcctgaagtgctgggattacaggcatgagcgcccatgcctagccatctttgcccatttttttaatggggttgtttggtttttgcttgttaattcgtttaagttccttatagattctggatattcgagctttgttggatgcataatttgcaaatattttcttccattccataggttgtctgtttactctgctgatagtttattttgctgtgcagaagctccttaatttaattaggtcctacttgtcaatttttgtttttgttgcaattgcttttggagtctttgtcatgaaatctttgccagggcctacgtctagaatctcatttcccaggttttcttctagggtttttatagttatacatttcacgtttaagtctttaatccatcttgtgttgcttttttatatggtgaaaggaaggagtccagtttcaatcttctgcatatggctagccagttatctcagcaccacttatcgaatagggagtccttttcccattgcttgttattgtcaactttgtcaaagatcagatggctgaacatgtgtggctttatttctgggttctctaatctgtttcattggtctatgtgtctgtttttgtaccagtatagcacacttttggttactgtagccttgtagtgtagcttgaagtcaggcagtgtgatgtctctggatttgctttttctgtttttgttttctgcttaggattgctttggctattcaaacattttggttccatatgaattttagaagagttttttctaattctgtgaaaaatgtcattggtagtttgataggaatggcatcaaatctgcaaattgcttaggacagtatggccatcttaacaatattgattcttcctatctgtgagcatggaatgtttttccatttgtttgtatcatatctgatgtttttcagcagtgttttgtaattcttgttgtagagatctttcaccttcctagttagctatattactaggtattttattctttttgtggctactatgaatagaactgcaattttggtttggctctcagcttggatgttactgacacatagaaatgctactgatttttgtatattgattttgtatcctgaaacttcgaagttgtttatcagatctaggaacctttgggcagagactttggggttttctacgtatagaattacattgtctgctaagagagaaagtttgacttcctctcctcctgtttggaatccttttatttctttttcttgcctaattgctctggctaggacttctagtactatgttgaataggaatggtgagagagggcatccttgtcttgtgccagtcttcaaggagaatgcttccagcttttgcctattgagtatgatgttggctgtgggtttgttatagatggctcttattattttgaagtatgttcctttgatgcctggtttgttgagtgtcttggttattttatcaaaagaacttaaaaatacattttatttattacccaagtaatacatgtttacttttagaaaaatcagaagatatagattaaatcaaaagaaaaatacttactatgataccatgataccatcttgtagatagctgctattgtggtttgggcatatattcttccagacttgtaacttcacaataaattgtgtaaatttataacaaggtatataatttcttataaaactggaagcatactatgcatagttaggtgtaatcatttttctgactctctttccatgtcagtaaatatatttccctgtaatcattactaatggctgcaagacattccattgtatttatgtataaaataaataaatgtatttaataaagcttatactgatgaaaattaggtcatttaaaaactgtctttatatggagtttgtgccaaaaaacacaaacattttacatttacatttacatttctgtgagtccaatctgtcagtcttgttatggtttctgcatttgggatcaggctgaggaattcctccctgatacaaatatttttaaattattcagctctgttttcatctgttttaacactaaagactttagccaatgtagaatttttcttatgtgttatgagccaggaatctaactttaattttttctaaaaaactttgttaaataattcatccccctgctaatttaagatgctggttttgtcacaagcaataatccatataaataattaggtctgtccctaaacttttatatttagttctatgatctatttctgtgccagatttatactgttttgattatcgagggtttataatatgcttcagttgatgtctggttgagcaaaacccctctttttctcaaagttttttggcttgtctaacagctgatcatcttccagatatgtctagaataatttgtcaaattatacaaatattttacaacttgacattttattggaattatattaaatatgaagattaatttggggagagtgacatatttataatattgtcccatcaaataatataaaatatatctctattgatgaatcttttttttttaactcctaatcacgtttacatttttttttttttgagacagagtatcgctatgtcacctaggctggaacgcagtggcgcagtctcagctcactgcaacttcagcctcctgagttcaagcgattttcatgcctcagtctcctgagtagctgggactacagacacacaccaccacacctggctaatttttgtattttggtagagatggggttttaccatgttggccaggctagtctcaaactcttggcctcaagtgatccacccgccttggccttccaaagtgctggaattacaagcgtgagctactgcactgaggtctaatcacatttttagcttgtcatatagctactgcacattcttgttaagtttattttacaatatcttattctttgtttctattgtaagtggaagccctttctcacttgctctgatgattactagtgcaaatatatgtgaatctgattatatttgtttcatatcatacttgtaaatcatttatttgttctaatatatttttattttatttccttaggtttcccgtagaaacagtaattccattctttagatctcattttcctttcttgacccattgcatagattcaaacctggtctagaaaagtgctgaaaaactgtggtgatatcagggcttcctttccttattcccaacttcagagaggctttaggtcatcactgtccaatagaactttctgtaattacaggagtattctcccaatgtctaatacttgtggccactgagcacttgaactgtggctgatgatactgaaaaaattaattattttattcaagtaaaataatattattttggacagcacagctctaggttttttgtttgtttgtttgttttgagacagggtcttgctctgtcacccaggctggagttcagtggtgcaatcacagctcactgtggcctctacctcctgggctcaagcgactttcctaccttagcctcccgagtagctaggaccacaggtgcacaccactgtccctggctattttttttttgtatttttttggtatagatggggtttcaccgtgttgcccaggttggtcttgaattcctgagctcaagcgatccccctgcctcggcttcccaaagtactgagattacaggcgtgagcctgtatgtgcctggccagagtttcactattaattatttatttcagatgaatctttaacatgataaagtcagcttggggaaaagatcatgggttaaaaaaaagtaagagtattacgtagataattgtcaaacacatgcctttagcaggatgtgaaagggagtagagaatagcatgataactggagtgagatgagggttgaaaaaagctagttttttgtctgctttgttaagattaagtatggctccacatccaactctttatttatcttccccaaatataccatctcactgtattaccttctggtaatattgctaccattatgctactccaaaaccttgttaccactttttgagttctctttctcccttgtcccctaataatgcaaactctccctcattctacccccattcccacaacctgtatctcacccagttttcaagttccttcacaagtgtaccttctgcatgaaaaaacttgttcttgatctcctcagtgaaaagtagtcttgttcttcattaaaggtagaattaatttgtgtcttttttataccacttagtcctgcacattgtcttcttcctatttgttaacatatctatgagactgtacactctgaggatctcatccttgactccttgactgattgacctttctatccttgttggtccctctgctggtgtgctacatatatattgtatacctgtgcttagtaaatatttcttacatgaatcacaattcaacttgtattaatcatttatgtcttgtattcaattgacagcttctggagaacagggatcatatgtatttatttttgtatcttctgtgttacagcatgatactaaacattgaagagttgtttggtaattattttaaaatttttattcataaaagtcgtgttaagatgttttatttaggattgcattttgcttcatttggtggaaatccaattaaagtaacataaccaaacaggaaggtttttgtgtttttttcctttcaaataacaagaagcctagaggtagtcagtctaggggtggtatagtggtactaggttctcatcagtgtccccagtttttctgtccttaacatgtagcttttgtccttgagatcacatgaggcttttccacctccaggcatccatatttatgttgtttctgtccctttctattaggaaaacagtagcttttctggaggtctctacaaataaacttctgctcttatctctttagtcagaactagggtcaaacgggcatcttccagggagttttgaaaggtattattaactgggtgctttccatccacattaaattgggatttttttttggaaggaagaaagaaaaaataaatcttggatgggaaatctagagtctatatcttggatatggaatttatacttaaagccattaggatctacaagggcatgatatgatacatgtgaagatttcaacaaatcaagacaattttgtaataaattccatatgcacagctggacagtaagtgctatcaaagattagaggtagatgagctccctgaaagatggagttgactagaaaatcttcagtgtaagaggtgggacttgagcagacccttaagagataggtcaaatattatacagaggcattgagtgcttgttttgcaagtgagaagcactttttttttgtttttgaatcattagaccagcttagcaaaaattaatgcactcatattatagggcaatagaaaataagattggaaaataagttgagacaacataatggaggtctttgaatgccaccgtgaagagtttgggtttgaggttgttcaaacaagcaaatctaatgcaggtttctgaaaagaggaataatatgagggagtggaatagaaatgacatatattaaagtttaaaagaatcattcacagattagttcattcgaattaattaatcactaatgttatatctcctaccctgtagttaagttcatagcactttttttgttttgtttttgagacggagtctcgctctgttgcccaggctggagtgcagtgaggcgatctcagctcactgcaacctccacctcctgggttcaagcaattctcctgcctcagtctcccaagtggctgggattacaggtgtgcgccaccacacccagctaatttttatgtgtgtgtgtgtgtgtgtttgtgtatgtgtgtgtgtatatatatgtgtatgtgtgtgtatatagatgtgtgtgtgtgtgtgtgtgtgtgtatatatatatatatatatatatattttttttttttttttagtagagatgggtttttgccatgttgggcaggctggtctccaactcctgacctcaggtgctccactcatctcagcctcccaaagtgcgggattacaggtgcaagccaccatgcctggccaagttcaaaacacttttgagcaaagcagttgattctaaggggtccaatacctaaaacagatatttgatattgttacatttgaggccctgagttatagaatagtgaagctctagaaataaaattttctgttaaacttattttttatattgccaaggaattctttgcttctgttatcattacagcatattttaaatattgtatcagcatattttatcatattaatacccaactgtaatctttcttaattagcttgcactaaatgatttataaaatgattgaaaacacttgtgtgcttttgactaaatgtgttttattgtctgttattttctcaacctagaattttaagtctattgaaaaatacttaaatttcaatgcagttatgttgactgaatgttttattttcctttttaaatcaatcttaatatattttgtagtttcttttaagtgaggtgtgctggagcatttcccagatacaattatgaattttttaaaatgacagatgtttattcaaatgtaaatctcatcaaatagtaaagatttttatcttctattttaataatatcaattacttctgatggtttgacatagtttgagtagagaaacagtctgattcaattgaaacacataaaatatgcttgatataatttcctacataattataaatgaacttctgaagtctgagttacctcatttagtatttggaatatcagaaattttcacttcagaacattaaaattagtgccttgtgtctttagactctcctccttaattaccacaagatcttttctttcagggtcttattaatatgaatttgactctatgtaaaaatgtagatgtagaaataatttattgcagtttctcctaatcagttaaaattttagcattcattgttgggtactttttgattactgttcagccctatcccactgatgttgggtttggccataggatttgctttggtcagtggaatgaatgttagtgatgtgatataaagccttaaatatgcttgcatggtttggcttcagtttttttcactggtcatttgttatgagaagagctttccctgggcagctgctgccccttcaccttgggttccagaattaacacaagtgaatcgaacctgagcccaacctatagcctgaaccaagccacccaaccaaacccagcctagatcagtcaaactgtagtcaacatacagacttgtgagcatgaaaataaatgtttgttattgtaagtcactaaatttggggtgctttattatgtaggattgttgtcgcaatagctgactgatatgaccattactatttcaaaaagcacatctatatattttcattaagaaaaagtaaaattatagatggctaacctatcagttctctattaattgaaaagtagtaacacttaaaacacgaattataaaacaccaattatttgagagtttttcttggctagtggccattacaaattttattgaataaaattctttttttttttttttttttaaacacggtctctctctgttgcccaggctagagtgcaggggcacaatcttggctcaaagtaacctctgcttcccaggttcaagcgattctcctgcctcagcctcctgagtaggtgggattacaggtgtgtgccaccacacctggctaatttttgtatttttagtagagacaaggttttcaccatgttggccaggctggtctcaaactcctgacctcaggtgatccactcgcctcagcctcccacagtgctgggattatagacataagccaccacaccccgccagaataaaattcttgtaatggaacttgaggaataagttgttgaggtacttattattagttttaaaataaacctggctggcactacaagtaatcacaaaatgaaatgacataggaaccatggctggcatttgttaagggcctggccacacaagtgtttggcattcttctcttctcctcacagcaaatctgtcaaatctgtcaggcagtcaacacatatttattgagcccttaccatatgccaggtattgcaaagtatgtattaccctatttttgttgcatgaagaaactgaggctcagaaaagttaaatgactagtttaagcctcacagctaggaaagggcttgagttttaggacttgacccaagtccatctgactccaaaaatcatgctattatcatcactgtgttatttgtgtttgggtggaactaggagaaaaatagaattacaggccaggcgtggtggctcatgcctgtagtcctagcactttgggaggccgaggcaagtggatcacttgcggccagaagttcaagagcagtctggtcaacatagcaaaaccccgtctctactaaaaatacaaaaattagccagttgtggtggcacatgcctgtaaacccagctactcaggaggctgaggcatgagcattgcttcaacccaggaggcggaggttgcagtgagccaagattgggccactgcacaccagcctgggtgacagagcgagactctgtctcaaaaaaaaaaaaaaaaaaaattacaaactgatttacctaacatttgttggtgtgttatctctagtcatttgctacataacccagaggtcacccagaatcactttagcattcagaaatctacatataaattagctcagacccaaattgctgttttttagcatgtgaaagtctgaagctgtccgtacaatttctactaattccccggccttacagtcatgtggtccccttcatatgtccttggaggccaccttgatttgccatgtcagtctgagtgtaaagctcaaccctttccagtttctaccagacataccttcaccaagcattttctgagttttggtgaggacctccatgcaaaacacgagatctccaccattctttccctctcaacgttgccccttgattgcaacaccatgccccttttcatattctttactctctgttttgcagattagcttttcccttctattgaagccttgatagcccagatacccaacaactttggagtcatgcctctaccctcaagctggagtgtcagtgagtgccttctttgactctgtctcattacaaagcaaaaatagtgagattctcttgggaaacagcatcagttggaattagtctcatcagtcagacagcccccatttagctcaattttaatttttaaaatggaatttcattgaattttcaacattgacaattttgttcaactaaccttaaatggtgagaaccgaaagcatctaatataagagctactcttttcttcttagattagaaataagatactttacataactaagaaaaagtctatctttagaattttagttacttcctacctctttccaaaaatgtgacttataaaaactacagaataaatctggatataagctttttctgtagtttttcccagaccacttttcctattagctattcagagtgaattttaggagcttgaaaacttgatatgtttatgagcccagaatttagacactgctataaatttaaattgtctgaagcacttgattctacaacactgtgttggaaatggttgaagaactgatttccacttctggataagccaaactactctcttatcttgcaaatttgccactaaaatcttaattcctgtcagaattattttcagtgggagaaatctgagtacaaattgaccaaaagaactttagttctcactcatttctaatataattttaattagttcatctttaatttaggaaataatttttctagcaacttggcagacattggtttcttgccagatactaccttatcttgagcttgtgggaaactcatctttaatattccatgagtatagtaaaactgtgtttttaacgtaacaaatattgttttatttattaaataaaacatttatttgggggtatattcttacctaattaaagagaatgagtaaaagatgaggcagaccctgaatgtgagatgcgtttgaaaatggggtgtctcaagattctgtaccgggacattggggttaggcttctaaatactgttagtccagtcttattactaagattgcataaagagcattttatttttgtgtgacctagatcaaattattttgatgtaggatttttcttctcagtcactttccaagtccccagccagcaatgccccacccaggcctcattcagccacactggcatgccccagttttcctgtggtatagcttgtacctgtgttcagcagttcccgaactcttgtcctgcacccaagaagaatgaggatgtgctaaacattgaagggtgaggaaggtggagaagaattttatagagctatgaaacagttttcagcagagaaaggatgcgggggttgtccccctacccaaaggtgggaatgtcccctgtgcagccaggcatggggccttctatggactcagaatggggagtgcgtgctgattggtttgtgtgtatgcaaaaaaggttaaagcaaagacaccactcaaaggtgggcatgacagtgtagaaaaccaattagaaaagggtaggtatatgtaaaataggtgaagggtggggatcaatcaaaggaaagcatgccaaacaggaagacaagttcttaatccagtctgaggatttaacttgtagcttggctttcaggctttaaactttcttcgccttggaggtggggtttcaccgggtaccagcccgtctgcctaggcatttggctgcctcctttctgtatcaatttgaccttcctaaacttcttattcgttatcttttaaataagtattatgtctgccctccctaccttaaaacgttgtaaggtttagatgaaagaaatatacatgaaagtactttgtaacgtacagtacctacagacattagtgattatgtttgtggggcaaaaaaagtaggcaggatggaagaaaggaaagcaaggttgctcttaaattcattccagcagtatggctggaaatgaataatcttcaaatcctgagcagttgcaagataaggaaaggattaccattctgggggcacagcaatgacagggccctttaactggccacagtgattgccagttccaaccatttcaggtaatattgtctacagtgtgctgagtgccatgttagttactagggatacacaccatgacaagaaacagtccttcgccctcaagaaattctctatctggctgtggacaacacggctgtgtgtctctagcaggggtgagccaggatatggcaggctgggtggagcatggttggagcagaaaaggagctggttattgtgacagggtctggcatgttttttccatcattaaatggagtgatttaaaaataatacaccatatttatatttttaagtcacagagaaaaacaagggtgttttaaaatttggttaattacaaaatcctgtaataacactttttttttcttttaatacatggggagtgacagcatcagcatgatcttctttacagttttgtcatgttttaggattttactatgctcattttaagtttcagggacattattgtcacgatgaagttctactctgttgcttgttggtgttctagtggtgcaacactaactctttggatgtcatttttaacttcgtcttttgtattcaaaagttgaattgctagtgatctttattttggtagtttttaaaggaaataagtgtataatatattatccatactaaatgagaggacccactgacaaggattacttccaattaatggtaatcattttggggtctggaataccttaagtattttttttttacttgtttcttagacaaataataaaataagcttttactttctgaatatacaacaacagggatggagtgaggggagacattccagaagatgccaatagtataagttgctaacctaggattaataactcattgcagaaaattcaggagatgacggtctagtctggtactgaattaaattatctacggtatttaatgttttactctagtagatttgctggtttggtgtctaccttaacttaaatatttagagaaaaatatggaaaagtttgtgagaaaatgaagtcttgtataaacatccttgtcctaattgttcacctttactgcagaaatcccagactggcaccagtgtggccgaagttcacactgtgttactataaatttacatgatgtagtggatgtcttaagaggtggaggcaatcccatattcaaaattgaaaacaaaaaaaatatttaaatacccaagtgagtaaaaatggactctcctggataagtctggaccatctttcaaagatattgagcgtctggaatttttatgtgcatttcgaggctgcagtttcctctgacagacaatccattgttattactggctgtaggcagtcctgaaagggcagagtcaggaaagacaaagaatttacagtacagaactttcaataatgtgttgatgtcaggaaaagagttgagccatttctgataagaaagaagtgttaatgttaagcagctgtaaatgtactttctgtgatctactcctgcaaagtaacagcagggtatttcttaggcttgggtcacaggatgaatttgagtaatcaatccttaagtgaaagcaaagagagaatactggaagatgtgacagaggtcagccctgggaatggaacatgtagtcttttccaatttgatgttcttgtcccaggtttagatttggcagcagctacctccctcctttaagtcctcaccaccattcccttacaacaaatcaacatttatcagtaactgtgaaagcacagtatcaaaattatttctaaattagagtttgagaaatgattttgaaatttatatagcattcctagtactcaggccaactcttcatagcaacacactcattttgattcttaaagaaatgtgatatattttttcctaaatagatttaaaattttaatcaacacatttggcttatatgatgaaaaactgcctgaggctatggaattgggtaagaacttgttattttggtgaaggtgcatatattctgaagacgtatctgcaagccattgggtacaaatactgaatgtgagtaaaatttggaagttgactgcttcagggttccaaattgggccatcaatattaggatatatataattttaaatccagtcttaaacctgtgtatgttcagaaaatcttttgtcaaagagtgagtaataagtttctatttttccaaaagcagtttaactaagtattaggtgttcagggaccagattcttattcgagtcttatttttaagagtttgaagtcaataacttattttctttgtccctcatctcttttattccacttataaagtatgcacactgggctgaacaaagtggctctcgcctgtatcccagcactttgggaggtcaatgtgggcagatcacgaggtcaggagatcgagaccatcctgaccaacatggtgaaagcccgtctctactaaaatacaaaaaattatccggttcatggtggcgcgtgcctgtagtcccagctacttgggaggctgaggcagaggaatcgcttgaacctggaaggccgagactgcgccactgcactccaccctggcaacagagcaagactccatttcaaaaaaaaaaaaaatatgcacactaattctggctctcctgcttttgaaggtatcacacatataatactctttgtgataaagccttaaattatcagagtggtaatactttaaggctttattaatccaaagtaagttgtgatattttaaggctttatcaatccaaagtattgttacagatatgaatagtggtacctacattgcatagaataggaactgaatcatgtaaatcaatgctacatcatttgaagtcttgcaggaatggacaagaccagtactcaaagctaacaatattttggcctgattttacataactttcaaatcatcttctcagaaagctaaaccccagctgctcttcaagataagccatgatgacagagtagctataaaagtagtgtctcatagataaagagaagtatgaacaggttcaggctggctgaataatagcccttttctctttgaaaggaaatggaaggaatgtagctgtatttgcaggtaatgaatttcaatcccttattactttctttgggacacatttactacacactgcattaggaaggaggaatttacatttaagtatggaagtggatcagaaattagtagatatataagatcaggcagatctttatcattgagcaaaggtctaaagatagtagtgcagtctgtaattctgtaagtggatatattggaaccataacaacagcaacagctaacatttattaagtgctcattatttattagatacagtattatgtatcatctgttattcatgtgtaaggcaggtagtgtctttattcccattttggagatgaagaaatcaaggtatacagtagttaagaaacttacttaaggtcatacgatctgtgctagctttcagattcagggaacttgacttcagaaaccatactcttaaccagtatgccaaaccaccttctatgaatttgaaaccacctcccatgaattgatgaattcataattcatcagttggtgttaatggaagtggtggaatatagccctgaggccaagttctaaattgtttaggaagtgacccaaatactgagataatcataacaaaaaaagaggagagaaaagaaaaaaaaggaaggaagggagggagggagagaaagaaaaagtccattccaacaggcactgggtattggatattatgggagtctcccataaagtataaggggcccataaccaggggactgagacttcacagtaaggaacccagccagtagaaactgggatacagggcaaggaaactttccagtaacagtggactggaataaaatcagagcaaaatcagagataaaataattcaaagtagaggcagcatttcttgacaaaagatttcttatgttatctcccctactgagggctgaagttggccccagagtgagatgcatagttataagtcagggttaatgtaatagattcagctcagaggcaaacagaagcaagggcaccgagccaggtaggccattacaaaatggcccaactgggttagagttccaggcaagagacttattttcctaactttactaacattatttctccattgtggcagctcccgcttctgtgggacatggcatcatgtagcagtgacattagatacccaaagactgtggaacagggagatgaagtttcataacataattacaaaatttaacagcaccctttcacatattttatggcccaatctatgttgttattcttttattattttttaagaaatgtagtatgttatgtaatatactgattgcagagttcacgaagccatttgggagattactgggaggaataatttgatatgaaattattatttaattatatcactttcttattctgtcttatactaacttttgcagaatgtatattatttggagagccttgtttgatatccttaacagacagagtaaacattcaagatagtacttttaggagagtagtttgaatagttttcatttgctaattccatcctcttttttctgtgaaagagaaaaacaaaaacattttattttgttttctttcatgtagtgtttatccattgcctccatattttataacagcaccaaagactagtttttctgttctgtttaaagctcatagtttcttagaactagttgtaaatactgttaagagtcccccaaacagttttttaagaacctaatttagtttcatttgtactaagaagctgttttctagatgactaacatcatatagtgttgtttccatcaaaaatattagtctggcatttgtcatgttctgtccactaaatagctttgttattattgaggtctaagctctgattttttatcttatccaaattcctaccttaggggtctagggagtcatgtcctacaaaccataaattctcatgagatgggttttatttgaccctatatattgtgacttacttttcagtctgactctggcataacattatgagacaaggaaaaaatatttaaccccaaaatatatttccttgttataccttgaaattgccctgcaaagtttcttgtgggaaaaatccacattctatagagaatccccttccccttttgttttccttcctttctttccagatacaggagttaatcaactaagaggtaggcacccttttaagtcccaaaagaaacaatttacaacccccgctctctctgaagtctgctatctgagagcttcctctgcacaataaaagttggtctccacaatcctttaccttttttttgtttcgttttttgtttttttgagacggagttttgctcttgttgcccaagctggagtccaatggcgtgatctcgactcaccacagcctccgcctcttgggttcaagcaattctcctgcctcagccgcccgagtagctgggcgccaccacacccggctatgcgcctggccacacccggctaattttgtatttttagtagagacggggtttctccatgttggtcaggctggtcttgaacttccaacctcaggtgatttgcccacctcggcctcccaaagtgctgggattacaggcatgagccactgtgcctgcctcaatcctttatctttaacctgaacattcctttctgtcgatccaagtctttagacaaactccaccaattgtcaaccagaagatgttggaatttatttaaagcctggaagccccgctttgagttgtcccacctttctaaatcaaaccaatgtatttctttcttttcttttttttttttttttttgagtcaaagtcttgctcttgtcccccaggctggagtgcaatggcacaatctcggctcactgcaacctctgcctcccggattcaagcgattctcttgcctcagcctcccgagtagctgggattacaggcgcctgccaccacgcccagctaatttttgtatttttagtagagacggggtttcaccatgttgaccaggctggtcttaaactcctgacctcaggtgatctgcctgcctcggcctcccaaagtgctgggattacaaatgtggagccaccgcgcccggccaaaccaatgtgtttcttaaatgtatttgattaatgtctcatgccttcctaaaatacatgacaacaagctgtaccctgaccaccttgggcacacgttctcaggacctcctgagagctgtgtcacaggctgtggtcactcatatttggctcagaataaatctcttaaaatattttacagagtttgactcttttcgtcaatattatgaaatgtgtctgagatacatatacaaaagaaaaatactaagatatagcatgcatccaagaaatgcagtatctttctgttaacataaattatctaaattcatataattcatgtgcatttctgagtctcatctcacatcagacaggcagcctgagatgaagaatgagcacgggctcaggttgggacctggtaaaagcaggcatcaccatttaaggagcagagacctctgctaggttgtttcacctctctgagtttgtttcctcatgtatcagttgggaatgatatcgaatttgtatcatccttatgaaaaaacaaatatatatgaagttgcaaatataggttttcaacaaaagttaacagctatcactcattggcatctagactttaagatgattccactcaagagagcgacataattctaaataagaaaatgcttttgatgtaagagtccatttcctgcctctcgggcacgccaccacagcctgaggctccattagctgttgctatctgcagttagtgatttagcttggagcatatcgggcgctgtactaagtgatctacatatgttatttcatttaataacagcaatcctttcaggaaattttggtttctgactttctaccatgactttgacctatgtacattttcttttagactatgtattcttttgacttttgtctgccttattctagccattgctttgcacaaattatggcactttatgtcatcaaaccatattagttaggaggctgtgggatgcaaataacagagaaccagacttgatctgtcaaaaaataaagggaatttttttcatatacacaactggataattcttcaccgggttctatctctgtgattcttttcactctgtcttcctccatggctctgcttgttgtatcagaaatggctgcagcagttcctgacatgacatctttgtactacactctccagaggaatggagagttgctgttttcccagaaagaagctcttggcttccttcgacaggaccagtgtaggtcttgtgctacctctgacaccatcacttagaccaggggcttggggtcattgactggcttatccctgctcttccctgagtcaatcaacggacaagaggaatggtgttacattgcttagtttagacctacacccgaggttgtggtccatgtcacccaaatcgcatgggcatcatggagcaggaggtgaaatgggtacaggaaggccgtcttgcccccagtgtcaaaggaaatgggtattagtccattttcacactgttataaagagctgcttgagactgggtaatttataaattaaagaggtttaattgactcacagttctgcatggctggggaggcctcaggaaacgtacaatcatggcagaaggcaaagggaaagcaaggcatgtcttacatggcggcaagagagggagagcaaagggggaagtgccacacttttaaaccatcagatctcatgagaactcatttactatcacaggaacagcaagggggaaatccgcccccaagatgcagtcacctcccaccaggcccctcccttgacatatagggattacaattcgagatgagatttgggtggggacacacagccaagccctatcagaatggttacaacatttcacttttaattatgacatgttgctagagggtttcttttaaaatttttttatcagtttaaggaagtcatcttcacaattaagtttttttttttaatcatgaatggaagttgactttcatcaaatgttttttctaaatctgttgagatgatcatgtggatttttttctttattctattaatgtgataagttacactcatttttaaaaacaactttagctataatggcatataataaactgcacatatttaaagtatatagtttgatagcttttgacatatgtgtatacctgtgaaactatcaccataatcaaaataatgaacatatgtatcattcccttccaaactttttttttttttttttttgagacagggtctcacactgtggcccaagctggagtgcagtggctcactgcaacctctacttccctgggctcatgtgattctccagctttagcctcctatgtagctgggactacaggcatgagccaccacacctggctaacctggctaatttttgcattttttgtagaaatggggtttcaccatttcctcaggttggtcttgaactcctgagctcaaagtgatctgcccaccttggcctcccaaagtgctgggattacaggtgtgagccaacatgcctggccccaaacattttcttatccctcctgtaatccctgtctccagccccttccctcctacccctgctccacacctgatctactttctgtcactacagattagttgcattactaattgaagttttgaaggttaaattaactttccatttctgaaataaaccagtttgatcattatgtattagctctctctcttacattaagggaacttcaaaaaggtcacgggaaaatggaattaaaagataaaaagaaaaaatataaactttatttttcaacataagctctgtcaagtttaagacacttttataagtgacaatgtcagccatttagtccatccctaaagaactgagggtcctgggatttaaccatgtcagtgcagtctttttcacattagtaactgaagaaaagtgggtgccctttaatgatttattaagattagggaacaaaaagaagtcagaaggagccaaatcaggtctgtaggtggttgcctaatgattttcccgttgaaactctggcaaaattgtccttgtttgatgataggaataagaggagtattgtcatggtggagaaggaccccctgttgaagctttcctgggcatttttgtgctaagcttttggctttctcaaaacactctcattgtaaacggattttatcattctttggctctccagaaagtcaacaagcaaaatgctttgagcattctcaaaaactgttgccatgacctttgctcatcactaatccacttttgctttgatgggccacctctacatcttggtagccattgctttgattgtgctttgtcttcatgatcatactggtaaagccatgattcatctctttacaattctttgaagaaatgctttgggatcttgatcccacttgtttgcaacatccattgaatgctctgcttttgtctgcagctgatacgaagtgcaatggttttggcacctaccaagtggaaaatttgctcaactttaatttttcagtcagaattgtgtaagctgaaccaattgagatgtctgtggtgttggctgttattttttcggttaatcattggccctcttcaattaaggcatgaacaagattaattttttccttaaaaattgatgcagatggtctgcccactgtgggcttcatcttcaacattgtctcatcccttcttaaaatgagttatccatttgtacactactgatttctttgggggattgaccccacaaagtttttgtaaagcatcagggtttagccattcttccacccaagcttcaccataaatttaatgttcttgtttcaattttagcagaattcatgttcctctgatggggctcttttcaaactgatgtcttatccttcttagtgcctcaaactagatcctgttcagacattttatgacaagttagcataagtttattctgatgcaaaaaacccctgaaatctatgcataggtttttcaaaatacacattttccataaactttttgaagacccctattatttctgtatttgtttaaccaacattttgcttctatgtttataaatgagattggggtgtaagttttctttctagtaatgcccttctcatactttagtatcaaggttatgctagccttgtaagatgagctgaggatggggagaatgtttcctattctctgttttattctctggaagaatttatataagacaggtttttttttttaattaagttttggtttgaatcaaccagtgaaacctcctagactcacaagttttttttgttctgttttgttttgttttgagatggagtctcgctctgtcacccaggctggagtccagtggcgcaatctcggctcactgcaagctccgcctcccgggttcacaccattctcctgcctcagcctccagagtagctgggactataggcgcccaccaccatgcctggctaaatttttttgtatttttagtagaggcagggtttcaccatgttagccaggatggtctcgatctcctaacctcgtgatctgcctgccttggcctcccaaagtactgggattacaggcgtgagccaccgcgcctggccaacctatagggttttttttggaaagctttaagttattaattcaattttaaaataaataaggggttgttcacagttttcttcttgtgctgttagtttttataaaaggtatgttttcttgactttttaattgactgtatgcacgtaatatgcatgcagcatgagcaatgagagtgagaccctgtctcaaaaccaaccaaccaacaacaacaataaaactctataagctctgtagtgacgtttcctcttttatttctgatattggttatttaagcttgctttctgtatttcttcattattctccatgggggtttataaatttattcatcatttgaaagaaccaacttttacccttattgatcttctctattgtatttttgttttctgttttacttgttgctgttatctttttatttccttccttatattttctttagatttctggaattttttttgtttgttttttgttttttgagacagggtctcaccatgttgcccaggctggtctccaactcctgggctcaagtgatcctccttccttggcctcccaaagtgctgggattactaaataggtgtgagccactgtgcccagcctattttatttagatttaagttgttcttttcataactttttatcaaggatgtttagcttattgcttttcagcttttcttcttctctaatatatgaatttgggggccataaactttactcgtagaatagttttaatggtgcacctcataaattttaaagaacatttacttcaaaatgggctctaatttccactgtgacttttttctttggcctatgggttattagaaagtatatttcttaatttataagcattgtgaattttctaggtaaatttttgttattgatttctagtctaatttctttatggtaaaataatttgttttgtataaattcaattctttggaatttgtggcaatttgctttcacatatgattttgataatgatctatgcatatttgaagccaatgtgtatattctgatgtttcaaggtagagtattgtatttgtgactattaggtcaaatacgtaaaaagtattgttcaaattttacatatcgttataaattatctgatatacctgagagaggtatgttcagatttctcactatgatttttaaatttctctgttttgtcaatgttgtttaatatataattttgagctatgttactaggtgaattaaaatgtagaagtattatctcttaatagagaagttaaagttttatcattttgaaatgcagttgtccctccatatccataggttccatatctgtggattcaattggggatcaaaaatatttgggaaaaaattgcatctgtactgaacacatacagactttttgtcttgtcattattccctaaacaatacagtatgacaactatttatatagcatgtatattgtattaggtattataagtaatctagagatgatttaaaacacatgggaatacattatatgcaaatactattctgtcttatgtcagggacttgactatccatggattttggtatccataggaggtcttggaatcaatcccacatggatacctgaaggccttctttgtctgatataaatatagcttatatgctattggcacatgttttcattttatatatacttaaaatctcctaatgtattattataactattgctatatttggttaaaaatttaggtttatccacgtttgcccttttcattgttctttatgccttcctgcatctttgagcttccatctgggagcggaatacacccttcagtgttgtctttaggttagactatcgatacaaattctctacatgaagtgaaaaatgttttttttctctacttcattattgaggagtaattttactggtagagaattttaggtttatagctatattccttcggcactttgaagataattccattttattctggcttctcttgattctttcaagaagtcagctgtcagtctgatacttgcacctttgatgttaatctgtcttttctctcaggtttcttttaatatgtcttctataacttttatttttagcattttttactatgttgtgcttttctttttccttatcttggtttaagtttggagatctacttgaatctgtgcttttggccaatttttgcaaagtctcagtcattatcttcttgaatatgcctctttcccattctctcttccctctcttctggataccttctatctatctaactttctggacatgcatgaatgggccccggcaacctatctgaccccatcccctgccgtactctcgttactcgcttgtctctatcttgctgtttttctaacatgccaagcatgcttcttactcctagatttttaaaaatattgcttccttagcctggaacactgttttcaagatatgtctaagactcattcccttacatgattcaggtctctgctcaaatgtggccttatcagagaggctttctctgacatttattcaaaattatcatccagacctctcctctcccatattgttctctaactctttacctggttttatgcttcttcatagcacttactacaatatgacacattatatatccaatatttatttgcttattctttgtctctctccatttgaatagaaattctgaagttctgtaagaggagagagctttttcccaccccctcctcacagttgtatcccatcccctggaatagtgcctggattagagtaaatgttcaataaatatttgtaggagaatgaatgaatgattaatagatagaagatataggaagagttctctacaggaagtaaagaaagtggagaaggcagaataacaaactaagtaagtcttttaatttgtatggtctatattttaatctttcgaatgtaaagatagtatcattgatcatatttctgttcatcaatgttacctaaaatagcaaaatgaaatattaatatgtttgaagatatagctttcattagtttaaattaactatctcatttagtttaggcatatggtccacaaatttttaagaacatttaattttaatttaaaaaattaagcctaccaaataagatgcattattttccagtgacttaatatgtatattcaagactttttcaattttttatagtataaaattattgtgattgcacatgaaaatttattatttaagcaaaatattatgagtgcttataagtacaaaggctaaaactgatatccctaccaaccacaaaaaaataggccaggcagctgggtactgcctagcctatttttttgtggttggcagagatatctctttattgtgtagatatttaaggactcatatagacccatcattttttatgggcaaaaatcccaactctggtcttctaaatgtcttttgtaaatttatttccctaaataaatcataaatccacttataatacctagacccacacaatgtgtattcgtcatagctgctcaaaaggaatccacagtgtaggtcagagctacttgatgagagaaagtcttgactctgctaataatgtttttacctcactggcacccacagtattttgccagattgcctgaagtcagcatgccttcctgatggtcatggactgttctgcttttccaggaatgtctcaaagggatcctgcctgaaaggaaagaggccatactgtgatatttcactgcttataaagagaccaagaatggcctctgtcttgttcttttagctagcttcaaacaaacttagccagcttaaaaacagaaatggaactgatgaagtcatcaacctagagcctcccgctactgcccatgtattttgtagtctagaatgaagctaataatctcaagaactgcttcctagaaaggttaaggagaaaagcatgccccatcccacttctcctcccatttcccactcttgaaatagcattgttagcatctgatgtgagccagaggagtatttgaggctgtgccatatgtccttgttagaaacactgagcttataatgactaagaaactccagggggttgtctaaaccaccaaggttataaagggcacagcatcatcacagctgaactaaaatttaatatgattcttactttaccacccatggtgacctaagaaggtggtaagggggacaaactctaaatagagggctcagttgtggctcaccaagaagctaaatatgctgttttcatggtagaatagggaagaagaaactggtaaatatttccaaatgtcatgtgtttacatatgaatctattcacttctttatttttaaaattcttctgagaagtactttagaagtaatccctaaatttaaagtatttataacaaaaattttacatattctcaccagtttagagcattacccagaaggaattgtgactccatggtccaggggattagagttagtcattaggggtgggaatttcttctcagaacgaagttagagctctgtaaccatcttatgtgaccaagtagatgtttgagaaagatctggaattaacgtaatgaaggtgagtagcactgagaatgcccatagagtctgtagcttagatgggggtgggtgtcaccatgatcttagtgttgcactttttggaaactaggtttaggtgaggaatgaagtcacaatcccctaagaagggaataatgaataaactagttatatcagcttattactttagagtagaaaacagacctcatgcaggaatcattctgcatatgtggtgaagccttcttggtgagcagacaaacaaaaaagaaaattcactttttctaaaaaaatagcacatcagacctttgtagcctggagaactcattcttctctactttagaggtgtttctttttctaataactgggaagggctgtctctaaccggagctcctgtaccacccctaaagatatcaataatttctcattctccaacttttagttttcccatttttattggtcctcaaaactttgtctttgcggcactccctgcctcatcatacttgtgacaagttgaattcctaagactcaggctcgtattacaaaggatgcaatttagatgagcaactccctggtgagatgagtggctctctggcaaacggggtggggaacatagagaactaagagtcaggaaacttggggcctatatctagggcatctgttacctaacattctgacccagactatgttttccttgcttcagtggcttaggctgcaaaataaggtccctttcacctttgacacataatccagatcttgtactttactttagtaattttagaaagaagacatttaggccgaggagatgaatgtctgttctcattgaggtaatgaggttttctaccactttatttttcttggtaaagtctttgcttataatctggcagcctttatttgtattcctttttcttcctttggctggctggagagcaagtgccattgacatggcccaaagagtatcatcttttcagccttggagcaaggagtctcagagtagagcacccccactccctccccaaatgcctgtgaatgacaaggcaggaaaaacattttttaattaagtcaattcagttgttacaagttgaattaatctctaatttagggatatcatgggaaactatttataatatatgccagctgacccttatccaaatttccatggaaatagcaatgttataacacagggtgttcttggactgctctaaaaattccagctggtttaagtatgatattgaaccgaaaaatgaagccttctactaacaaatgtgttgaagtatgcactcaggtgctcaggaggtataggcttagcttgaaaaaattcaaggcatgataccctgggctttccctcaaacctctttaattaagacctctgatattgttgtgttgtttctatctgaagtcaaatgggaattgcagaaagttttgcagttttttttttctcctccatgaggtagagattcgtctatgccaggagaagtgaagatagtcacgtctttctcttgaatgatgtaataaagttttgcaagggataaaccatgtttcacttgtatcagatttatttatcaaatgtgttgccattaagagtatgaaaatatttcagctgaggccaggcgcagtggctcacgcctgtaatcccagcactttgggaggccaaggcaggtggatcacctgaggtcaggagttcaggaccagcctggccaacgtggtgaaaccctgcctctactaaaaatacaaaaattagctgggcgtggtggcaggcacctataatcccatctactccagaggctaaggcagggagaattacttgaacccaggaggcagaggttgcagtgagccaagatcacgccattgcactccagcctaggtgacacagcaagacactgtatcaaaaaagaaaaaaattcagctgaaataatagcatatgggagaaattagccatgtatttataatacgcgtagtaaaagtgcagacgctatgactatattgcatgcttggtgaaagtaatggcaggtttgctatgttcaaaacatttgaattaatctgttcaaaccatgcacagcattacagaattgacattccagcacagtgactgcagtctgcagcagttgcagttttgtcatctatacaacgtcaaacaagatgcaaaccaccaggcttggtagatagaataccctttgagaattaagtaatcctgagatgactttgctcatcattgatgtcctgtgacgtcaactgaaggcttgtcttgcccatttcaccttgtcattgtggttattggttttctccattaaaatggaaaattggattatatttagcagaatgaacatatatttgatgctttaggtaaaatatatacagtcatatgccacataatgacttgatgttttaggtaaaatatatacagtcatatgccacataattcaacattttgatcaacgatgaactgcatatataacagtggtcccacaagattaaaattaatatttttactataccttttttatgtttagatacacaaatgtcattgtgttacagttgcctacactattcagtaacatggcatactatacactccattgcactccatgtgcgccattgcactccagtctaggcgacagcctaggtttgtagcctaggagcaaataggttataccacatatcctaggtgggtagtaagctataccatctagattcatgtaagcacagtctatgatgttcacacaacagtgtaatcacctaacgatgcatttctcagaatgtatcccagtcattaaatgatgcatgaccgtatgtattatctgaagttagcaccctttagcaaactcctgaatcattaatttgcaaccctttggttacatcttttttcttaccattataagaatttgcttaatatgaatttgtggattaaagtgatttaaagtgctctctatatcagggagattagccctttgtctgtgatatgagatgacaatattttttcccaagtttgacatttttcgtttgaaaaattttttttgtcatgtagattgaaaatttttttccagtacaataacgcgtttaacactggggatacattctgagaaatgcatcattaggcaatttctttgttgtgcaaatattgtagggtagacttacacaaacctagatggtagagcctactacacacctaggatgtgtggtatagcctattgctcctattttacagacctatatggcacgttattgtacttaatactgtaagcaatggcaacacaatggtaagtatttgtgtacctaaacatagaaaaggcacagtgaaaatatggtattataatcctatgggaccattgtcatacatagtccatcttatttatttatttatttgttcattcattcatttattttttgagatggagtctcgctctgtcgcccaggctggagtgtagtggcgcaatctcagctcattgcggcctctgcctcccaggttcaagtgattctcctgcctcagcctcctgagtaatccccacaatctcagctcactgcaacctctgcctccctggttcaagcgattctcctgccttagcttcccaagtacctgggattacagatgcatgccaccacggctggttaatttttgtatcttttttttagtagagatggggttttaccatgttggccaggcttgtctcgaactcctggcctcaagtgatctgcctgccttggccttccaaagtgctggaattactggcaggcccatagtccatcactgatggaaacactgttatgctgtgtgtgtgactatagttgttgctgttttttttttttaatccacagctgacctgaaagtcttttatgtctccagattttaacagaaagccttccccactctgagttagtagagatagtttcctttgttttcttctagtattttaattatttcatttttaaaatttaaatctttactcctttagaatttacctggtatatagtatgaggcatgaattcaacttaattttattaaaaacacctctccagttttctcaagacaattggagttgttcgtcttttcctcactgatttaacttatgtatttatgtatttatttatttatttagagatggggcctcactctgtcacccaggctggagtgcagtggtgcaatctcagttcactgcaacctccgcctcctgggttcaagcaattcttgcgccttagcctccccagtagctgggcttacaggtgtgcaccaccacacccggctaatttttatatttttagtagagatggagtttcaccatgttggccaggcttgtctcgaactcctgacctcaagtgatctgcctgcctcagcctcccaaagtgctgggattacagcactcccaaagtgctgggattacagtggcatgagccactgtgcctggcttagataccctgtgtatcatacaccaaattctgtatgcattgagatctatttctgaatttcctgttctgttttcttgatttgtctattcctgtgtcaggaatacaccttcaactattgtagctttatattattttataataaatgctaggaattgtccccctcattttattctcttttagagatttctttgaaatccttgttttatttttttctgtataattttcatttttgaattgacacataataattgtacatattaatggagtacatagtgatgtttcaatatatacaatgcttagtgatcagatcaggataatcagcatatccataatctcaaacatttataatttctttgtattggaaaaattcaataccctctcttctagctatttgaaaatatgtaatattgttaactatagtcaccctatagtgctataaaacagaacttattcttcctgtacagctgtaattttgtgtcctttaacgtatctcaccatcttccccttcccccatctccctatcctctagtaacttcttttctactttttacttctaagagattggctttttttttagctcgtgcatatgaatgagaatatgaggtgtttaactttctgttcctggctattttcacttaacataatgttcttcagtcccatccatgttgcaggaatcacaggatttcattcttttttatggctgaattgtgttccattgggtatatataccacatttccttgattcatttatctattgttggacatttaagttgattccttatcttagctactttgaatggtgcagcaataaacatgggggtgcagatacctcttcaatgtactgatttcctttcctttggataaatgctgagtagtgggattgttggttcatatggcagttccatttgcagttttttgaggaatattgttctccatagtggttttgttggtttacattcccaccaacagtgtgtaagtgtttccttttctctgcatcgttgttttttgtctttttgataatagctatcctaactggggtaagatgatatctcactgtggttttgattggcatttccttcatgactagtgatgttgagcttttttttccatgtatttttttggataaatgtatgtctcttttgagaaatgtctattcagatcatttgcccattttttaatcagatttttttttttttgctgttgcgatgtttgatttccttgtatattctggatattaatcccctagtggatgaatagtttgcacatattttctccattctacaggttgccttttcactctgttgtttcttttgatgtgcggaagcttttcagttggatataatctgttcatttttgcttttgttgcctgtgcttttgaggtcttattcataaaatcttgccccagaccaatgtcctggaacttttctcctatgtttttctctaggagttttatagttttaggtattacatttaggtctttaatccacttgaagttgatttttatgtagagtgagagatggaggtctagtttcattcttctgcatgtggctatttagttttcccagcaccatttattgaaaagattgttctttcccccaattaacgttcttggcatctttgtcaaaaatgggttgcctgtagataaatggattaatttctgggttctctattctgttctactgatctgtgtgttattttttaatgtatactttagaatttgtttgtctcattctcccccgacccctacccttctccaatttttggccttgttactgtagttataattaattgctaaattagcttagggagaacaactttatgaggttgagtcttcctatctaactaacttggtatgtcttcccctttgtacaagtctttgtgtcttcaggaatgccttaaaattttattagtaaatatggcacatttctaaagctttttcttaagtatttcatctttttctgttgctattgtagatagtcttcccccatttcatcttccaactttctgtgtttgtaatctaaaatctattgatataataattctctatcgtgctgcctaagttttcttgtttactttttcaattgaatgtcatagggttttctatattcatcagaaattgtagtagttttattatgttctctaaatttttatacctctagtttctttctcttagtaattgtattgtctaatatctaatatctaggatgttaagtaatggtggtgacaaatgagcatccttctttgttcctgaattgagtgggaatacctctagtgttgtcctgctaggcataatagttactttgggatcaaggtatattttatcaagttaagaaggtatccacttatttctaccattgatttcaacatatttctaaatcatagtaaagccccagggctatgtacctgcaccatgataggataaaagctctaaaaggaaagacacttaagaccctctagtctaccttcctcccatcatgagtattaaattccaagcacaggaaggttgtaactattccctgccccaaagtcctaaaattagattagaagacaatttggaacactgtctcttaggtcttatagcagcgttttttggggtatgttaggctaacactatttctctataacattatttctcttcctttgtgctctctccttgagatttttccattttatccttctcttctcatctcacttctgggacttcacgtgtattgcttggctgtgcattcttcctccagcctgccattgctgacaagccaagtttatcttaggagagttctagacagtgacataatcccttccccacccaaaaagactctttgctatttgctcttcctggacaaagtacattgtcttccaaatgctgttggttacatctggaattaaagcagaaagctcattggagctgctgaacacctcaaaatatacttcagtttttacagtgcctttagcaaggtgattttagccaacagtgaaagtatcataggcactactgtatcttatattcatttgtaggtggtattcagatttcaaaagaaattgtcataatatttattatatttaaatggaaaacataaacaattacatattagtgctatacttctgattttagattcacctgtgtcataactttaacatcaaaattagtaaatgtttcatatgctaagaaaacttatatgcaaatggaaaaaatctaagccaattattattttcataatgttctactgtgaaacaaaagatagtatttctgtccatatgtagttatcagactctggagtcagatagacttgggttagaattctggatttaccaccacctggctgggtgactggacagaagtaacatattctcaactgagtctcacattcctcagctgcagaatggggacagaaatactttgtacagttatatgagaattaagaaaatgcacacaaagtgcttagccagtggctaccatgccctaagactttaacagatgataactattaccatagcctattgttaatggctgtaataaagcctgttgtttttaacttttattaacttaaagaataaatgttgcagtttgactcagtgtgggactataattgcaaagcaactcatttatccacacagcctcctttctgagaattagaactaatgtacttagaaggatttgactgaagttctgctctggattttcttaggaattatttgggcaaccatgtccattaacacttatctagaaccgcaaggctgaaagtatgttattgtttgattaggttttcattagccaattattatttattgaccatatgataggtggaatagataagtatcacaaaagacatacgattcctactctacacatttagaactaaaaacagaagggcatctttgatttacttaaagggtccactttgtgctagatataataccatgccctagggatacatagatgaaaagatagccccctactctgaagaaacttatggtctagtatggtgtctagaatggaacttagaagccacttcttataggaagccttccctaaacttcaggtagggaaaatttccctcttatgtcatagcccccaagcttacacttaagtttggcatttgtcacactgtagattgtctgtctcctatgctagactgtaggctgcttgagaacagggactatgtcttactcatcaccgaagaaaagaagatgactaaaacatcatcttggcccttgaagaacttaaaattgagtgacaaatataaactacgaacatctgtaaacaactaagctcaaaatacatttttatgaattataaattctacagagtatatgctacaagaggtaggaggttttggaaagatgatttagaagatacggcatttcagtttagaaggaatggtgtgatttccatggttgaggtgggcaaatgaatccaaggttaaggaacatcatgagcaaaggcacagaatcgggactgtacatgggctacttaaggaatagtaaggagttccatgtgagtggactctggtaagaatgttaggtaggggattggttgtagctgatcttggatgcagtagtagggtgtttggattttcttctgcaggcagtggtgcattgacaaggatatttgagcaaaagggacatgattactttgtcaatagtgtaaatgatgggaaaagagagataatattcaggaaggggactcctgggactgccaataatgtagacaagaggtattaaggtgagaatagatatggaaagggaacaattctggaagcattgtgcaaattgacttgtcagactctaatttggaataagggcgattccaatttaaaagtccttatttcctacctcggtggagcttgcagtgagccaagatcgcgccactgcacaccagcctgggtgacagagtgagactccgtctcaaaaaaaaaaaaaaaagagtccttatttcaaaggtgatggctctagtttacattctccgtcatttacatgctctggccatggcatgggtaaagtcactcagaaagcgtttaaagaaaagccagagggaggtcacagaaccttgtggaaaacttatatttaaggggtaggtaaatcttcatatttagaagagattatgtttcaaaacttactaaaaagacaaaaatgggctgggcacagtggctcatgcctaaaatcccagcactctgaggccatggcaggaggattgcttgagcccaggagtgcaagatgagcttgggcaacacagtgagaccttatcactaccagaaaaaataaataaattagctgggcatggtggcatgtgcctgtagtcccagctactaggctggctgaggcagatcacttgagcccaggaacagtgaggctgcagtgagctgtgattgtaccactgcactccagccttggcaacagagcaagaccctgtctcaaaaaaaaaaaaaaaaaaaaaaaaaagaaaactcacatagttttcatcctttaagtggtttgcttaagttaacatctggtttatggcagagcccccaacccctgacatgtagctcagtgcactttctattttatgctctagattttagtttaatgctaaatgtgaggatatcacctaccttttccatcctcatctatcttagtaaaccggattaaatttgaattctggacccctctactttaagtatcttctatctcagccaggcgtggtggctcacgctataatcccagcactttgggaggccaaggctggcagatcacgaggtcaggagttcgagaccagcgtggccagcatggtgaaaccctgtttctactaaaaatactttagctcggcgtggtggcgcacgcctgtaatcccagctactcaggaggctgaggcaggagaatcacttgaacctggggaggtagaggttgcagtgagccgagattgtgccattgcactccagcagaactccgtctcagggcaggtgggtggggtggggggggcgttgaaagtatcttctatctcatatgttgatagctaccaatagcaaagagaaaattgtgccactggaaaacagggcaagtcatctatatggatgccacttaaaattatgtgatatgaattgatataaaaagcctaattaaatctaccttatgtttcaaaggcggtaagttaatcttttacattattgtttttatactctactctttatgtaaaagaaaaactacttcattttcaaatggtaaattattatcacccaaatacattgctgtatacagaagtggaaagattttgctcaaataagccaaagctaatgatttcattataattctatagaagtttttgttggtactaatactgtaattgtctatagcatatgccataggtattgtttgaaattgtttttatctcttaattatcaaatgaaatatacctcaaagagggaggcctgaaaagacatgaaactttgaaatatagagcatcttaaaaagcaagtacatggtgacgccagtcttcagaatagcatcatccctgttgaacagcataaaaaatatatggatttgatgatctatttggctggaagataaaaaatgaaccatcatgagccattattaaagaggtgtttataactgaaaaactgtgataaaggtcagttgacaaaatgagtggagcactgtaaatactaagagttgatggcccatgcctagataattcagtgtttctattcttagaaaatggattttaaccatttgaatgggcctagtaaatgatcctattacaattttcacatatcaattcatggtttacccaaaaagatgtgcagcatacttttaaattggcctttttctggcagagagtttccagaaaaataatgtgtttttttttgttttgaatttatttgcttactttgggtttttcttaagcaagaatattaaagtacaatatacatacagagaagtatgttttctaaatgtacaactcagtgaagtttcacaagttgaatatacttacttatccagcacccagatcaagacacaaaacatcaccagcgcttcagaatctaccatctcttacttccttccaatcaataggtacttaccaccctaaaagtttattgggagacaattctcccatgtgtctcatgtttctgcatatcttgtgagcaaaggcactgactgcgtgtgttcagaatgtctttccaaggcagccttggaagaccatgtctccagagcaaagggcaggtgtgcttatagtcttgaaaatagagattatgtcccttagagagcaaagaacaggtttacttactattcggtataatagagatgtctcccttcaaagcgaaaaggacaggcatgcttactgcccattataaaagattcagattccctatgttccctacaggagttcctctcctgtaacacaatccactgtatgtacaggtgtcacttgactttctgttgccttgtgggaattagagctcagggaaccagtgcaaacactgacactctgactattgagttgtaaggtcctttgtctctgacctagcatgtaaggctaacttgttaagcttgcaaggagcgtaaatctcagacccgtcactgtccttggtagtaagcactattctgacttctaccaccatagattagttttacctgctgttacacttcatacataaaagaattatatagcatgtactctgtctggcttcttacatccaacaacatatttgtgagattcattcatattattgcatgtaggcataattctttcttaatagtataccattgtgtgaacattttaaaaaattgggtttttttttccactattgatggacattagggcagctcccagtgtcagctattaaaattctgttgttagaaatactttatgcatgtctttgagtgaatatatgtatatatttccgttgggtatattcctagaactagatcagagggttcgcactggtgctgccaaacaactttctaaagtatctgtacaaagctgctctcccataaacagtatatgggccttttggtatctctgttattttcaacctttgttattttccatcatctttgttttgttttttttcagtgacatgcttcaattttaccatcatccattcataaggaaagatcccattggcataatggaattataccattggcataaaataaatatgccaatggtcgggcggatcacaaggtcaggagatttgagtccatccttgttaacacggtgaaaccccgtctctcctaaaaatacaaaaaattagccgggcgtggttgcgggcacctgtagtcccagctactcgggaggctgaggcaggagaacggtatgaacctgggaggcggagcttgcagtgagctgagatcgtgccactgcactccagcctgggcgactgagcgagactccgtctcaaaaaaaaaaaaaatatgccaatggtataattccaatttcacaaaacaatctcacaagcacttccactctttaggctgaggcaggtgaatcatgaggtcaggagttcaagaccagcctggccaacatggtgaaaccccatctctactaaaaatacaaaaattagccaggcgtggtggcacacacctataatcccagctactgaggaggctgagaaaagagacatgtcaattactaagttgttaccaggacaagttatcaaaaaggacaatgaaagccataaatattttgtagtttatttacccatgaacacaatagtttccagtcttccgcatcagataagaccaagttattcaaattaaaatgttaaagatacggttttaacagaaacaagaacaggctgaaaactgccatgaatatccatatccacataatgtacaaaaaagaaagactgatattattccaaatatttctatttgaaagtaaaagaaaatctgtacagctgaatcttcccagtaaacagaaagagaaaatattataacacagtattaatcttccacataagtaaggccatatgcaaacaagaaagagaacacccaaaattgcagtgtttcttcaaagaacccttctctagggaacatatttaacactccaaccatcttctattcttctacgtgcatactaaaaaaaagtacttctcttcccatcataactagtcaacccagtgtaaattctaggcccgattttcccctgaatcatttctgcctttttgttcagttttccctgcctagagcacccatcacaatctctttagttcttctatccactctgaactagaaatcacctttcattccatacagctctgtagtcctttaaaccctctaggaattgctaaagaggggtgaggggctgagaagaaaggagaatgggcaataagaggtctggcagtctattttacagaacagcctgcctctggacatgacaaagagagccaagaaactaaaaagcctgcttctgcggatgtttctgaactactacttttgttttttttaaaggaagacagaagagatttatgagagatgagagaaaagaaagtgtacactcactctggcacttcattaggttcaggaagggaggcaaataaaggtacctagattttgaatgaatccactggttgtggctgagaaagcctggtacttgtcaagaacaccaacatattaaccttgccatgaggatagggtctgacatgtcccctcaaccacctgtctaacaaacagtagggtttctgagtgatgagggtggtggtggtaaagagaggtcttttggaagaggaacaggtcttttgtgtgctgacaggaaagctgtgtccaccaccagtgttctggagatccctgtttattagaaaccagagagtggagctggcaatggtctgggatatgttcactcagcagggagctgcccaagtagcagtacttgggaatagccagtagcaggcagcaataggtgaccagtctcaggaaaagtaatggggtcccataattcacacagaccaacttgccccctgctgttctcccttgacttcattaatgcccagcaattgtccacaggccatgcacctgtactgtcagatgcagagcagggtgagctgaataggttcttagacacagctagaaatccaagtaggaggagccagaccagaggtcctgggaacaaaccgagtccaaacaaaggtaaatacagtgtaacctacagcatcattcgcttcgcttagaaggatgtgacccatcggctgggagcatgtgatgttaatgcagaatagcaagacgaccaggtgaaaggggagcagcacagccaccaaggtctcaatcttcaggttgagagaacggaaagtttaaacagagggtacaggaaagtcagaacaaaaaaagtaaagggcatacctaatgctgttgcccaagctcaggtccagctggtggtggcaggcaaccttctgcaggagtaattccaaaggcaaaggttaaccacactggaacccaaagggcctggggatctccactggctcccttaccaggcgacgtctagctctatgggcgtcttcacccaacaggtagtactgcagtggatttgaccagaggtcctctttaataatctgagcaatcctgtcggactctggaaggctgtggtctgaaaaccaggtgaagaagctgcagatgacatgtcggttcctatgaatgaaggactggggtccatggccccggcgccacatgattagagtggaaaaagacaccacttggccgaaggatctgacctcatacacctttacaatcagcttgtttctgaagtaagggtttctttgaaagaagaacttaaacttgcagcctgtcctagggtgtctgagctccttcacttccaaattggttaagtagcttaacatctcggcatcttggcctctaatcatggcagacagctgtgggtggtggcggaaagcagtgacccagaagcccgggatattgcgaatgatgtcattcctctgctccaggtagtattcatgaatctgcccaaacctgcgctccacctgcaggagcgccctgtcagcctctgcattcacggagtccagttccagctggatggactccagggggttcaggtggagacccacgttcaggggcccgggcccgggcccaggccctgcctccctgtttacctcatctattgctctgttttcttccgccacgtccatttcttcgcctcctggcttctcatccactggggctgagaacatggcacactcctcaggcttcacgtcctcggccttcccctctgcaatcacttcagactccgacctccctgccccacaggtttctagagccttctccccacctaggccgtgcgtctcttcacccggaaagccatttttgaggctgccgtcagttgtcagcgaggcagaggccgcttctaggccctccgcgggtggtggagtcacttcctgccccgctttgatggctccatgactgcgacccgcatcgaccaagatgtggaaagtatggccaccatctgcgggatcctggggcgcgaccccctcctctggaagccggggcggtgggaacacgattggctccaagcggccatcaaacatatctgccattacctctgtcgccttgctcttttctcgggacctctggccctggtgcgggtcttccagagcatagtcgagagtagcggggctgtgaggactctccgggaggctcatgttggtagcggccagggcagcagtgggtagaggccaggccagaggtaggtagcgtcaacgttcctcacacaaaatggcgagtaaacacctcgcccatttgcgccgcccactcttcagtctcgcgacacccacccctcagtctcgcgacactcactcctcagtctcgcgagtctgtggtggtgtctttacgtctttgttattttagccatcgtgctggatgagtaatgatattacatggtggttttaatttgcatttagccaaagtctaatgagctgagaaccttctcatgtgtttgttggccactaggatattctctcttgtgcagtatccgaggcttctccctatttctctactgggctgacgttatttttcatatggatttgtaggaagcctttgtacatgctagatactagtcagtcattcttccagtataggtattacaaatatttctcttccagtataggtattacaaatatttcctcccactctgtggggttacttttcttttggactcgtagtttcgctgtcgccgaggctggagtacaatggcatgatctcagctcactgaagctgccgcctcccaagttcaagcgattctcctgcttcagcctcccaagtagccgggattacaggcgcccaccaccatgcccggtttttttgtttgtttgttttgttttgttttgttttgtatttttagtcaagacatggttttgccatgttggccaggctggtctgaactcctggcctcaggtgatccgcccatcttggcctcccaaagtgctgggattacaggcatgagcaaccgtacctggcctactttttcaccatcttaatggtaccttttgaagaacaaaagtttttcatcttaatatgtgccaatttgtcattttcccctttaccttagtgtttttctgctctgtttaagaaatcttacctctcacctgggcacagtgcctcacacctgtaatcctagcactttgagaggcggagacgggaggatcagttgagcctaggagttggagaccagcctgggcaacacagcaagaccccatctctatttttaaaaagaagaaaaaaagaggaatcttatctcaccaagattgttcaaatttatatatgccatccatctggaattgatttttatgagtggggtcacaatttctttttttccatatgaatatctaattgacccagcactgtttattgaaaagacaattctttccccatgcataggtttttaaatgtttctgtcagaagtgacataaatcattggctacagctagtcagttggccttgtctaactttaataggacagggaggtgtaatcttctcttgagcctggaaggaggaaactggaaatattggcaagtgctgtatcactcatcatgaaaaataatttgagaaatatataaaagaccaatagaattaggccaaaggacatagagaaaaggtaataataaacaggagaaatttatgtaagacaatacagagcattaaccaaagattaataataaaaggagagagaaaataagcaatatttggagagaaaattatagtcacattgatggtttaaataaatataagacaggatgttagacagctttatgccaatacattttcaaacttagatgaaatatatggcttcatagaaatgtataacttatcaacacggactgaaatgcaatagaaaatctaaatagacctagagacaataaacaaatggaatcagtagcttaaaaaaatgtttccacaaaaatagcatgaggttcaaatgattttgaggcgactgctaccaaaccttcaaggaacacataatccatttttatatttattaaacattcaacaaatatttattaaacattcaacaaatgtttattgggtacctactgtgtgcctggtactcttataggccctctggatataacggtgaacagaccaaagatttcttccctcttggggtttacattttagcaggggagaaagataataacaagaaaccaatattgcacattagaaagttataagtgctatggaaaaaacaatagagcaaggagattgaaagtcctgggggtagggagtggggaggagattgtagtatgaaatagggtggtcagaggaagcctcattgaaaatatgagattttggcaaagagtcaaagaagttgagggagtcagctagtagaaatcctggaggagagcatttcagcacgagaagtgctaagcagaggcactaagacaggagcatgtctggaatgttcaagaaataacaaggaggccagcgtgactggagcacagtgaatgagggaggctagatcaagtagggtcttgtatgatagtgtaagaaatttggcttttattcttagtgaaatgggaaattactacaggattttgagcagaggacacaaaatctgacttaagttttgcgtgaatcactctggctcctgggtgaaaaataatctgtatggtggcaatggtagatttagggggatcttttgggaggctactgcagtaacccaggtgaaagatgtttctcagaccaggtggcagcaatggaggtggatggtggacatagtatgatggtagagtcagcctgatttaatggtaaattggctatgggatctcttagttcattttctgttgctgtaactgaatacctgagactgggtaatttataaagaaaagcttatttaactcacaattctggatgctgagaagtccaatatgctgtgctatgaagtagcatgacaaaaaagcagaagagcaagcaagcacctgggaaagaatggacaagagaggctgacttgcattatagcaacccactctctcaaaaactaatccattcccatgagaagttatccagccttgcaagaaaaacataaatccatcttaacaacctgatcacctcttaaaggccccacctcccagcatggggtgtaagagaaagagagaagtcaaggatgactccaatgattttgacatgagcaactggtaggatggagttactggaagcagagatggtgaaggttataatgaggaagatctttgcaggaaaatcagagttgtctctcttttttaacatattgtttgagatgattattggacaccagagttgagatgccaagtgggcataatgagtttagagctcaggagaggtctgagatagttattcacattttgggataatcagcatgcatggaatttaaagtcaaagggttggatgagaacactaagatagtgagtcctgataagctgggccctgaagactccaaaagtataaggtcaagaaaaagaggaaaaacagcaaggaagactgaagagagaccagcagggtaggaaggaaaccaagagagtgcaatgtgcttgaagccaaatgtgtaaaggaaggtgttcagctgtgtcacagggtgctcacatgtcagttagtatgaggtctgagaattgaccgtcggattttacaacaaagagtcactggtgactcaaaaagagcactttcagtggagtggtgggggttgaaatatgtttgaaagggaaagggagaaaagaaatggagattgaatattgacaattcttttgaggaatttttctccaaaaagaaacaaagaaatgggatcatgacaagagtagtcaagctactttcagtggagtggtgggataatagcttggctggaataagtttaagagaaaacaggaagcgaaaaagtgaaaacagcgagtatatacaactgttttgagaagttttgtttcaaagaaatgggatgatagctggtggggaaatggatcaaagaacgtgtttttaaaatgggagatgaagcatgtgtaaagaagcaggttgatgtgaatgatccagtagggagcataaaactaatgatgtaagagacagaaggaagcattattggagggatgtcctggaatagacaagaggaggtggaatctagtacctaagtggagaaggagatgtcagctttaggagcatggcaagttcactagtggtaactggcaggaagtcaaagtgtgaggtgtatatgctagtaaacaggtagaagtgatagtgagatttatgaaatcgtcttctgattgcttcattgttctcagtgaaatagaaagcaagatgatcaaatgagtgtgaggatggggcaacaggcagtgggagtctgaggacagagaagaaggtatgaaatagttgtctagagagaagagtgactagactgtgacctaaagtattgtcagacaatgttaaagtcatgaattggaaatgaggcccatcagcatggctatgaatttttctccagccgcattcaacttacagctgcagtgtgaataagcagagttggatttagacctgaaacaagaagggcaagagaataattataataattgatcttagagtttaagctggaggacggaagacatacaggatgaggtcagtgaaaaggtggtctgatcaatgaattggaagattcagggtactgaaggtctcctggggtcgagtcctagggagaataagctagagggctgagagacagtggtttgagaatgacctgcaagggattagtcagaatcccattcatgaatccaaggtggtctctaatgaggtagacagaggatagggtaaggtcattgcaggggaggaggtcaatgagccaacaggccaggatgggaaggatagtctatgtgtatattgaaatcactgagagataagacaagagagaagtgagaatgaggcaggagctaaaaaacatgagaaatgagagggaatgacatgacagtagcaacgttttagggcaataggtggtccaaaccattgacaggagactcaaagctggatatgtattctagggccaaggtatatcaccactacctttcgataaaatcagttagtgggaaggcagacacctttagaattttatatttcttaatgtcacagaccctggtattatacatctccccaagggtacacatacattaggaaacatgtattttttaaaattgaaaggtgagtagtgatattattctttgagttcattgtgaagtgttattttcttttggggttccattctgctttgttttaaggcatggactagaaacagttgaaaagaataatatacaatttcaactttggagcctgaaatattctggctataatttttttttcctaaaaaaagggagaacaaggagagctatataaaatctctgaaatgttttgtcaactagaggcagaaataaagatgtggagaaagagggagagggagaaaaaggaaagaaaaatgaaaaatgagtaagggaaggaagaacgatatggcttcttgggaagagtacaatttagccactaatctgcacatcacagaattgtaaagtgtttaaattctctgggaaacagaaaaacatgatgttttaaaagataaactcaatattagatgactgaaaagagcctgtgaattgtatagtcttgttttccttggactcctcaaatattctttttcagttcttgttttgaaagggatccctctctcttgacttaaattctttaaacaacattgtttatatagtgatttaacatacagaactatttttcttagaactaggccacccagtttagaaagctgagggcctgaatacaatatgttactttcgtaagattcaaaagaatgttggtaaacaagagagggagatgtacactttgctaatttcttctgtttcccatggaaagtttatcaaactgtttgtgaaggaaatggtcaaaaagaagttttaagtgattaaccaagtagctttacagctgcagtcgtctttattgtatataaatatagataagagaggagaaaaatatttgagttaccagggcatgggaaatgatttaccttggcaaagttaataaattatgatttaatcattttctactaatgtagcactcatagaaagaaaatatacattattgtgcctggtgaaactgtaaaaggctaaaaggtctatgtagagtcctggcctgatagactagccccagagtgtttcagccaggggtgagcagagccacaggcttgtgactggacctgtgtcctggctagtgtcaagcatccccaccagtgaatgcgatacaggagcaaaatgatgcaactgctgttacagtgtttatgttacacaaaaccaaaataccagtatttataccagactcttattttaaaagtgttcagaattcaggaaatacaacagtgaaactaagtaatacgttttaaatgcaaattttaaaatagatattataaaatgtttctaatatctaagtgttagacataatcactctagcctaatttagataaaaatttttaagtattagaaaagaaattgatactacagtaaatgaataagttggttaatcatggaaaattgaaaatgaaaaagagtgcattgatgatgtcatcattaccataagagtattttttggagcaaattttttccagctgctataaaagcttccagtttctacactggtggcagagaggtgaacagagttttgctctaattcctattattttcttgagttgtcattttaggataatctctctgtgattactttttttttttagaaataactttttatggatggcaaactgtagtttttgtttcaagtaaagcatttctggttttaactgtatcatctttaatttatcctgtttgaatatagattaggtacaactgtatcaacctaattaattactgtcccattcacattccactttattgaacggtctttgaagtaggagtaagatttatgtatgtgatagaaggtttagaagctgggtgtagtggctcatgcctgtgatgccagcactatggggggccaaagtgggagaatcacctgaggctggagtttgtgtccagcgtggacaaggtagtgagaccctgtgtgttaggtcattcttgaattgctataaaaaaatacttgagattgggtaatttataaagaaaaaagtgtaattggttcagcaggctttacaggaagcatagtgtggcatctgctcatcttctggggagacttaaggaagcttacaatcatggcggaaggcaaaggggcaacaggcacatggcaagaggaggagagagagggaggtgccacacacttaagtgaccagatcttgtgagaactcactcactgtcaagaggacaacatcaaggggatagtgctaaaccattcatgagaagctgcccccatgatccagtcatctcccaccaggctccacctcgaacactggggattacatttcaacatgagatttgagcagggacaaatatccaaccatatcaccgtgtctctacaaagaaatttaaaaatcagccaggcatggtgctgcatacctgtagtcctagctactcaggaggctgagatgggaggatcgcttgagcccaggagttggagcttccagtgagttatgattgccactggcactccagcttgggtgacatagtgacacaccctgtcgaaaaaaaagctttgggttgtccattgatattttctctttcctttggaggagtatagagttgctccttcattcttttcaaattttaatatagtgtataactctttgcatatgtttcaagatgataattcagcaccttttacagtactggataatcatagtaaaataaatataccagaatttcattattttaacatacaccatatactgaactgccagaatactgagagaagatattacaatcactagttgaaaccaggaagccagcttcagtcatcaaatccaaacaaacagtgagcacaggaagagcagtaagtgcctatttattgaccaccttttgtgtgtcagggaggtgatagatgtttagtggtgaatgaaacaggcatggatctgtgtccagaattggttccatctggtgggttcttggtctcactgacttcaagaatgaaacgacggaccctcgcgatgagtgttcttaaagatggtgtgtgcagagtttgttccttcagatgttcagaagggtccggagtttcttccttccggtgggttcgtggtctcgcttgatttcaggagtgaagccgcagaccttctcagtgagtgctacaggtcataaaggtagtgcggacccaaagagtgagcagcagcaagatgtgttgtgaagagtgaaagaacaaagcttccacagcgtggaaggcgacccaagcaggttgccgctgctggctctggcggtcagcttttattcctttatttggccccgcccacatcctgctgattggtgtgtttacaatcctctagctaggcagaaaagttttccaactccccacccgacccagaagcccagctggcttcacctctcagatcctgctcagggagcttagaatgaagaaggcagaagcaggagactagccaggaagggcggaagccaggcagacagtgctgcaaactcacatgtaaaaaacaaggtgggaggaaagggagaaggtccaaggtaattgcccaaaaagggatgccggtctggagatgggtggatgcatattatacagaaacaagtagaaatcttaatgccctttcaaaaatataagtataaatttaggtggtgagttgtttcaacaagatacatgatccttgtttggggtaggggacagtaaagctctcaaaagcattcttgggacagtggaggaaattaaaatagggactggatagtaaatgtttaaaagaattacatgaattttcttaggtgtgataaatggcattaaagtatagaaaacagcattcttattctcaggaaaggaattttagtatttagaagtcaagtgttaaggtatttccaacttaccttcacaaagttcaactacaatgccaaaaacaaacttatggggagagagggaggaaagaaaatatagcaaactttaactaggtggaattatgtagctatttgattgtactatgctttctatgtatgtaggaaaatttgtataataaaaagtagggggtcaaaagataagcatgtgtattagtccattttctcactgctgataaagacatagctgagactgggaaatttacaaaagaaagaggtttaatggacttacagttccacgtggctggggaggcctcacaatcttggtggaaggcaaggaggagcaagtcacatcttacatggatggcagcaggcaaagagagacagcttgtaaatggaaactcccatttttaaaaccatcagatcttatgagacttattcactatcacaagaatagcatgggaaagacccacccccatgattcagtgatctcccaccaggttccttccacaacacatgggaattatgggagcttacaagatgagatatgggtggggacacagagccaaaccatatcagcatcctactctccttttgacaatggatgaggcagctgaaaggaataccaaggagaaaggggaagaatgcagggtgtggcctattatgactttgggcaaacgcttaacctctttgagcctgagttttcttcctctgcttcacagataaatatctacatacaggggtgatatgaagattaattaaataagttgaaatgtagtggttaagagtggtaagtccaaatctcaaactgcacttagttactaaataaccttgggaaagttacttttgtgcccagtttccttatctgtaaaactgacataataatagtgcctacctcccagaattgttgtgaagcacagaattgttctaaagagcgaagcttagcatatattaagtatttgataaatattggctctcattatttttgctatctaggactcagcatcctgaaaatagagaataccccttcttttcacgtgcccattggacattcacaaaaattgagaatttattatgcccataaaaaaacctcaatatattgcaaaaagtagagtgtgagcagcatgttctgagaacagttctgtaattgctgacataagtaactctctaaatcaactcttgggtcaaaaaggaaataaataaattacagaacaccttcaaaataacaataatggaaacctcatatactagaacttatggtctgcaactaaaggactttttagtattacttgtgaatattgatacaaaaatactggataaaatatgagtaaacaagatccaccaacacactcaatcatttaccacaacccactggacatgcccatgccctttcaaaaatataagtatatgatccttgtttggggtaggggacaggaaaactctcaaaagcattcttgggacagtggaggaaattaaaatatggactggatagtaaatgtttttccaacaattttgttttagcaaattacatccttatcacaacaccctataaaccaggtactatcattggccctgttcaacagataagaaaactgaggtgcagaaatatatagatatagatatagctagataaagatagatagatagatagatatagatatctatctatctttttttttttttttttttttttttttttttttgagacggagtctccctctgttgcccatgctggagtgcagtggcgcgatctcggctcactgcaagctccgccgtccgggttcacgccattctcctgcctcagcctcccaagtagctggtactacaggctcccaccaccacgcctggctaatttttttgtattttttttagtacagacggggtttcaccgtgttagccaggatgttctcaatctcctgacctcgtgatccgcccgcctcagcctcccaaagtgctgggattacaggcatgagccaccgcacccggccgaggtgcagaaatgttaatttgcagatggacacataggaaatggcgaggcgaagaaatgaacccaggcaatctgagcctataaagctcttccttttaaactctacggggtactctctgagccattctcagctacaaaagagggttagtaattcttatctcttgtggtggacaaggtaagatacggagttgagtggggagaggcattgatgctatctttatctgtttctgtattgttgagttgttataatgagcatgtattattcatgtattttttcatcaagaaaatgttttttaggggcctataaaagtgcctggcacaaagaagctcccaataaaaacattattatgtctgaaaggaaattcagaatttccatttgacttaataggaattcatcagctccggaagctgggtgaagaaaagaaacaagatagggcaacagctagaggagaattcaggtgagaggtttctactttcaaatgagaagggcttatacatcctaaagtaaggggtgggaacagaaggagggagaaggaattgggagctgggggaagagtggtcctaaagcctccctagatgaatttaattatttgggggaaggttactagtgaccaattgttgacatatatataagccccatttcatacatgccatgaataataggcctccctggggtaacaaaaatttaaagatcattctggaaaatgagacaggaattaaaagaactctatggcttgctttctttatctacctggttctggcaatgtgagaataggttttctgaagaggagccaatagtttgtttttccacttgtgggttacaatggtaaaatgattgttggcaaaagaacatcttttcaagcagcttcccttggtgtaggtcagaggggcaacaagcagagttatttctgcagctgggaaaaaggttcagagctatcttcctagaatcggctcttgtttcagaatctaaaatagatttgaaatattgtgctatttgggaattggggcctattcatgctaagcacatctgtgggtagctgttgaaattcaaataaattcaaataaagtccaagtaatgctcatactacacttaccaatttcaaattttaaaaatacatatatacaatacctgcaccccatttggtatcactacctaagacacaatatggaaagccttgattttctgccagccatagctgctttgaacctgaaccacaacatttaattcctttgaaaatgccccttcctccctacctgaacttttcaactgagattcattttcaaaagtttaaatatgaactatagcaaatagttctatattttggttttgatcatttgacagactttagtagctgcaatgaggttgttggactacttaagtcataaagccaggattgaataaatgcattttccttctcgtcatctttctgatttcagtaaatacagtttacttaggtgtggtgattaaggaaacctggtcgatttatttatacactattccattccatattcaaggtgtcttttaaaaggcaaagtaagggaacttgcctttttaaatttaaccatgactttcttatagtgatctacccaatgtatggaaagaagtagaactggctgggtgcagtgactgacacctgtaatcccagcaagttgggaggctgagacaggaagatcacttgagcccaggagttcgaaaccagcctgggcaacatagtgagacccagtctctaccaaaaaaaaaaaaaaaaaaaaattagctgggaatggtggcatgcgtctggagtcccagctacttgggaggctgaggtgggaggatgcttgagcccaggaggttaaggctgcagtgagccgtgttggcagcactgcactccagcctggagcaagacccctttctcaaacaaacaattattttaaggttgtgagtttttcttttttttccttaatagttaaaaatttgaaaggcatttaagtgacatattcatgtcataacctgagagtttacaatgttataagtaggtaacacattaagcacattatatgaattatctcttaatttaaacctcataattacccaatgaagtttgtgtcatcatttccatcttacttataaatgtatccaaggcttacaaataagtaatttgtccaaggtcacacactcagccaggagtgaaactgtgcccattattcaaattattaactgttttgatttttattattatttgtagagacaggggctcactatgttgcccaggctagtcttgaattcttggccttaagcgattattccaggtcagcctcccaaagtgctgggattacaggcatgagccactgtgcccagcctgagctgttaactcttaatctaaacaatgccttttacatgagaaacagtaaacaagatggcaagggatggcaaagaggatactgaaatatgttaggagctacatacaagaaataaattcacagttaaaagatgaagacctttatctaaatccaggcaaactgcaaactttaaaaagaattatgataagaataaagcatcaggaaggagaaagacaaactgatgacactgatatcccagaataaggccccatagacaaaggtataaccatcatcacatatggttggtgactcccacagcgtgttcctcaccttccccagtgcctttgggaaatgtgagtgttctctgtaaaagttctggcatggtgaaagatcgtaactctaggaagctgaataacttaccatttggcactaatatccctgatttcttctgtttaacttttttgctctcatctctatgttgaaaaatgcaatagatgttaaaatcagtaataatgttcaataactagtacagctgttcccttgttccacctcaattttatttatagaaaagccattattccactattctatatcaataacaattttcatttgtttttctacgtgtataatatgaattatattaaataacaaattttccagtttccataataataattctaatgactatataacagtctgttgagttgatgcactgtaatttatactgggtattttgtttccagttttttgctattataaatatccttccaagaatttatttaggcatctaatttacttaaatttcttcatatgcaaatagtatgtttatgtcctctgaccatttatctcttgaggttttaatatttttgaagatttggataagtccttaatttgttatgtatactaacttcttccctgtttcctaattatgtttcccttcttgtgtgtttcaatcattgttagtttttttatgttaaaatcactttttcttgatgtttttaagctatttttttgtgtgatttccattgttgccataagcttttcaaaaatgctgtctaaagatttcacagatatttgatgcatatttctcctagtttgctaaaaattaaaggatatagttaactctttaatgcactatgatcttactctgctatgtaccataagtgctaatttaaattactttttgtttttgtgttttttagccagttatcctggcaattattaaaacataattagccagacatggtggcacacatctgtagtcccacctgtttgggaggctgaagtgggaagatcatttgagctcagtagacgaggctacagtgagccatgatcacacaactacactccagcctgggtgacaaagcgagatatgtctcaaaattttaaaaataaagataaaaaataaaaatgaatacaatgaataaaatgtaattactaacttattttttcctaattttatgatagtatatgttgaatttatttctacatgtcttacactgctttattcaattagtgtaataacttatactttaggttttaggatttcctggggaaattctggagactagagcagcatcataagtcacactttctttgttagtgtggaatttcaatatttaacaaacagtaaataacttcacttggtgaacattgtttttctgtataatatatatctaaatctgtttatcttgttttgtatagtccattaaagctttgtacttttctttacatatggcacatacaattctttatcattttctttataaatgtcatggtttgaaaccacgtttgcagagatgataaaagtgagagactgaggcaagatgcttcttgcctcacaggtggtgctccttgctcattccagggcataggccaagctcactatggaagaaatttagtttatagtttgactttgaaccaaggatgataatagtccctccctaagactgatcccctccttgtccgggactgaagccacctttgtaaaactaatgaaaggccacaagattagtattatgggaggagcctcaattctgctcaaatgtaggcatagtttctataatcccttactgctcagtactcatgtggccagaggtcacaagatttaagacttccccaattgcgcccatagataacatcactattgtagaacctacgattgggtttttgagatgttttttcacttttgttttctggcaactgactgaccatatccaaccagtgactcatgactcaaccagtgtgtcctgtggccccccacccaaaggaggactcagcacactgggatcattttccatacccctgtgatttcatcccaaatcaatcatcggcacccattccctatccctctgtgcaccaaattatccatacaaaccctagccccttatcagagagactgatttgagtgataaccccagtccttctgcttggcagccttgcattaattaaactctttaactgcaataccaggacctcagtaaagtggttttttctgtgtcccctccacccttttttgtggctatgttaaatgggatttcttctctttttgttaaactagtggttaccacaataaagaaatcccctaattatagtgaattcactataaacctagtcactttgataaactcacataggctaataagcaaatttcttaggatttttagacatgcattgctttctgcaaataatcatagttttctctcaccccttaatgtatcattctgttgtcacgaagtgaatgcagttgccattattcctgtattagagtgctaggctggaaaggcaagaaacatacatgttactttcagttcctcaactgaggaagccattgatgaagcaccttcttttcatggatcaagcaccatgctaaacacttcatatcgaccatcttgcccaaggctgagaacaagcctaccaagtatacaattattaaatatcagtgttgaggaaactgaagtttagcagatgcaggctgcccatgttaggccccaagaagcaataaaaaatggaacactgaggggcctaactatgggggtctgtgaatgaaaggctgtgagtctgtgtctctgggctcctgtgactggcaggtttatctctacccaggagctgcattgaccatgaactttggccagtgatctatgaggaactagggagggatctcagagctgaatccgctcgcctgcatctgtgtcttgtgcatatgcttcacacttcctgtttctaggtcatagtaagtctaatgtgaaagtaatcctgaaggtagtctatgttcttgttttcactgctctccaacccatcagccctttgaggttaatttatctcagatcttagaaatagcaaacgatggagtaagtggcttccttcacgaccagtggtctttccattgtaccaatgatgtcctcatccaaatgtaagtcagataagatgatccaattttgacaggctgactgttcctgaatatgcattatacaaattctcacagaggctatactgtccacatccttgagttgcttatattgctttgcacataacaagtattcaataaatatttgttgatgcagaatgaatgaatgaatgaggcaaagacaacagtcttaatgcttttcctacaagagagactttcaatgatagaatacaaactcatgtggtatctcctaaaaatctcaccatttcacatttcaaatgtggaagcttctataaagactgtatttgtcatgagccttttcacaagaagatgtttagtaccaggtcagcttgttttcatcttgttttcaaagaattggggttaggaaagcaggaaactaggaaggatcaaggtgggaacagtggtaggcaggcttttctctgacaaagttgtttgggttatttttatctttctgcttctgttacagcaacaatatgagaaaactgactgttcaaatttaataaatagagtctgtccaaacccaattttgaacaaatgacaaactatggtgcacatgcattaacatttctgtttgggtatgcaatgggaaactaagtcttatgttctcgtctgtaatttaaacatacaaagttttaaatgttccattagaagatatactacaatactagtacattaattgagtgttctttgttatgccaaaaaattccaaaggaagttacacagcccctagaaggcatagaatctgtagattttgtaattatggtttttaaacttaaaatctcattgaagtcattagttaacatttctaaactttttgtttgtttttgttttagacagattctggctctgttgccaggctggagtgcagtgggacagtctcacctcactacaacctctgcctcctggattcaagcaattctcctgcctcagcctcccgattagctaagattacaggtgcccaccactacgcccatctaattttttatatttttagtagagatggcatttcaccatgtttgccaggctggtcgtgaactcctgacctcaggtgattcacctgcctcgacctgccagtgttgggattacaggcatgagccctcgcacctggccacatttctaaacttttatgcctgaataattctgaacagatattccaataaccttcctgccctccacctcatcccagccaaagccgggagagagggaagacctatactaccaatagttacaaacaattatttttggaattaaaaacaggaatttgcaccatgaacaagtgtctcgttttgtcttctgagcttctcaaaaaccaccattatattgagactataaaattgttctttaggctgggcaagatggcttatgcctgttgtattagtctgttttcacaccgctgataaagacatacctgagactgagcaatttacaaaagaaagaggtttataatggacttacagtttcacgtggctggggaagcctcataattatggtggaaggcaaggaggagcagtcacatcttacatggatggcagcaggcaagaaaagagagcttgtgcagtaaaactcccccttataataaccatcagatctcgtgagacttaccattgcaagaacagggcaggaaagacctgcccctataattcaatcacctcccaccaggttcctcctatgacacatgagagttgtggagatgagatttggtaggggacacagccaaaccatatcaactgtaatcccagcactttgggaggctgaggtgggaggattgcttgagcccagaggtttaagaccagcctgggcaacatagtgagcccatttctacaaaataaaataaaaaattaaccaggtacggtggtgcacacctgtggtcccagctagtgggaggatcacttgagcctgaaaggccaaggctgcagtgagccatggtcacaccactgccctcaggctgggtgacagagcaagactccatctcaaaaaaaaaaaaaaaaaaaaaaaaaaaagttctctgaaactaaaagaaaaatctagggaaattaaacattttttattgcaaatcacttaaccttagaatgtcaaagattttccctaagtttttatataaaaagaagcatgggagagagccatagggaatcaaaatttatgagccacaatatttgcaagaagagaaaacattacatcagccatgcacggtttctccaacatggatacaaagcagaatgatgtaatagcagctgcagttttgtgctaccacattaaacagtggtgcttttgatatcatttaactaaaccaaaatatgcagttcaacctcacatagctcaaaatactcagttcaacctgagatggtcctgaattaactagaccatgtttcaggcttctgaatattatttttaagttctgtgtaaggtaaggtataaaagaagaaaaaaaacctccttgcctcaataactttggttttaataaatgcaccaataaatttatttgaaccctgagttaaaatgattcagctctagtggatgaccaaattgaggctgcttttctttatttattcaagttagatttcatgtaaacccttaaattgtatgaattcaactatcatttctaaagcagccagactaatatgaacctaaatctgagtatacttttccagaaacagctgactatttaggtctcgttatctgtcctgtatctcactatcttcttcccaaccacaggaaactgaggattggctactgactatttgaaattggctatttcatagaggtaaaaatctcatcagtatgctggcaacagtctttaattttgaaagaggaatagtcccacttgactatttctagcttccagtattaggtcaggagagaaaacatttctttagaaccttttccataaaatcagggaataatttaggaatggggaaatcttctagtgttttatttcagctctcctagggatgtgcttcccaaggctttgacagggagaaactgatagctatcagtgtgaatcagctttgtgtctaacaatttcctttctaaggaacatcaagcatagagaaatgattaagcatatttatataatctaacatattaagtgaattacatttaggtgaaattggaaagtcagcacgtattgctttataatgaacatccaagccctgcttgatttgcctaatggactatttgataagggcaaaatacattctgatttaatggaatttctaattagttaatatttagtcaaagtgcaacattaagcgtatccctaattatatgtatgataggagtttacaaagcaattggtatgggttttatatttatatttatatgtcatatatctttttctgaaaaaaagttgaaactagaacttaaatagcttacatgtttatcctttctatccttgttaggaaaaattcctttaaagagattacaattattactgtaccccgataatcattattatccttgtgcttaattttcattcctctaacctatcctttaccttgagtttttatcccaaaatacaacttcatccatgtctttacagaaaaagtaaaagtccttagcaagctgtgcaagacccttcccctctggccattgtcccaatagcatattttagttaataaaagtctctcactcaaaatgtctggtgtctccatgttgttagtgtaggtatttcagacagcattctcctttgttaaacatcctacatacattagtctaatagttgtcaatgttataacacttatttacacactgggggaaaaattacccttgcattaccatgatggagttactaaacccactgagaagactcaataccatgggtagaatcttcattagtgtttaactctggatgtcattacctcccagctagagacattgtcaataaaatttcagcatttattgtaatgactttgactttgatcatgaaaaccacatttcatctttttctttgggttcagattgttctttcacacacacacacacacacacacacacacacacacacacacaccacacacaagaaaaattgtttttttcctttagggactttctcaaaccctttcataatcttttgttaattttaaattgatatttactggagaaatttgaaaataattaaaaaaggaaagaatgaaagccattcttatttcacggggtaaccactattatccctttgatgcacatttcccaaatattttcctgtccatatgttattttctcacaaaagtggggtcatccgctacatcctgttttgcaacttgctttttaaaaaagcataataccatattacaatcatctttatatattagtaaaaattcatcttcataaatttaatggctattatttctatttatggaaataacatataaaaaatcctaattattagacatttaaattgcttgaaacactttcctgttacgtacaatgctgtaatgaccattcttgaggcaaaatctttacctacatccttgattattaggatagaattttaggagcaggatcgctgaatcaaagtgcatgctcattttatttgtttacctatttaataaggcaacacaggcaagatgtacaaaaattcagaaggaccaatgggagattcagtgacaaataactctccctccttccttttccctcctaggagacagctacttttaatagtttccatttatttttccagagatatttaatgcatttatataaacacacacaaatcctttaatatgcctattaagaaattagtaaaatgggccgggtgcagtgactcacatctgcaatcccagcactttgggaggttgaggcgggtggatcatgaggtcaggagttcgagaccagcctgaccaacatggtgaaaccccgtctctactaaaaatacaaaaattagccaggtgtggtggcatgcgcctgtaatcccagctactcaggaggctgaggcaggagaatctgttgtacttgggaggcggaggttgcagtgagccacagtcgtgctactgcaccccagcctgggcgatagagagagactccgtcttaaaaaaaaaaatgatttcaataatgaaaattgttttataatttcatgtgctagataatcataggcacaaagctttctacaattaggcaacattcattatttcagttctatattatttcttaatttatattttaccttacctttatgtaataatatattacttgtcatttaccatgatatttttatcttcattgaatactttaaaaacattttattataggaagtttcaaatgtacccaaaaagagaatgcgataaatccccaagtctccaactactatgcacattttaattaattaatttatttatttatgtatttatttatgacggagtctcgctctgtcacccaggctggactccagtggctcactcggctcactgcaagctctgcctcccaggttcatgccattctcccgcctcagcctcctgagtagctgggactacaggcgcccgccaccatgccgagctaatttttttgtgtttttagtagagacagggtttcaccgtgttagccaggatggtctcaatctcctgacctcgtgatccgcccgcctcggactcccaaattgctgggattacaggcgtcagccaccgcacctagcccattttaagtctttcaataaacaatgccaggtttttctctatgaaaggttttttagtgagacttaccctatcttcattttgttgagttgaattttatagctgctgaagccagggttacatcttttagcaagaataaattggtggttggaatagaaaaagtatagtaacttttgttgcactgtgacaatagattttatctggcatggtaatgccaatcaacttggcatcatttcctggctcagcgagttggaataattatgagaatccattcagagtctgtggggaaaactgctaggattgattagcaatgtctaccattggaaaagtagagaattgttggcttttatgacatagacagtttgccgattctgctttagcttacatgcataacagcatacttttttttaaaccattcttttgcttagtagccataaaaatcaatttggcttatttaaaagtttcataatgaaacatacctatttacctataggtttcttttgccagatattatattaacaacttttcttaaaaataattttattttttgaaaggaactaaataatgtcagtatatagatgctgctgtactatcattaaggaagcatgtgctgaggttgtgttctcagaaacaaggaagaatgacatttgtccagtcatggagctctgtggctccatgcagggccatgaatttgttgatgtctgtgatgtacagtcatggaacagagagaagctaactgacccatgataagttaaacctcaaatcttaccacttttaatgccacagtaaaattttctaaactggtcaaccacaacaaaagtatatttaaaaactaatatgaagtatatcaagaatttaagaactgctgtttcatgaacctatggaatggcagatctgaaagtcatcgtggagatcgtttagaccaggagcttgcaaacgatagccagtgggccatatccagcccactgcttgtttttgtaaatcaagttgtactggaatactgccaggcttatttgtttatgtattatctgtggctgcttgtgcactatagtgacccagttgagtaaatgcaacaaggctatatggaccacaagcctaccacatataccgaggctatatgaaccacaatgcctaacacatttactatctggccttttattgaaaaagtttgccaactcccgattttaaccaacttttcattttagaattatggaaattagaaatcacagaggttgtgtaacttgtttgggataattctaccacttgagaaaatagccaacagaattcccagaacccccagtggcaggatccagagctgcagtctcaagagctgcagtctctatctgaaagagagcattttcacgtctctggaagccctaccctaccttgtcagccatgctgccactccctccctccccacttcacacacttaatgcaataaaggcaaaatgaatacatggatgaaaactctcctgtattcatagaatatttctcacattccttcatcattccaagtattatacggaattgtaatcatttgcctttcccactagaacatgagtgcactggggacagggacaatgccatatttgtctttgtatcccagatgcttagcacagattacagaataggtatctattacctgtttgttaaatgctttggatttgctatcttatcttcttccatgcccattttaagataaacttcaactacagggaagataaatgcaagttgtggtttgtaattttcatcattcctgaccaagacccaccactgagacccaacaataggagatatccagaaccaaacaccatgataggaaagttacaaatctgtttttttcattgcacctactaaggaatggcccaaagcctccaaggcaatcttgacctgcatccctggcaaacagatgagaacctgatgtaagtcagggataataagagtgaagaagagagagatatgaaagattattaaaatcaagaggacatcatggttgattgactgtccagggggtggttgaaagtctgtgactgcccagattctgccaagtttcagaatgcaggaggaagagcacattgggtaagggaggtgtgggtgggaagggggcatggaggtagaggcagataggatacaagcggggaggttcagtagtcaatggtatatgaagctgcagctttcatgataaacatgggttcagatgaagtcattcagagagtaaatcaagattaagagaacacaaaattaagcctagagatcaccaaaaggattgaacaaagtaaaaaggaactcccacttagaaggatcacctagagacacaggagggaggcaaaagggtagtgtcccaaaagccgtgggcagagaaaaggaaaaatgtcaagtaagatggcaaaacaatatatgcctttcatttagcaacttggtggtctgtgacaaccttcctgagagccgttttagtggaggagttgtcttggaagcctgattcaatgggtagaagagtaagtgtgaacttgggaagagacattgagtatattttactcttaagaaacttaatcgataggaagaaagagaaatgagatggtaactggaagataggtttgtattccactgagtgggtagcatcattgatttgtgaattctttgaagagaatctaccaggtgtcagaatcatagagggaaggtatataaaagccaggtgggaaaggaaacatcaccaagaagaggaggaatttatctctatgaggctaggtcttttcacttataaatggaaataataatagcttcctcagagagaagttggaggtttaaacgaaataacataatttaaaacattttgaaaacagcaaagcactattcaaaaccagattattctatatattatcaactccagttgattaccttgactcaatatctgattagtctcaatcttagagtccaattatgattaactttgtcattgcagctcagaagtcagggatcaatttccttttcctgacagtgggatatattctgatgccttggatgccagataattcttatttacttcagttatcaaattaagtaccatgtttaaagcaaatcagtggtgctgccacagtgcacatgcatagtcaatggatgttataggagatacagatgtctctgtcagtaggctaaggggtgcaagttactagcctacatgatgatacccaggacaggtaaagatgagatgatgttggtggctagacaagatttcagtcgagtaagacttcccatctccttagaattatagtagcaaagatatcatgtggcagaaatcaccagagctagactctggtgaaacccttatgctcaattttttgtgatgtggaagttccttctaggctctggtattacgaagtaaaattaaaaagccaaaatcaaaagcttactcttgtgaatcagagtgttacaactcctggtgagagaactaggaaggagatcttgattatgggaccattttctaaggagttaaatacagattgtagcaacatagatcctagattatgaaaaatgctttactaagttttgctttttttccattacacaaattcaatttgtttgaacaagattataaaaatagtaattataccctatcagctaattatttttttagaatgaatgagttataacagaagcaagcaacacagttagcaagcatcattactgtttattttcattttttcatgtatacacttacttatttatatcctatgttcttccacaaaggagccaaagtgactgttgctatttatttcatatgttgttattcataattcattacccagaagacaccagttctcttggtagtgaaatatatgttaatttaagtatttttttgcctcaaacatctcaaatagtaaattaaaatctcttatgaaataacagaagaatatacaagttctccaagtccttcaaagaataaaaatattatttacactcctgtatctgttagggttagagattggggactttaaataaaataactaaaataacaaatgaccaccaaatcccaccgtcacggacgatgggaaactaaaatcagctttaacattttcagacaatttccaacctctcatccactcctcttttgtgtcctcaccctgctccacattttgctttactctgccctgctctaagcagatggcccttgtggtcatatgtcaagatcctaaaactatttctgacctggaacaaagttctgcctgatttgatcttagttcaggtcacatgtttttctccatctattcctatgaatgtttaagaaaacttattcacttccttattaatagaacaaaaacatttgtttttgttctattgcttgctcttacatggttagccaactacaatgaaccactcactcctggggaaatcactagaaacaaagatttaatggataaaaacaccagactagtgacaattttttctgatggaaattgtttggaagttttttttttcttaaatatgaaagtagagctgtgtgacttataattaaatgctgattatcctctgtatggacatattcacaggtagctgtgtgtatacttgtatatgcacaggaaaggtgtgaaagaatacaccttcaaagagtggccatatctaagagtggggctgggagatgagaaaggagagctttcacttcctgcttcctgtatatcctgtttgaagttttacaatgatcaaatattattgttttaattaataatgtgaagaatgaaaatatttctaacattcacaaattaaagatgatagcatggttgatttgaaattttttatactttgcacagtggtgttttcaattcagtgatttatgacacattttgggctttatcctaatgcacgaatgattgaaaataaaaagatgaaacttaccctaattatcatacatatacaattcctgttagatatgaatatcttgcctcaagatttttattaaagagttctaatttagtcctatctctgtgactaggattataaccttttaatattgttaccaagatcttatacaaattactcattgaacaagcaattcattgaacaccttgtcaacccctgggctgagcattgagggcagagatgggtagacgtgagccccttcagttgtatgagctagctttcattgcatgctttccatgccccaggactctgtgtagtgctttacatatattaactcctttcatcttcacaacactcctgtaaggtataaatattattaaacccattttactcagattaagaccctgagacagatttagaatcccagaggtctagctctgactcaaaagcccatggttttaaaccgtgacttcgtagtgccttctggatcataaagtagatgtaatatagtaggagttttacaagtaaatatttaagtatattttaacatttgtaattatttaacaattggaacaactcgaatttccaacaataggaagttgattaaatacaacggagtctacccatacaatggaagacttaagaagcatttgaaatgatgatgtagaatgtagacactgatctattaacattaaaaaactatctttggcctggtgcactggctcacgcctgtaatcccagcactttgggaggccaaggcgagtggatcacctgaagtcaggagttcaagaccagccaggccaacatggagaaaccccgtctctactaaaaatacaaatattagctgggcatcgtggcacctgtaatcccagctactctggaggctgaggcaggagaatcacttgaacccaggaggcggaggtttcagtgagccgagatcgtgccactgcactccagccttagtgacaactctctttatattaagtggaaaagattataacagttcttataatatgatttaaactttgtaaaaaaaaatcatataattaaaagccaaagccagactcataaaaagcatccacatgcttgtaggccaaagcaggctccataaacgattcaggtcagaatactgggggatgcatcactgatcactgcactttctcccatggagcctggacaaagcttcactcgtctcctcaacatacagccccaggcatccactaccagtctatctgaggtggccctcaagagaatcctctttatcttttgagcatttgctaccctcaattccactgctagaatctattcatctagtatttcctcttggtctcattcttatcccttatttcattctcctgtgtgtctccacgtgactcctttgtgtacacttttcttgtgactcagttttaccctggatcctggtttgctacttctattattgctctctttcacatcatcacctttttttttatcccatcattcccataggcacacaaatatgctcttgtatctacaattgttttttaaaagatgtcctctagagctacatcatctccagccctttatagcacatctccttgataaagctatgttgactgtttcttctttctcacccacctatttttctcttcattccctcccagcaggctttgctttctacctctccattgtaaccaggatcaactagtgtccttgactttgaacttgccaaatccagtgatcagttctttggcctgtgttacttaaacattcagcaacccatgagactgttgagacccccttcttgaaataccttctttgctgagcatcttcgtttcttcaggctgctgtaacagaacaccatagactgggtaatttataaacaacataaatttactgctcacaggtctggaggctgggaagttcacgatcaaggcactagcagattcagcgtctggtgacagctctgctctgcttcaaagattttgccttccagctgtgccctcatatggtggaaggggctgacaagctcccttgggccctcttttataagggtactggtccctttggaatcctcatgagctaatcatctcacaaaggccctatctcttaataacaacacattaggaattaggtttcaacatacaaattttgggaggacacaaacattcagaccacagcactgagtttctaggataccacggtctcctggctttccttctgcctcacttgctccatcttctcagcctattctgtgggatgctcctcttgctgaccacttctcttctgtttccatttattcccaggtattgccatctagccctgtggcattaaatatcatctgtaatcagttcccaatttataattccagtttcaatctctctcctaaattctgttgttaacgtaggtgtctaaaaagcatctcatgcttactgtgtccaaaacagaacactcaatttccaccctgtggctaagactgctagctgtcctccagtaatcatcctctccttctattgtaatacatgtgtttttactgggcacacagccactcagaataaagcctacattgacaacatctcagtctcttttgtagctgagttctggccaatgagatgtaatcagaagtattgtgtggcagctgctagaaaacctttttaacatactgcaaacatatataatcttcctcctctttgccttcatctatcctgctgtctggaacacagatgtgatggttggaactttagcatccatcttgggttatgagaatggaggacaacatcctagaaatcatggagtggtgagttggaaaggtctctgaaggtatggagttgtcatacctgtcctggactgcccaccttcaggcttcctttatatgataaaggaatacagatgcttcttgacttatgatagggttatgtaccaataaacccattgtaagttgaaaatactgtaagtgagaaatgcatttaatacacctaacctactgaacaccatagcttagcctagcctaccttaaatgtgctcagggccaggcgcagtggcctttgggaggccaagatgggaggatttcttgagcccaggcattcaagaccaaccctatagctgggctaaactatttggcaatgcagtacattgtagagtatccactgtttaccctcgtgatctgggagctgtggtttgctgctgttgcccaacattgtgagagaatatcaatgcatattgctagcctggaaaaagatcaaaattcaacatttgaagtaagatttctactaaatgtttatcatgttagcaccaccagaaagtctaaaaaatgtgagttgaaccattacaaagagtccccccatcagggactctctgtaaactaccttcttcaagccactattactgtgcttcaaagctgaatctaaccctaactaatagtcatctatgtctatcagagaacaatcctcctttcacataccaggcaactgaaaatataaaattggtagaaaagatgatccgtttttacactactttgctcaacagataacttttctagaatataattgtactgattaaggatttatacttccattttctcaggttttaaatgaattctaataaaaatctttatgctgttttgattatactcctctctaaatggatttgtcctcatctgacattttgtgctggtttgaaaactttcaaagacaggcctaaaacaaaatacagccttctcaatacataaaatcatatccaaatgtgagttttctcaggctataatatctagaattttttaactttgaaatgcaatgtttattcaatatatggtaaaaagctccgtaagtatttgtgaatgaatgacttagtaaagagtatactatcacataattatttaactacataaaattaccctggtgatttaaaaacatgttccccaattttttgatactcttttcactaaaggtgagtgcatttgtgctgctataacaaaatatcttagactgggtaatgtatacagaaacttatttcccacagttctggaggcttggatgtccaagatcaaagtgctggcaagttcagtgtctgataatggcctgatctcttcttccaaggtggcaccttgaacaccatttcctccagagggggctaactctatgtcctcatagcagaagaggtggaaggaatggaaggaacagacttacccattcaagccctttttataagtggctaatcccatgcataagggccccccctcatgacctaatcacctcctaaatgccttacttcttaatactgtcacactggcaattaaattttaccatatgaaatttgggggatacattcagaccacagtaggtgagatctaatttccttccccttgaacatgggccagccttagtgactgacttcaaactcatagaatgtgttagaggtgacactgagtgtcttccaagactaggttagagcaggcagtacagtttctgcctggctctactggacatacctttggatccctgtgacaacacacacataaaatgtctggctactttgaagccgccatgctgaagaagtcatgtagggatagagggagacgactgaggagccagagctgttgcagaacccagctgactgagttttcccagcatcatctgccagacttgtaagtgattccagttattccagtcctcagcctcagagctgctcttggcaagtactgcaaagatgaggtttccctgttgagccctgaccaaattgcagacttgtaagctggctaaacagtgtttgttatttctaggtgtgagggtagtttgaacagcacccacagtattgggaacattccctcatcagcacgttgactctctatgctgcttgcttgattgtcttggagaacataatgaccctttcagtcattccctttgggttaattccctctgtggaaaaggggtattcttgcacttgcctgccactcctgtagccacaatttagagagggctttgttcccttcacctttcctctatccagggaaaatatcagacctgttgccttccaaaatggaaacaaaatcacctgtttcaaagcaagctgccttaagatgtggtctgtaaagatactacaattaagtgataagctttcccttttctttaccctagaaacagaaacagactgtgtttcagcataatgcaggtgaccaaggcatatcctccatataggaacagagcaactaaaaagaaaactatagcctcattaacttgtctgaggtagtgatttgttaagtgaaaagcagtgggtggtgtagtttttaaaaaggtgggccatattaccatttcttcagtgcttcctggggaaaaggatactatcattatgtatattctctaggccaggtttcacctaggctagagaaagaacaatctaatgtaattctgtctcattagtgcattagtgcatttccctcaaaaggaaaattattttataaatggctgatatacttgcctactataaatgatgcatggtattctagtttataaattgatctcctaggaaatcaggtgtttgttcccctaaacttgatcattccagagagcttttaggatcaattccttgaccagagaagagctttggcaactccaccgatgtaacggtgccttgtaggatcccacagaaagctgctaactagtttttttctttctgtgatgtacatttagctgtagcaggaaatagtgtgtaattagaagaggctcccaaaggttgaggccttatctggatgattgccaagtccaaactgcactttgtagacccaatctcagggagtccagtttcttccacagcaggacccacctactggctttagtttcatggttgtaacttctgcgaccccaagcttttaattctattcaaagcctcatcatctaaaagtcatttggaaaactaaagaatgacagctatcaactatatataagtagctttcaattcaaaagagggaggtgtaatataatgaagttaaattacattttgattctggttgctagatattctttgatcattaatggtgtcagcaaaattgagcacaccttaaagtcagacaacctcttccatgaaatgtttctctcctctccctttcagcctcacatccttccttcttctactttgtcacctcccactagataagcaacttggatatattgatgacgtcctcttatttgccaaaaattcaccaagctgttaataacttagatttatttatgaaaactacagcagatttaagtcaaccaacaggcccaagctctttaaattttttgttactagggtgacaattctacacccaattttagttttcaaaatctaggcagaaacacctttattgggatttagcaatgactttgttttataacctgcagagattattaggaagatacatatttcttcctcaccttctattttgttctatatttttgttaaaagttggcatatgagtacaaaaaggaaaacgttttttatgatcatctctgtctacataacagactgaaatttgtgagcatttaacacatttgtgccgaaaaatattgaaattataaaagtaccatttacaggcagccacctaccaactaaaacattactatggcattcttaccttccatcatgagcctccctatgaactgagtcacataggagaatctaaaaaaaaaatcctgggaggttcaaaaggtagccatttccctaacaatgagacatgtccataaagaagggcttcattatttttgattctcgtcaaatatttcaaggcattccgagagcccccatcttcagggttaaccacatgtagtatgctcaatacagccggtgtctaatacacagccaaacagtcgtctttccattaaaatgtgatttttgcttctgcttttccatctagcacatctgttcttctagcggttcttgtgtcgttagccgcctttccatcccaccttggcgctattcttttaattcaattgtgcgcaaattgcatcaggctgtcagggcttcgctttatgaatttccctttgaggacttgcacattcctctcggcacagaggtcggagccggtgggtgcccggctgccgccgccccgcgatcaatggcacctgaagcttccccgggcgaggccgtggctgcctggcttggtcccggagtccacggccacagagactggtgccttgaagacgtggtttttataaccatagaacgttgcatgccttattttaatggaaaaggtatctaacgaagtcggccgtaaagcaaaactccttaaataaatctgttcccccacccctaccatttccattataaaatcaaacaaacagtatcagcaagccgggaaaatacagagctttttatgtttgcacctcactttgttcccagcaggatttaaagtgatttgtaagcgtatgtaaaacaagagcatgtacatttaaaagtgaaaagggattaaaaactagggtggggacataaaatagagccaggacaaggcttaagtgatgcctaaaataacaacctctgctatgagtgggccacaatttggcactagattatctagtagttctctatcggctaatggcatcccccaaccccaactcaatttgtttatgagcatttttggtgggagatggagagatcagggtgagggtgaaaacgcaggcgtgtctggccaactcatttttcatttggcttcatgtaggagtcgattttaacataactggaagagagaacatcctggactgtgcatccttaaagcaatcttcctcaaatattgctcttctgagacaaaggcgctcgtaaatattggaaggcattgaattcaaaatctaggcaggcttgccttgccaagaacagaaccgtaaagatgtatacagctgctctctctcctctccttcacaggcagacagctagaaagatgatctattcttgctgtcttagattcttaacttccccctcactctaaaaccatgcaaatctagcttccacccccaccacttcactgaagctgagcttgctgaggtccccaaagcacttttcagttattttacttgggtcctgacagcatttggacactgactgctcccttcttaaaatacctttgccttgggttttcctaacagcacacgttggtggctatcatctccctcttctctggtcatgccttctacatgtcctctgttgccttcttctgcacctgacccttcaatgttggttgggatgctgttctagtgctgagaaccctgtaccagaaagggtccacagaagtgtggccaccatacagaccggcaaaaaaaatctaattcctctgaatcccagagtgaagaatttcatgaagctcttgttaactgaataatggctgcagtagacgtggtatattggcttggtcgacctctattccaaactccttctggggtctttcacgtactgcagacactggagagctaggagctacatttcctgactgcctcgcagcaagagtttcaaatgtgatttagtcattattaatcagaggtattcctgtgaaatttgaatttgggactgagttcagtggagaaagaggcagcagtgcctgaggcatccatttagctggtgtgaagatctagcccatgtggctcgggggccaacaattctggtggtgccttcctgatacctggactgatagttagggtagtatattcataaatacagtatttttcctggcagtcagattcccctaataggcctatcaggaaaaattgtccaaggcttgaaattgggtcatagagatcgggagtgtctttcaggaaaattctgatatggtctggtagaaactttaggaattttctaattctataggggtatgcactggtgacttcctattaactaaactattttacaactctgtaaggtagaaatttatttgcagcaaactatagaaatccagatagttttgttttttactttttaattttatttgaatgtagcagaaacaggatctcattctgttgtccaggctggtctcaaactcctgagctcaagcaatcctcctgcctcggactcccaaagtgctggaattaccagcatgaccagccacaaataattcttatccatagcaaaacaaatcttttttttttggtagatataaaattgattttagccctgaagaaaagataattccaaacattattttttattgccctaaagctacattgtctaatatgaaagctactagctatgtagttattgaactcttataatgtggcaagtttgaattgagatgtcttataggtataaaatatacaccagatttcaaagactcgatatgaaaaagtatgtaaaaagatctcattgattttattatattgataacatcttgaaataattatatcttggatagagtgggttaaataagatattattaaaattaattttaactatttttacttcttaaaatgtgactcttagaaaatttaaattacagatgaggcttgcattatggttctgtcagacagtgctgtcctgtagaattttagccagttttgcatctattaaccagttgattgaaacatttctgattgtgtgtgtatatatgtatacacacacacacacacacacacacacacacacacacacacgtgtatgtatctctgaattctcctttgaactggacttaacatcttacagattccctcattaattaatgtattaaataaaatatttgtgacatgtcattttatacttgcatgagaatcacagttctaacatttatactttagcagtcaattctgcagagttgctccaacaggcccaatctagatttgttattccagttcttccaattattttgtaagtacctaattccctgtattaaattccatcctaaaatggctaaggtggttttagttacctgctactgcaccctgactataccctgacattagcttaaaattgaacatttactattttccagatactgtgttaaacactttacagattattttatttaatcgtcaccgcaactctgtgagggaggcagtatactcctcattttacagatgaggcactgagagtttaagaaacttctccaagacaaccaggaagtagtagctggactcacacctaagcatactgactctaaagtctacttccatccattaccactgtgccagcacctattctgttccaccaaataaaacagaaagaagggcatatctgtcactagatatgtgttgacctagaagctgcggtgcggcaaggaagttacaggttatagtcatcccctcacttgttctgccttctctactcctaggacctttgattcaattagctggttctcagaatcctgggcatagctcaagcctgagtggctcttccagactctcacccaactgaggaggttggatgatgcgccattttccgctgcaagctgagaagcacctctgccaagaccaagaggtctcactggtggagatgcactagaagtatgtgactctgagggtcacagagcttgctaaacaggctgtctaccatctttggcaaaggcaggaaacaattacactgtaataatagttattaatggccagatgttgcactaagtgatttacatacattctctctaatcctttcaatagctcagtggggtgagtagcagtatcatccttttaaaaatgaggaatcttaggtcttaggttaattatggatgctctaggatttcctggataatcactgaactcactaatcaagggctacatatctgacaaatatttcagacattaaaacatttgataataaaggagtctatggtattatttgtccacatgtaactgaataaagaaacttgttaaagaaaggagaatggcaaaaatgttatatattatccttccattattaatgctagtttaaaagcttgaaattgacaggcaactcagtattttccaacatgcatcacattagcttttaattcattatctgtctttattttttactgtctcctttcttgctatggtcttcattttatactggcgctgaagagacatctgaaaggattatgccaccccactttagtcccagggaatagaactactatgaattattgatagtgttagctttctagtgctttaatttcacctctgtttcagacaaggatattagttaaatggaattttttatatcaccccaggagcttactacacaggaaatactgactgacttgaattattgaaaagacagtcctatgttgatttccatttctacataggatggattcttcatacattccactcccctatatttttgcttagtgttaggttaatagggcagttttcaaatggagtccctcagaacccgcgggattcctcagagatgcttgcagtacaactggagaagcaagagggctcggtgggatggtatctgcaggtagacatacacatgagtgcacacatatgcccccaaccattgccttgcttcagagaaaaacttcacttgtctaccgtaagtattaagcctttgtgcaagattatgttggaagaaaggtttcttctcttcacaaatcttgaggctgtgtatggtggctcactcctgtaattgcagctcttgggaggctgaggtgtgagaagtgcttaaggccaggagtttgagaccagcctgagcaacatagtgagaccccatctctacaaaaaattaaaaaaaaaaattagccaggtgtggtggcacacatttatagtcccagctactctggaggctgaggcgggcggatcccctgagcccaggaggttgaggccacagtgagtcatgatcacaccactgcatttcagcctgggtgacagagtaagatcctgtctcttaaaaaaaaaaagagtaaaatatcctgagttaatacaataaatacaatagatgtttgcacatctttgagatactaagaaaacatgtctaaggggttttatactatatagttgagtgtatacagctgtgcactggacttgacagaagctgatggcatgtcatatgactaggcttgcaggatggacttggccctcctgtggtattgtaagaattaccccgaattctgggtaaagccagttaccatgtatatttatgtaatgaataaactcacaagcgcaaaaaaatgcaataatattggggaatggcaccgataaatgaaccaattgcacaagtaaacttggttcacctgcttctattcgggtcattaggcccctgaatccataggcctccaatgttctttaagagaaggaatatagtcattgcttgtgttcttcagaagggactaccatgagtaaaatattttctgagtttctgtaataagagcaaatatttctctaacttgcaaagagtattttaaaatgtgagggttttgttttttgtgagttaatgagttaaaaagtagcattcagggttcctttctgtatgtggatggtataggtgcctagaaattgccctcctcccacgcatggaagctgtagacctgaagaaggtaggcagatgacaaaggctcattcattcagtatacatttatttcttcggggtcggggggtatttctttaagttttattttatttgtaattgacctatgattgtacatatttatgaatatgtatttattgagtacccactattaccaggcatcatgctaggtgttgggaatctaatagtaagacctatcctgccaccttcttttttgtgtgtgtgagacagagtatcactctgtcgcccaggctggagtgcagtggcgcgatctcggctcactgcaacctccgcctcccgggttcaagcaattctcgtacctcagcctcccacatagctggaattacaggcacccaccgccatgcctggctaatttttgtatttttagtagagacagagtttcaccatgttagccaggatggtctcgcattcctggcctcaagtgatctgccacttccacttcccaaagtgctcgaattacagcatgagccacagcacccagcctgatcctgccaccttcttagaatttgcattctgttgtggaggaggcatataataaacacatagacaatcacataaacatagcaattacaaaatgtgatcgttgacatcatgcatgcaacagagtaggggtggggcccttttcacataggggcagtcaaagaggaggccctagaacagcagaaagctaagtgcattttagaaggccacagctggcctctctgctggcttccaaagcaataaatgcgtggtgcttactgtatttgatggctaaatacatgccatctgtactcaagaattagaatgctgtggaaactctgaggggaccaatagttggtgacttcttgtataggaacaaaaaatatggcacagttaatttattacacaaatagatttttccttagttatttaacatttatcagcactgtgttttatttatttcttaacgcaaaggtgggctgagggataattaaaagtaatatacccaagatcattgtccttttccattccataaaaaaattgtctccaccactgtttatgatcctcatcaaacatataaaaaatgcatccataatgaaatctcctcttatattgttactttataactgttaaaggcaacatgatttttgtaaaggataaaatagactacaaaaattagtttcattttcaaaacctctacataagcatgtaaaatatattagagtgaagagggacacatggttatcaaataacctgacttctatcaacagaagtttccagtttacattattattctttcatttttactagatgaaccttcttttttgtttttataagcttatcagtggatcacccttcttaaatagaaatacctggaagatatatgcacacaaaactgattcagatttaccgcagaaatactagatttcaatgggacattcaagcaaatataattcatccatctacccatccatccattcaatatttattgagtaagctaaactaataggtaaaatatgctggaaccagagcagtgtattgtggttgtgttggctccttgggtgggtgaacacttttcctgtttttttttttcattcttttgcacacttactgtagaaattttctgaaaggcaagtagtcaaactgactggatagcctaagaaatttgaaattatctggccgagtgcagtggctcacacctgtaatcctaacactttaggaggccaaggtgggaggatcacttgagcccaggagtttaagaccagcctgggcaacatactgagactccatctccacacacaaaaaaatttttaattagccaggcatggtggctcattcctgtagtcccagatacttgagaggctgagatgggaggatagctgaagctcaggagttcgagattacagtgcactattattgtgccactgcattccaacctgggtgacaaagtgagacccccatctcaacaacaaaaaatgaacaaacaaaaaaattatccagtccagccaatgtgataaaatggactaacagaatgaatttggggaaaataattcaggaaaaatacatggagtggtttactggcaaccccaagaaaaagagaaactattatactactaaaggagttcagtaaggcatctgattacaatacaagaaattactagttttcctgtatcttgtttaaaaacataatgattaaaaagcatcttgttcaaaatagcaagaaaaatatgagtataaatttatcaagaaatatacaggacctgaattaaacaaactataaaattttagtgagaaacttaaagacttgagcaaaactggagaaaattttcactcttgaggacaagctgaaatgttagaattgccacttttctccaaattatttttagatttaaaaggggatgtgaaaggactggatgaaattatgctaaactctaatagaatgtatgacacaaacacggacatttaaaactagaagaataatgaggtggcggtatagggactaatggacattaaaatatattctaaaactataataattagaatagtttggtactggttttatattctaaaaccataataattagaatagtttggtactggtttagggattaagtaaatatatcaatggtgccaaatagaatgcctataaacagactcaggcatatgcacaaatttagtgtaacagttacatttggaatctgtagaaaaggataaattatttagtaaaagatgcaggaggaaatgtctattcaaaattaagacatctttttcatataaggcaatcacataattccagatttatgaaagatttaaaggataaagccatacttttatatgaagatggcatattttgaacgcatgcatttgcctctgctccctcctcaaccctacttaagtatcagtaaaaatgatttttaaaaacccttaaaaacacccacaaggacaaataacgggagataaagctacagcaataaaaccttggaaactagaaagcagatgagcgggtggtaatgcaaatttgattgtaagcattgcaggctaccaaagcagagaaatggtccagttaacacagtggaaatccctcaaggctcaggctactggaagtgggcatgaaggtggggctaaaaataaaagcactgattccaaatctgcttactaagcagttgtgccccatgtcacacaggagagcagctgccctgtctgctcaggcagaagccagagttcatttgttttgagacagtcttactcactctgtcgcctaggctggagtgcagtggtgtgatctcggctcattgcaacctctgcctcccaggttgaagcgattctcttgcctcagcctcctgagtagctggacttaacggtgcacaccaccatgcccagctactttttttattttttggcagagatggggtttcaccgtgttggccaggctggtcttgaactcctgacctcaactgatccacccacctcagcctcccaaagtgctgggattacaggtgtgagccactgcacccagccagagtttcacttttatagacacagttgaaaaaatgatgtagtgctgaagacagggattcagtgaaagttaatccctggaatgttgaggccttaaccttcttcccagatttttaaagcacacataaccagactcatagcttctaggcaggaaatagggtgtatcttccctggagaatatgaccagtccaaggaaaaagatatcaagataccaacgtcagaggctcccagatgcaatggtcaccctagaaaacctaagactggccgggcacggtggctcatgcctgtaatcccagcactttgggaggccgaggcgggcagatcacgaggtcaggagtttgagagcggcctgaccaacacagtgaaaccctatctctactaaaaatacaaaaattagctgggcatggtggcgcatgcctgtaatcccagttactcaggaggctgaggtgggagaattgcttgaacttgggaggcggagattgcagtgagcccagattgcgccgtggtactccagcctgggcgacagagcgagactctgtctcaaaaaaaaaaaaaaaaagaaaagaaaaaaaagaaaacctaagaccacagctcagcagtagggcaaaagagaaatccattgcagattggtggatggggaggctcacactccttcacccactccgggaaacatctgactgaattgttaaatctgccctctgaaatggattgttcctgctgaaaaaaactctggcccaggcattgatcccaggccccagtggtttggaccctgcttgcaggacaggcacctgaagagcacactgcattgcaggcaggtgtgtttgcaggtccctggccatctagactaactttaagggtcctcaatgctctttcacaattcctttaacatttgtcaactcctttagtgattattacaccttttcactttattcaatccctcaactcttcctccaccccacttattctcattaaattaccttacctccctcacactgagaaaatgaaagctatctcatgtgaatgcctctccctatccaaattgctctccaatttttaaaatccactgtcttctcttccatacagagaaaatatgtcctcttttctatacctaatgagtccactcatctcttgatcctgtttcttctgacagctctgggccttgttccatcaattaccactcctttgctcgaatcttcaattcattccctttgcctacttatgagagtatgtgtagtggacactgatctaccactcagattccctttcaagattgaaggattcagtcccccagaagccaggaatgctgctggaagatggcccttagccatcagccttcttcaggaattgcctcagcagaagaaagtcacctcactagagttcatgtattcttccctgggcagctctcctctaacaactgggttaatgtggggaatataaagaccagccctctcaccttgagacaactgtgaagggtcttcccagtttcagagctccttaagtcttggctaaggtcttcattgagactgcatcattgcccagcttctcccttagtccaatcttgtctcctttcctttcctcgctttccacaaattgttaaatgtgacagcactccctaattaacttcctgcatgctaatcatctcagagcctgtatcccagggtaccctccttatgacagtatgtttgtaagacaaggacttttaataatttgttaggtagtaccaagttgccctttcaaaaagctgtacaattttgcactcccattaccaatgtagaaaagtgcctcttttcctacaccctaattgccactactggatattatcaagcttttaaatcttcccattccataagtgacagatggtggcttattcttgctttatttgtatttttaaaaattatgagtatgagtgagaatgtttttacacattacttactggctatttatattcctttccctttcatttgcttgtgttatttgcccatttttctattgcacggccatacatattggtaatataccatatgccatacgtatattaattttcaagtaccatttgtatagtaagaaagttgcaaataagttgtttcagtttgctgtttgtttggctttaagactttcttctggccattcaaatgttttgcattttttaaatttgctaacattaccaacatttttcctgtgcttcttggttttctgtcaggcttaaattggcatttcccattctaagatttggggaaaaaaaccaaaacactaatgtcttccttaaaacttagctcaaatgtcattgctctcacaaagatgtctctgagtaccttgaccagagttaaccccccaattcccttctccctttatataatataaatcacattgcctatcatattctgccttaacattatggccatttttattattttccaaactcttctattggaatgtaagttactgaggaaaggaattccattttaaatctctatgtatgccctccagtatctagaatgacttgcgtaaagtcctacttaaatatttactgaattgtaataactagtactgtttgattatgtggctctgacactaagggtgagtgattttatatatatgtatacatacacacgtgtttgtatatgtatacatatacacgtacatacatatatttcacactctttctcattagacataaattttgtgaaattttgtgactatttttttgcttggagaactcttagttctgccatctttagacctcagccacacttaccaaagactgactgcaaaaacagcacttgagagtcaggtctcagggcctgccaagtgacaggtgaccagaacactcctagctgaggaggcagatcaggcagggtggttcctagcaacaggggaagcatatatggagccatgacacaaagtggccatcctccccacagggtaaacagagctcagtctcccaacaccatgaccatctgccccatcagtggcatagattcctcccaggccatacttttggctggggaagaagtccctgatgatgttgaggacaagatacaggcaggtatctcaactaggtcaatacattgagttatcagctcaggtggattagtcgttgcccagttcctatgcccagtagccctagtcttggattccatggtttcaatttctcccttttcattctcttgagcccattcaaatatggttttcatgccaccacaactgctcctgctcctgccaaagtcacaggtgacatcgacgttgctaaacacaatggccagttctcatttctcacctcactggccctgccagcagcattggcctggtggatccctctctacttcctgagggcttgattgggctccctgggcaccagtttttcctcatacctcactggatgcttccttctctgcctttcctggttcttcctctgcttcctgagcacttcacattggagaacccccaaagtacagtcattggacctatcttttctatctagattcattttcttgatgatcccagccaatcttataactttcgatactttctatctgctgacaaattccaaattttatatcctctaaccagactcataggtccaactgcctactcaccatctcgctttggatgtctaacagacatctcaaatgtaacattccaaaactgagcctctgatcttccccttcccccaaaatctgctcctctcacagtctctccatttcagtaaatgacaaccctatccaactagttactcacaccaaaaactctggtgtcatccttcactcctctccttttctcacacccacattcaatctgtcagcaaatctacttttactataccttcaaaatatactcagaatctgaatcctcctgacaaccactctgctaaccaccctgtgcaagttactatctcttaagtgtctctcttttctcatcaataactgggggcaataatagcctatgacttacagggttcttgtgtggaataaaagataagacatgtaaagaacttagcatagtgccgaacaaattgttagtgcttggccagtcatggtggctcacacctgtcatccaagcactttgggaggctgaggagggaggattgcttgaggccaggagaccagcctaggcaacatggtgagatcttgtctctactaaaattcaaaaaaattagccaggtgtgatggtgcgtgcctgtagtcccagctacctggggtactgaggctggtggattacttgagccctgaaggtcaaggctgcagtgagccatgatcatgccactgcactccagcctgggtgacagagtgagaccctgtctgcaccctcccccctccaaaaaaaaagttgttagtgcttaataaattttagctttcattattatttgtggcgtcagttttctaggaggtttcaagaagacgtggctagtaaagttgaagctatcagttccttttcataagaactgagttttttcttcaacacatgaaattttcattttaaaggttttacctaaatgagctaaagagaaagaagtccaaactaatctcacccagtaaaactgtcacagataagatccaaataaagggttaaaaagcacaatagcaatttgaatcattggaattcttctctataaaagtaattttcagctaacctagaaaatattttaaatctaaagttatataagattgtcacatatcatactgcatagctgtctacagccctagcttcacaacctgaaataatttggggatatgaggaaactcataggatgtttctacaacagcaactgagataacagccatcatttgtataaaacagccttgttttataaacctaaagtcccagctaattagtaataggtagaaagattctggaaaatcctcagtgttatctgagatgtcagcaatatacaataggcctgaactatataggaaatatcttgggtaagtgacctaatgcataaattagatgtgtggatatcactaataagataaaccattgcactaaataagaagaaaaatatttcagagcattcaacttgtcctttaatgcaatcactttgttaatatatgtggtaagaaacagtatttgaatagataaaagtagatgagcattttttcttaatatttttcaaaaattatgtttcttctttattctttaagtatggatctctttcattatatatatgtctgtgtgtgtgtgtgtgtgtgtgtgtgtgtgtagagatatatgtatctctctatatacacataaatacatgaaacatctaccacgtgctgagtaatgaggaaacaatagtgaattgtttttattactaagctccttataaaaatattttgatcgttttgagtataagagccaggtaacagtggccttggagtgttttaagttggcgggtgggggagataaccctaatataaaatcatcaggaattgactgtgcttaatttattagattttcttcatctgtatttaattatacattatactctgtggtattcttagagtgatatatacaatgtaaacaaatttaaatatcacatatatgcaaaaattacttagtaaaggtaaactcccattaatacctactgtgggctcattttagctgatccatgtatactttgtatgctaattttatttatttatctgtttttttataggaagtcctggctgagcaaggttggaagccctagttctcgcattgaccgcacaaacttttctaatgaaaaaaccatctctaagcttgaatactctaattttagtattagatactaatagaagagaaaaattgtaacacactgaacaatagatactgtatgttcttaagactatgtatactagaataatagtagcagagtagggtgaaaaggaactttctgttctgaaagctaagcgactgtacgtgctactaaaaatgtctgacactgaaataattttactcaactatgttttcaacaagcaaaaatatagtattctaagattaaaatgtcattacaaaatatttagtgtgaacatttaatttaaacttgtctcatggaatctttaatttcaatgaacattacagcatatatatgttatttggcgagacatcaaataaagttaaccatttaaaaattattttcatatactgttgtctatgttgaattataaaatcctctgaataatttgttactacggttatttgttattaaactcttcaaaaagaaccagtgattagaaataaatgtgatgatcaatataaccataaaatattatcaacaaagagttttaa

SEQ ID NO: 620 - DNA, 3096 bp, Homo sapiens
agccataaatattttgtagtttatttacccatgaacacaatagtttccagtcttccgcatcagataagaccaagttattcaaattaaaatgttaaagatacggttttaacagaaacaagaacaggctgaaaactgccatgaatatccatatccacataatgtacaaaaaagaaagactgatattattccaaatatttctatttgaaagtaaaagaaaatctgtacagctgaatcttcccagtaaacagaaagagaaaatattataacacagtattaatcttccacataagtaaggccatatgcaaacaagaaagagaacacccaaaattgcagtgtttcttcaaagaacccttctctagggaacatatttaacactccaaccatcttctattcttctacgtgcatactaaaaaaaagtacttctcttcccatcataactagtcaacccagtgtaaattctaggcccgattttcccctgaatcatttctgcctttttgttcagttttccctgcctagagcacccatcacaatctctttagttcttctatccactctgaactagaaatcacctttcattccatacagctctgtagtcctttaaaccctctaggaattgctaaagaggggtgaggggctgagaagaaaggagaatgggcaataagaggtctggcagtctattttacagaacagcctgcctctggacatgacaaagagagccaagaaactaaaaagcctgcttctgcggatgtttctgaactactacttttgttttttttaaaggaagacagaagagatttatgagagatgagagaaaagaaagtgtacactcactctggcacttcattaggttcaggaagggaggcaaataaaggtacctagattttgaatgaatccactggttgtggctgagaaagcctggtacttgtcaagaacaccaacatattaaccttgccatgaggatagggtctgacatgtcccctcaaccacctgtctaacaaacagtagggtttctgagtgatgagggtggtggtggtaaagagaggtcttttggaagaggaacaggtcttttgtgtgctgacaggaaagctgtgtccaccaccagtgttctggagatccctgtttattagaaaccagagagtggagctggcaatggtctgggatatgttcactcagcagggagctgcccaagtagcagtacttgggaatagccagtagcaggcagcaataggtgaccagtctcaggaaaagtaatggggtcccataattcacacagaccaacttgccccctgctgttctcccttgacttcattaatgcccagcaattgtccacaggccatgcacctgtactgtcagatgcagagcagggtgagctgaataggttcttagacacagctagaaatccaagtaggaggagccagaccagaggtcctgggaacaaaccgagtccaaacaaaggtaaatacagtgtaacctacagcatcattcgcttcgcttagaaggatgtgacccatcggctgggagcatgtgatgttaatgcagaatagcaagacgaccaggtgaaaggggagcagcacagccaccaaggtctcaatcttcaggttgagagaacggaaagtttaaacagagggtacaggaaagtcagaacaaaaaaagtaaagggcatacctaatgctgttgcccaagctcaggtccagctggtggtggcaggcaaccttctgcaggagtaattccaaaggcaaaggttaaccacactggaacccaaagggcctggggatctccactggctcccttaccaggcgacgtctagctctatgggcgtcttcacccaacaggtagtactgcagtggatttgaccagaggtcctctttaataatctgagcaatcctgtcggactctggaaggctgtggtctgaaaaccaggtgaagaagctgcagatgacatgtcggttcctatgaatgaaggactggggtccatggccccggcgccacatgattagagtggaaaaagacaccacttggccgaaggatctgacctcatacacctttacaatcagcttgtttctgaagtaagggtttctttgaaagaagaacttaaacttgcagcctgtcctagggtgtctgagctccttcacttccaaattggttaagtagcttaacatctcggcatcttggcctctaatcatggcagacagctgtgggtggtggcggaaagcagtgacccagaagcccgggatattgcgaatgatgtcattcctctgctccaggtagtattcatgaatctgcccaaacctgcgctccacctgcaggagcgccctgtcagcctctgcattcacggagtccagttccagctggatggactccagggggttcaggtggagacccacgttcaggggcccgggcccgggcccaggccctgcctccctgtttacctcatctattgctctgttttcttccgccacgtccatttcttcgcctcctggcttctcatccactggggctgagaacatggcacactcctcaggcttcacgtcctcggccttcccctctgcaatcacttcagactccgacctccctgccccacaggtttctagagccttctccccacctaggccgtgcgtctcttcacccggaaagccatttttgaggctgccgtcagttgtcagcgaggcagaggccgcttctaggccctccgcgggtggtggagtcacttcctgccccgctttgatggctccatgactgcgacccgcatcgaccaagatgtggaaagtatggccaccatctgcgggatcctggggcgcgaccccctcctctggaagccggggcggtgggaacacgattggctccaagcggccatcaaacatatctgccattacctctgtcgccttgctcttttctcgggacctctggccctggtgcgggtcttccagagcatagtcgagagtagcggggctgtgaggactctccgggaggctcatgttggtagcggccagggcagcagtgggtagaggccaggccagaggtaggtagcgtcaacgttcctcacacaaaatggcgagtaaacacctcgcccatttgcgccgcccactcttcagtctc

SEQ ID NO: 621 - DNA, 30745 bp, Homo sapiens
ttccgggcttccccagacagacagctggcttacagggccacctgaagacgttccagggctccacaggccactgtcttctggaggggaacggatcgactgccggtgcgcccagccaaattcaactcctgagtcctcagtctctagtcccgggaaggtaagtcagatctgactctgtctctctgggagggaaacggccctgacgaaggtcctccctcagactctgtccatgctccaggacactggaggacagagtcctggtttctgtcaggattctctgttaagtctagtctctctctctctctatctcttctccctctctcattcaggtctccgggagatctctgttttagaatgggtataaaaattgtaataaactctgagtgagtgagtgagtgagtgaatgtggagttcaagggcttgcgcttgaatttccagtttgtagctccagggtgaaagctagggaattcgagaaggccctcacctgtggttccgtggtgacctcataaggcttagggcggcatcaggcatagctcgatccaagccaggggtttataccagcctgccaatgccaagaggagcctaagtccccgaaaggggagcagccaggagggcatctgactgatcccatcacgggaccccctccccttgtctgtctataaaaattgccatgcttgtttatataccccagtgcctattgtcctgtttagtgtctgtctaaatttcatatgtcggatcgtcgatactgcccaaaatgactgggcaaggacttcttcaaggtccttagtacagattttctatcccaggaggtcaaattcctcattagtcggttgggctggccatcccagtcctgcctttcctgtcagaaacaaattaggtgttgttatggggaagggtgtggaagacattcacccgtttaggatttctggcaccataaagattgctggcgtttggattgccataccccacgccccaacgactggtccaccttctccttagaccagtggtggatccaaaatagccaccctgctgacctccttactcaccttttctgtcatcccataacttttcccatgcccttaaataaggcactgtgcagagaaacctacacccatactgctctactctgtctggactcttattttacctcttttggctactctccaacctttagggaaatccaagtggcccctttcctcctcatccccatcccttaccctgcacatctcattttcctgtgttgcagcaagtccagcgtctctaagacttggctgtgttctccctccttaaacccgtgaaggaaaggaccgagtttgaacattttgctttcgagtcgtggagacaccaaagttatttgggatataagtcaagaagggggggtcacctaagtcccactggctgaggatcccttggacccacctcttatcctctccatagatctcgaagcttgaggagacagaccttatgtggcaagaaatattggctatagttgttttcctacttcttctagctataatacttctgttcttctgataccatagcctcccaggccgtgaatatctttgtccatgctgggtttaatatttttgttcaaaccttgttaattgcctccagaatagtaaactcttcttcccggccccataaagattggagtcctctccagtgtatgttgcagaatttctctctaggcttctcagatgattacggggtccgccttaaaaaaggcaaactctggacactctgcgaagtagaatggccaaagtttggaactgggtggcccccagacgggtcactacacttcacagctgttcaggctgtgtggtgggtcgttgttggaactcccggtcaccccgatcagtttccctacattgatcaatggctagatttagtccagagctctccttcatggctccactcgtgataaaactctgtagccattcgtgatcctacctccaaggtcctttttagccagacctcacttttgcctccaccctcagctccctcgattcctcctgtactgcctccttctgaagaagaggaaagttttcttcacccatttccaccaccctataaccctcctcctcccccagaatcttcccttgtctcctcaactacatcctctgtggcctctctgcctatatcctcccaattatggcctcagccggaggaggtggccccgctcctcccactgacagaggcccaaatccctttgggcagtgggcgttgtgctccatttttagtttatgtccccttctctacttctgacctgtacaactggaaggctcataatccccccttttctgaaaagccccaggtcttaacctcactgatggagtctgtgctccagactcaccggcccacctgggatgagtgtcagcaactcctttcatcccttttcacctctgaagagagggaccatatctgaagagaagccagaaagtatttccttacatcagccagcttttagagatagcccagagagttttcgacaatcgagaatttgaaaagcaaaaacaggtagctcaggcagctgaaagggctgcagacaaagcatcaaaaagacaggcaaaaagcttagtggctgccatccaagaagccaaaaaggaagggcccccatcacagagcactgaccaggggaccccgagtccccaccaggaaggccagaaacgtgagaggactcccctataaagaaaccaatgtgcttcttgcaagcagattggacactggagaaaggaatgcccattaaagccagaggagaaaccagaaaagaaaaaggtcctcaccctgccccgcagcagaggaatctgatgattgacggggccagggctctttgtcacttggccccgggaacccatggtgaccaccacagtggggggccagcctgtacgcttcctaattgacaccggggtggaacactcagtactccagacacccttaggcagtgtctaataaaaaggttgctgagtaaagggctactggagctattcaggaatatcctgtcacccactcacgagaggtgagtttaggacagaaaagagtaacccacttgttcctcgtggtcccagagtgccccttctccctcctcggatgagacctgcttcataagctacaggcgtccatctccttctcggcccaacaaactcacctcatgttaggggacacaatgccccctactgctcagctcctgctaaccacccttcggtcagaggaatatctcttagtttcaccctcacaactgccggagaataaaagtaatcctctcctactggctttacagactctgtttcctcatacctcccaggactggcaaaccaccatctgccagctgttgtagaactcctggccaccaccctgccggtccaggtcaaacaatatcctatgattctgtgggctatagagggaattaatcctcatattcagcaactattacaagctggtatactcacaccatgtgagatcgcctggaatattccatttttgccggtccagaaacccggaacaaatgattaccagcctgtacaggacttgcaggaaggtaacaagcagacagtcactgtccatccaactgtctctaacccttatactttactcagcctgctcccaccagaacatatggtgtacactgtccttgacttcaaggatgcttttttttgctattcctctggccccaaaagtcaacctatctttgcttttgaacagacatatcctggctcggtagacaccacccaattaacctggacttggttaccccgaagttttaaaaattcccccaccctttttagggaagccctccaacaggatcttttaccattctgagccagtcaccctaactgcactcttctccagtatgtagacgacctgttattggctactgaaactactgacagctgcctgcaacatactacggacctactttacctccttcaggaattcgggtatcaggtcccagccaagaaggcccagctttttcttcccagcatttcctacctagggtatgagacaaatgaaggaaaaagggcactcaccagtgctcgaaaggcagccatccttcaaatccccactcccaccactaagagacaggtacatgaattcctgggcaccgtgggatatggtcgcctatagatattggggttcatggaaattgccaaacccctgtacaccactactggagggaataccccgctggtttggactgacaaagaagaacaggcttttcaaaatctgaagaaggcactaactgaggcccctgctcttgccctcccaaatatctcaaaaccatttcacctttttgttcatgaaaaccaaggagtcgctaaaggggtacttactcagactttagggccatggcaacacccagtggcctatttgtctaagagactggaccctgtggcctctgggtggccaagttgtctgtgagccatagtggcaacagcaagccaggtccaggaggctgataaactgactctgggccagaatttaacccttacggctcctcatgctgtagagaccttgctacaaagtgcttctggcaaatggatgtcgaatgctcgcatcttgcggtatcagagtttactgttagatcagccgcgtttaactttctctcccacaaggtgtttaaatccagctaccttgttccctgatccagaccttaccacacctgtccatgactgccaagaactgttagaaactatggaaactggctgacctcatctccaagatgtgcctctaaaggaggtggatgccaccgtgtttacagatggtagcagcttccttgaacagggagtacagaaggctggtgtggccattactatggagacagatgtactgtaggcccaggcactgccggcaggtaccttggcacagaggactgagttggtaaccctgactcaggccctccaatagggtaaagacaaatgtattaacatctacactgacagcaggtatgcttttgctactgtacatgtacacagagccatctatcaagagcgagggctactcacctcagcaggaaagagtgtcaacaacaaagaagaaattttagccctgcttgaagctgtttggctccctcaacaggtggctgcaattcactgcaaaggacatcaaagagaagacatggccattgctcgtggtaaccaaagagcagactctgcagcttgagaggcagctcagctcctggtcgtgcctttaaccctgctgccctctgtgtcctttccacaactgactgggcagactacccagaatactccccagaggaagaaaaacaagcttcggatcttcaagccagtaaaaatcaggaaggttggtgaattcttcctgattccagaatcttcatgccccaagcccttggggaaacttttatcaatcatctacattctaccacccatttaggaggagtaaaactggcccagcttctaaggagccatttcaagatcccccaccttcaggacttaactaaccaagcagctctccagtaaacggcttgtgcccaagtaaacaccaagcaaggtcctaagcccagcccaggccaccgcctccagggaggcttgccaggaggaaggtgggaaattgactttacagaggtaaaaccacacttggcagggtataaatacctcctggtgctagtagacaccttttctggatggactgaggcatttgccaccaaaaacgaaactgctaccacggtagttaagcttttactcaatgaaatcatccctcaacatggactgcctgttgtaataaggtctgataatggaccagccttcacctcgtccatagctcagtcggtcagcaaggcattaaacattcaatggaaactccattgtgcctatcgaccccagagctctggacaagtagaatgcatgaaccccatcctaaaaagtactcttgcaaaattaatcctagaaaccagtgaaaactaggtaaagctccttcctttagcccttcttagagtaagatgcaccccttaccaggctgggttttcaccttttgaaatcatgtatggaagggctccgcctatcttgcctaagctaaaggatacccatttagcagaaatctcacaagctaacttgttacagtacctgcagtctctccaacgggtacaagacatcatccagctgcttgtcaggggagcacaccccagcccagttcctgaccagactgggccctgccactctttccagctgggtgacctagtgtatgttaaaaagttccagaaaaaaggactgactcctgcctggaaaggacctcatactgtcatcctcaccacaccaacagctctgaaggtggacggcactcctgcttggattcatcattctcgcatcaaaaaggccaacaaagcccagcaaaaaaaatgggtccccaagcctaggccaggccccttaaaactgcgcctaagttgagtaaagctatcgaattaattctttttatttacctcttctgtctgtttccacctgttatgtcctctgccccttcctactcttttctcctcacttccttcatgacaggatgtgtgtttgcaaacaccacttggaaggtgggaccctccaaggaagtctcttttgtagtcggtttatgtgctttgttccccgaccctgcccatacccttgaagagcaatgcaatctgccgatcatgagagcagggaacgctgaccttgctgcagggttcggacacaccagaagccaaactggatgtggaagttctaagggtgcagaaaaaaggctccagagcgttgacttttacctttgtcctggaaatcgccctgactctagttgtcgagattcttaccagtttttctgcccttactgcatgtgtgtaaccttggccacttactctggaggatgaacctgatcctcaaccctttccatagcttgtgcttcccatcctaagccgtgtactataggaaattgtaatcctcttactataactctccgtaaccctagtttaactcaatggtattacagcatgtcatagggattaaggctttatatttcaggatttgatgttggaactatgttcaccatccagaaaaaattcctggtcccatgaagccaatcagaactttaactgatttaggtgaccctatgttccaaaaacacccagagagagtcgatttaactgtcccactgccattcctggttctgagaccccagctgcaatgacaatacctccaacccagcccgatgtccattttggacgggatacatcacctccttaatctcaccaagcctaaactagcctgagattgctggttgtgccgaaaggccaaacccccatattatgttggattaggagtagaagccatgctcaaaatggactctctttcttgtcatacgtgcccccatgcccttacactaggagatgtgtcagggaatgccttctgtctaattagcgcaaggtataacttacctgcttctccctttcaggctacttgtagtgagtctctccttacttccttaaacccctcagtctcctaccaggcacccaaaaatacctggttggcctgcatttcaggcctcactcgctgcatcaatgggactgaacctggacctctcctatgcatgttgattcatgtactcccccagatctacatgtacagtgggccagaaggacaacttctcattgctccccctgaattgcatttcaggtttcaccgagctgccctactccttgtaccccttctagctggccttagcatagctacgtcagcagctattggcacgactgccctgattcaaggagaaactggactaatatcactatctcaacaggtagatgctgatttaagcaatctccaatcagccataaatatactacatgcccaggtagagtctctagctgaagtagttcttcaaaaccgccgaggcttagatctgctatttatctcccaaggaggtttatgcacagctctagaagaaagttgttgtttctatgccaatcagtctggagtcataaaaaatactcttcaaagagttcgagaaaatctagatagatgccagaaggaacaagaaagtaacaccacctttctcattcctggagtaccaaagtaccaaagcatgtttaactggaatccctggctaactactctaattactgggttggcgggacccccttctcctcctcttgttagggttagtcttcaggccttgtatattaaattggtttcttaattttgtaaagcaacgcatagcttctgtcaatcttatgtatcttagaacccaatataacacccttgttataaccgaggaatcaatgatctgattcccccaaacacgagtgggaaatgtgataccctaacttcttttaacctgattgactctctcttagctgagagagctggacagactccattttggtttcttcacttgcagccccttgtccccctcccttaaggacataactggtgcaagctgactccaagcacatccaagaatgcgcttactgataagatactgaggcaagctgtaccagcagctcctgggaacgcactcggttgacggtgcccaaagcctttgcgtttatcactttgtgataatttaagcccctgcacctggaactgtttattttcttattactgtttctgtaaccatttatctttcaacttttttgcctgttctgcttctgtaaaaaattgcttcagctacactcctcctcccctctttagaccaaggtgtaaaaagatgtgtagccccttcttcggggctgagagaattttgagctctagccgtctctcggttgctggcaataaaggatcactgaattagtctcagactgtggcattctctctataactcagtcggttacaataaaatagcaaaacaagttgccatttcttccatttaactccatgccctcctcctactgtaacccgttttctcttccattgaacaaaagacgttgataaaaataggagctaaagaaaatgcggataggaaatggatattatcagatcaaagggaaatgttgtcaaaacctctcatgagggaagtcttgtctcaattacatcaagggacccattggggaccccaagcaatgtgcaatgcagttctccgggtttatgggtgtataagaatttacaccctggccaaacaagttatagatagttgcttaacatgtaaaaaaagctaataagcaggatctaaggaaattgcgccttggtggaagaaatccagcactgagaccatttcaaagtgttcagatcaattacactgaaatgcctccaattggtagttatacttattagtaataatagaccattttacccactgggtagaggcaatcccattctcacgtgcaacctccagtaatgtagttaaagcgctaattgaaaacatcatacccagatttgaactaatagaaaatactgattcagatactgcaacccatttcactgtgcatgtcattaagaagttagcacaggtactagatatacattgggaataccatactccttggcatccatcctccacaggaagagtagagtggatgaatcagactctaataaaccacttaacttagttttagaaactcgattgccatggactaaatatactcctattgcttggttaagaatccggactgccccttggaaagatattggcctgtcacctgaggaaacgctctatggaatgccctacttacactccattgctgacatccctatgtttgaaacaaaggatcatttcctcaaaaattatatacttggtctaggctctaccttcttttcccttgggactaaaggtctcctagcacaggcatcacccctggagtttccagaacatcagcattggccttgagaccatgttctcatccaagggtagaagaaaaggaagctcgaaccagcctgggaaggaccctacctagtgctcctatgtactgagactgcagtctggacaacagaaagaggatggactcatcacacccgagtcaagaaggtgccgccacctccagaatcatgaactgtcactccacagcccacccccaccaaattaactctaaaaagagcttaataatcacttatttattctcttttttcttttcaacagaaggtcatcttgtcatcagtgtaactcaggctagtcattttttaacccttcagtttgatgcctgttcagtcatcccgtatggagatgagcaaggtcaaaagaagctagcccatgttgataagtgtctatgtctataccacaaaaaatcaagcatgtataagtatggagtgttaaaagtcccagtggtgactgggcagatgtttggtggactaataagtacaaagggtggagagccaagctccctgcttcaaataaattatgacgaccaaaacaaaaaactccaactagtccctggtcccaccccaccaaattgtaagccatgacactgtaaccccttgttgctgattataaataatccccggaccatggcccaagagccctctatattcaaacagtatgggctaggaggagatgttgaaggacagatccatttcttagagaaatgaatgtgacaatgaaaaatgacactactcttcgttcatttttctttgacaaaataatttttctgtcaattttgtatgtatttaattttaaccaagtaaagcttcttatggacatatattcatcagatttaaaaaatgagtttcttaaaggtgcaaaaccaggaatagcttggtaaattcatgaagctagaaagtagctaatcaaagttcttattaaaccttctggggttgattaagagtagccaaaattatgccaggtgcagtggctcacgcctgtaatcccagcactttgggaggccaaggcaggcagatcccaaggtcaggagattgagaccatcctggccaccatggtgtaacctcgtctctaacaaaaacacaataattagctgggtgtggtggtgtgcacctgtagtcctagctacttgggaggctgaggcaggagaattgcttgaacccgggaggcagaggttgtagtgagctgagattgggcaactgcactccagcctgggtgacagagcgagactccacctaagaaaaaaaaaaaactattagcgaaaattccttgtaacaaatcccctcaagaggtgaaatctatttccctactccttggccccgtcctggccttgagacttgctttgatcaatagaaggtgacagaagtgacactgcacacattccaagggtaggcctcctacaatgctgctacctatgaacaagcccaagttagcctcatggaaaacggaaaacacataaagagggtccctgtcttccctgacaacccagtccacccagtgaggcccacagaggtgaggaaacccagctgataccacgtggttctgagatcggcttatcagctgattcctgcccaaattgccaacccacaaaatcacgagcaaataaatggttgctgtaataaccagttgggttgttacacgaaaacagctaatagatataccttcttaatctcaattatctaaaaaagatatccctcctcactgattcatagctaagtggttctagaaggaatatttttatgaataatacacatttctttattctgtgcatcacatgaaaatggtcagaatcaaaatggagtcactaatgttaaaaaacaaacaaaagactctgacaaatacagctgggaagaccatgaaaagagggttctaatggttgtacacctgaaaaccaaaagtaccacgaaagacggcgaacaccacaaccttgagcaaaggccattccaactgaacagaaaacatactctgcaaggacctctgaacaactgcctgtccaacctcagactaacaccactttcgtgattgatctttggagccaaggctaattaattcaaagaaattagataatcctcattttttccttaaaaaatttttgttttcctttattttcccaaatatacacatagtttactgtggcatgcatactcccattgcagtggtctattcccagagaaatatttttcttttagggacctctctctgttatttaggtttatagtcacaaaggatttactatttcaacaatactagcactgcatatcatccagtatacactgggaaaataaggtgccccatgtgcagatccaggagactttgtgaccaccagattatgaggcatgcatgtatttatttatttatttttgagatggagtctctatctgtcacccaggctggattccagtggcataatcttggctcactgcaatctccacctcctaggttcaagtgattctcaggcctcccaagcagctgggactacagatacgagccacctatgtggctaattttaggatttttagcagacacagggtttcaccatgttggccaggctagtttcaaacacttgagctcaagtgatccacctgccttggcctcccaaaatgctgggattacaggtgtgagacaccatgcccggaccatgcatgtattattaatgttgaagtagataatttaacaaacatcaatgaagtgttaacatttttcactcataggtgcaaaatatcatgccaattgccttctatgagctgtcgtaagccacagcctagagattcaattccatttcaagattcaaccaaagccaactcatcaacaagaacatgtaaaagacagaaaaacccactaccggcaggctgaaacagatgctgtgacgtggccctggcctgtcatggcatgtcacagcatggcacaggcctatatcatgttccctagactgctgactaccaactagttacagctgactccaatcaggtcgggatttgaccatctctgcactgaacctgcaattgtaacttttaaaattgaaacgctgcttctcacctctcctccctagactccatttcacagggaaaccatcacagggaaagaaagcctttgttttttcttccttctttgctttgctttctctctttcttttacacagggtctcactgtgtcgcccaggctggagtgcagtggcacaatctcggctcactgcaacttccacctcctaggttcaagcaattctcctgtctcagcctcccaagtagctgggattacagacatgtgccactgtgtctggagttgattccttccagtggttttgtggtctggctgacttcaagactggagcagcggaccttcacagtgagtgttacagttcttaaagatggcacagacccaaagagtgagcagcaggaagatttattttgaacagcggaagaacaatgcttccacatcctgtaagggtacctaagcgggttgcctaagcgttgctgctgggggctggggtgaccagctttaattcccttatttgtccctacccacttcctgttgattggtccattttacagagtgctgattggtccattttacagagtgctgattggtctattttacagagtgctgattggtccattttacagagcgctgattggtccattatacggagcactgattggtccattttacagagtgctgattagtccattttacaaacctctagctagccacagagcactgattggtgcattttacaatcctagctacagagtgctgattggtgcatcttacaatcctcttgtaagatagaaaatttctccgagtccccacccaacccagaagtccagctggctacacctctcaccaccacacctacctaatttctgtatttttagtagagagggagtatcaccatgttggccaggcttctttcttaatcttttcttttctttctttccttccttcctttcttccttccttcctttctctttctttctttctttctttctttctttctttctttctttctttctttctttctttccttctttcttccttccttctttccttccttccttgctcccttccttcctttactctctttctgtctttttctgtctgttttctctattccttactcttccctcattccttccctccctcccccaactcttctttccttcctttctctctccctccctactttccaactttgggctgtgttgaatttgttgactcatcgtgaacaaacagaaactccaatgatactgttacccaagagaactttgcaaaaggttgtcatgtttaataattcattcacagaatcctcaatctcacaaaagcctggaatggattttctgtttggacagggcagggaagctactgtggccaggctccagctcttcccactgcagctagcacaagccttctaaagcaggatgtggccaggcacagctcatgcctgtaatcccagcactttggcaggccgaggtgggtggatcacctgaggtcaggagtttgaaaccagtctgtctctactaaaaatacaaaagttagatgggagtgatggtgggtgcctgtaatcgcagctattcaggatgctgaggcaggagaattgcttgaacctgggagacagaggttgcagtgagccaagatcacaccactgcactccagcctgggcatcagagcaagactccgtctcaaaaacaaacaaacaaaaagcagtgagaggtgaagccacctggacttcctgggttgagtggagacttggagaacttttctctttagctagcagattgtaaagtcaccaatcagtgctctgtgtctggctaaaggattgttaatgcaccaatcagcactctgtaaaaatgtaccaatctttcatcccatctcatcccatctttcagtcacttcacaaatggttcctagtagatacaaaacagttttttctccaatgggaaaacagaaaacagccactcagtttgctcccaacacccgtttctagccgcttaccacagctaccttggcaagtactctaggagtatgggaaaatgaaaacgacaaactcacacacctttttaacatacacaaccagttctgactacctagccaaggcagattcttcttctgtggaatgtcaacctatatctgcctcccgaccaactggacaggcacctgcaaccttagtcttcctatgtcccaacattaacattgccccaggaaatcagaccctatcagtgcccctcaaaactcaagtccgtcagcacagagccatacagctaatacccctgcttatagggttaggaatggctactgctatgggaaccggaatagccagtttatctacttcattatcctactatcacacactctcaaaggatttctcagacagtttgcaagaaataacaaaatctatccttactctacagttctaaatagactctttgacagcagtgactctccaaaaccactgaggcctaggcctcctcactgctgagaaaggagggctctgcatctttttaggggaagagtattgtttttacactaaccagtcagggataatacgagatgctgcccggcgtttacaggaaaaggcttctgaaatcaggcaatgcctttctaattcttacaccaacctctggagttgggcgacatggcttctcccctttctaggtcccatgaaagccatcttgctattactcacctttgggccctgtatttttaacctccttgtcaaatttgtttcctctaggatcgaggccatcaagctacagatggtcttacaaatggaaccccaagtgaactcaactaacaacttccaccaaggacccctggaccaacccgttggccctttgactggcctaaagagttcccttctgaaggacactacaagtgcagggccccttcttcgcccctatccagcagtaagtggctagagaggtcatcacccaattcccaacagcagttgtggtgtcctgtttagatgggggattgagaggtgaagccagctggacttcctgggtcaagtggggacttggagaacttttctgtctagctagaggattgtaaatgcaccaatcagtgctctgtgtctagctaaaggattgtaaatgcaccaatcagcactctgtaaaaacgcagcaatcagcactctgtaactagctaaagggttgtaaatgcaccaatcagcactctgtaaaatggaacaatctgcaggatgtgggcaaataatggaataaaagctggccaccccagtcagcagcagcagggaaccgctcagatacccttccacaccgtggaaactttgttcttaccctcttgacgaaaaatcttgctgctgctcactctttgggtccacaccacctttaagagctacaacgatcaccacgacagtctgcggcttcattcttgaagtcagcgacaccacaaacccaccagaagggagaaactccagacacatctgaaggaacaaactccagacacaacatctttaacagctgtaacacacactgtgaaggtccacggcttcattcttgaagccagcgagaccacgaaccctctggaaggaaccaactctggacacagcaggacgtgagacttctacctgctcactcagaatcatttccgcaccaaccatggccacgtttgtggagctcagtacaaaagccaagatgcccattgtgggcctgggcacttggagggtaaatatgcaaatctttgcacaactttcttctctggagggctgtttgggtgttttctctttctacattcagccagaaaagcctggaggtcgggtaggggtttggagaggtgaatttcagtcctggagctgggactcgggttgctttcttttctcaaagctgattcaagctgcaatgctgcaagactggctttcccagcagtgatgagaactcctctagcaagtatcaaatttcaagcagagttggacttaaaattgttttccagggcagtttctctctctggctctaggacacttaattgggcacaaggtttccccagagtcttggctgtgggtttgttgtgggctgggtggttgtggagaggatgcagagccagaagtccctggcaccactttgcagatcaccatgtgggacttgggctagcagcatccctatgacctgggagcttgttagacatgcagaactggctgggtgtggtggctcatgcctgtaatcccagcactttgggagatccagacgagaggactgcttaagcccaggagttggagaccagactgggcaacatagcaagacccaatttctacaaataatcaataaattagctgtgcatggtggcatgcagctgtagtcccagccacttgggaggctgaggtggagattgagtgttgagcctgagaggtcaaggctgcagtgagcagtgattgtgccactgcactccagtctgggcaacagagtgagatcccgtgtaagagaaagaaagaaagagaaaaaatgcagagtctcaggcttcacccaggctacctaacgggcatctgcactttaacaagttccctaggtggttcctgtacacattgaaatctgcaacatgctgggactgcagagagcctgggctgggagtcgtgagctccacccggctgtttttatgacagctggcaaaacacgctaaggcacattgaggactcagtgaggcaggttcctgggcctctgttaggctaagtttgaagttgttccatcactgcctccctctgccttctttgccatttccatccatgatagcactaccctaactagtgatgagaagcagtctttggagttcctcttctctcctgtccctcatggctaatttccctgctcagacttctgcctctggctctctttccttctgtgcacactgacttttttccctctcctgtgccgagctggagggtaggaccctctgctgcagcactgggtcattctcaggataaagtcttggtctatctgggcgaacagatcacttccagctcgattcatacatactgactcttgcttgaatagcaagatttgccccaaatcagagctttaatcctatataaatggaacaaataatcacttccagatctccagggaatctgctcacccttcataagtttactagacagtttcagaattttggaattgaatgtaagaattatgaagggagctgccttcaacacgtggggatgatagattaaaggattatgaacttagcagtggaggtgaagaagggtgtagtatagcggttggggtcacagggctgcttctagatgccaggtggcagcccgtttcttgcccaggtggtagggtagttgtgcatctctgttttgtgtacttttcaatgtttgttacctcacaatagaagaggtttaaaagactattttgtgagagatcaagttttaagtgctttttgcccccatcattggcttggctaggttagaacaaagtgtgataattgtatttcctttttttcttttctttccttcccttctttctctccctctctctcgttctccctacctcgctctttctttttataggaatggaaaacaaactctattcctataagcttctctatttctcctttttttccaaaatgatcattgtataatggacggcctgtactgagcctgtgtgtcaggtaatgtggttaacttaacattcattacagcatgtcatcaccacaaaggcctcttgtggctggtgctatttttttttccattttgccgacaaggtttagagagattgaatcacctgcttagacccacacacccagtaagtgttggaatctggattgatgctgtaatgaccattatccagatccttatcaccgtttggggaaattgtctgaaaatccctctgggttatttagagtcaagctttcatctgggtcttcagaaagttgtagtggagccatctgcaccaccacacacctgaagacatttcaggactaacctggatgaaaagggaactgacttttagctaggataggacaaaagggcataatcataaaattaattcactttccttcctttcttttgaaaacttttctaaactgtgtatcctcccagatattccctggcaaagaagaccccagcgaagccttggtttggagaaactggaccgtgtggggcaggtgaaggtggtctggggataagagaatatggtggttgctgagtgtggtgtaattccagctactcaggagttgggaggattgtttgaacctgggagtgtgaggccagcctgggcaacatggcaaggtctcatctcttaaaaaaaaaatacatgtgtgatgggcttttcttttgcttttcagtctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgcacatggcgcatttggtgggaggccttcacttcaaggcaggcagaagtatctggatcgggtgggcagcaagaactctgtcggccttttctacgtgtacccgttttcatctctgccttgataacatccgtggatacaatactatccatactccaagccgttattgatatttgaacatgtcgtggctgccccacctgcctgcgggttggatttcccatagtgggcttggctccctctgggcctccctgttccccatcagagggatctaccatctgcccagaggcagtcacaggccaagggtgcaggcagggcttgatatgaagcctccctctcagcactgtggtctcagcgactgtgcccctgaggttctcagccagggggtattttggaaaacagtaggagcacttttctattatcacatgtgattttctttattcagtctagtaaaagttgaggtatacaatgttataaaaaaagaaaaggatgttgggtgtgagggtgttgagaatcactggatctatattatatgcaagttgctgaaaaaaaaaacaaaacactagttctgtgtacttggaaaatgcttacatctggtgggacaaatagaccccactgtgtagcagccaagtctggataaagcccttttaaagttatcacttgggtcctgataggcttgataagggacctatcagatgggtcagataaagggccatctattcccaaaggcctaagaatgcttgacatttaaaagctacacgcaattcctgctctcagagagcccacagctgaggaagagactgagacaggtaaacaaatttcaaatctgtggccacatttacttaaatgatctgagacacttatagagtactaggagagttgaaaaagtcaactgcttttaaaacttaagacatgtcattgaggtgctgagccctggcgatcttccacactgcatcgtggatcttaatcagctttgttatagatggcctgagccaggttagatgaggatgcaaatcaaaaagcagggacaatgagtataatgtggcccttccttttcccagtattactagctcattgctacactctttgcaggtgtggcccactttctttgagagaccccttgtgaggaaagcctttgagaagaccctcaaggacctgaagctgagctatctggacgtctatcttattcactggccacagggattcaaggtttgagtgactccctttctcagcctctagtttctgagctgttgcaggaattcagggacccccaacagagagactggctgaagccatggcagaagaacataaattgtgaagatttcatggacatttcttaattccccacattaatgtttttataatttcttacgcctgtctttactgcaatctctgaacataaattgtgaagatttcatgaacatttatcacttccccaatcagtacttttgtgatttcctatgcctgtctttacttaaatctcttaatcccatcatcttcgtaagctgaggatgaatgtcgcctcaggaccctgtgatgattgcattaactgcacaaattgtttgtagagcatgtgtgtttgaacaatatcaaatatgggcaccttaagaacaggataacagcgatgttcagggaacaagggagataaccttaaagtctggctgcctgtgggccgggcagcacagagccatatttctcttctttcaaaagaaaataggagaaatattgctgaattctttttctcagcaaggaacaaccctgagaaagagaatgcgctcctaggggtaggcctctaaaatggctgctctggggacggctgtcttttacagttgtagataagggatgaaataagccccggactcctgttgtgctcccaggcttattaggacgaggaaattcccacctaataaattttggtcagaccgattgtgtgctctcaaaccctgtctcctgataagacgttatcaatgacaatgcatgcccgaaacttcattagcaattttaattttgccccggtcctgtgatcttgccctgcctccatttgccttgtgatattttattaccttgtgaagtaggtcatctctgtgatccacaccctatttgtatactccctccccttttgaaaatcactaataaaaacttgctggttttgtagcttgagggcatcatggaacctgccgaaacgtgatgtctcccccggacacccagctttaaaaatttctctctttgtaatctttccctttatttctcagaccagccaacacttagggaaatagaaaagaacctacatgaaataacgatgaattatcaggggcggattcacccaatactgagcaggtgccagaaagtagtagctgcaccagggctgcagagtggtgtggactggagcaggagagcttgcacttcataattgggaatggcaggtggtcaggaagagaccttggagcagaaagatgctggctggaagggaggctaaggccatgtgcgctgctgaggtgctcacatgcctgggttatcttgcagttatgtctgagagaagacatgatttctggcagcccagacaagttgtaactgccatatcacctttgtctagattccatgccctggggttgccctcccaggaaacctcttgggttattcttccataactgtattccagggcttaattattttattaagcaaagcacacctggcagtggcatcttggagaaaagtccaagtatggtgatgctggaaggaagccagtagtgatcccagcacccattgcctggggctctgctcttacctgctcctgaggggtgggggagacaaatttccagctctctcccctcctgaccagctggagtgatgatggcctgccatcccgaattccacgcctcttctagaggctgcaaggatagaagttggccaatatcttctccagaaaaccacaccctggagatctaatctttatccagtgatactgaaatgaaagtttgcccttgggtgtgtataggatgtaggtgtgtgaggttaatgtccatggtgataatggtggcttctggaatgtactaacagaggatcttaaagtcaatccagtagtttctaaaaatatagggattaatatgctacagtagatatagagattttatttaaactcacattcttgtagtatgtactccagagcttgaaaaagtggtatgcagatgtggtatttagcaagcatcaggatcctgaaaccttgttgaacagaaccaagtgtcctgatgcagattccagtaaacttttcattctgtatttacagactggggatgactttttccccaaagatgataaaggtaatatgatcagtggaaaaggaacgttcttggatgcctgggaggtaggttccagctttgtctaagtgtgctgggagagaaatcctcagttatccatgagattcccattgatatgaaagaggccatgtgcctgatgctttctaatttcatcattgtgattctctagctcttctaatatcctcctcatcacctttggcttttgggtgcatctgatactatttatatttcaagcctactactgagtcttcaaataagactggaaatacaatgtaccccactttggggaatacacatgctgttctcaaaccagggtgaggcatttggaacagagggtttgggcctgggtttgctcatagcagctgagtaacctagggtcagttttgtaactcttgtagggctcagttttctctttaaagaaaaaaggtcttataatacatactactaatatatatctttcggggtgtgataaaacttaagatggtttacgtgccgggaacatcagtcataaagcccatgtaatcatctaaccctaggagacagggttaacatccccatttataaataatgacatttgaaacctagattggttggtgacttgcccaggtcatgtcacaatgtgtgtggcagagctgggattagacccagactcatctgaattgcaagtccaaccaccaaaaccatcagcatggtgcttggtaagcagtgaacacacatccggaaatcagggaactttgtaatcccagcactttgggaagccgaggtggaaggatcatgaggtcagaagtttgagaccagtctggctagcagagtaaaacgctgtctctactaaaaatacaaaaaattagccaggtgtggtggtgtgtgcctggaatgtgagctacttggaaggctgaggcaggagaattgtgtgaacttgggaggtggaggttgcattgagccaagattgcaccattgcactccagcccaggcgtcagtgcaagacaccatcttgaagaaaaaaaaaaaaaagaaaaaagaaaatcagggagcctgagtgccctgcttctcagatcaaacccatgacctgtttcacatcatttcatattgaaaatgaattaagggatgaatgttttctctggccattttttattataccattatgtccttttgcaaatgctaatagagaacgaattggagaaataagatataaatgaacagtggcatataactccaagagttaatcatgttatcttggcagctgtctgtgtaggggtgcatgtagttgcgagtttgtattgtgttttacacgggaaaatatattaagcctcacctttctgaaatgcttagaattgacatgattcaattaaatgtagttttttctgtgtattgtttgttcaaaagcattaatccacaagcacagcattctttttttgatacagattctcactctgtcacacaagctagggtgcagtgacaccatcttggctcactacaacctccctctaccaagtaaaaaccattctcctgccttggccttccaagtagctgggactacatgtgcatgccaccacacatggataatttttatatttttagtagagatgaggtttcaccatgttggccaggctggtctcaaactcctgacctcaagggatccacccgtctcagcctcccaaagtgttcagattacaggcgtgagctatagcaccaggctgtttgcattacatttgatctgtgtttttgccttagctcctatgatgatatgaagtatggcaagtatgtcaatgtaccctgcttctcacagtgctatgttttcttaatgaacatgaggatgactgctaaagaaaacatttgaaaggcatgaaaagatatcattgatcaagttcagaggctctgatttgaaacgagcatgcttgaatacgtaagcattggatgtttatgtagacccacaaccagttcagtagaaacctcattgactaccctgaagcagaggggaggaaaaaagtataaagaagtcaagttttaatacgggaaaactaacctgacctatgatgcacaaaagcttttaaattatctaattgctgaatcagaagtttttgggaaacttatgatttcatagcttccaaactctacttcccaatttgaataacttaatctatgctagtggttctcaacgttggctgggcattagaatcacctgaggaatttaaaaatcccaatgtctaggctacaactcagacaaaatcagtaagaaactctgggggatgaaatccaggaatcagtcatttttcttttttaatttagagagagtcttgctctgttgcccagagtagagtacaatggcatgatcatagctcagtgcagccttggactcctgggctcaagtaaacctctgaagtagctgggatcagaggcacacgtcaccgcatccagctaattaaaacaaatttttttttttggtagagacagagtcttgctatgttgcccaggatggactcaaacatctggccttaagcaatcctcctgtctcagcctcccaaagtgctgagattagtcatgagccactgcatccagccagtacctttcaaagctcactagtgattccaaattgcagccaaaattgagaagggctgcataaagtgttccctgaacatgtcatgctcatccctgcctctgagctttgctcctgccttcctgccttcctgtgtcatatgctcatgtttttcccctcttttctctctctcggggtttttgtttgtttgtttgtttgttttttgaggcccagcttatactctacctgaaaggactcccctgacaactgcgggctgtgtgaatctcttccttctctgcctttctgactctgtctatgccactgtcatgttatctgaggcagcctcagtgtcatgattgatggctccatagaagggaactctagcactttaattggactgtaagaatcccagaagaaggaagcacattgtatacttttacatcttgacaacttctgggcaggatctagaacatgtaatagatggctactaaatacatgttgcattggaggctgctgctaacatatatgatatctttgggcaagtttggaaaatgcccaataaaggctaaaaattatacaaagattcccttccttgcatgtccatgcagcttctgtaccaggaagcatggctggatatgcaaacagtgggtcaggttttagccccacacaactccgtggccgggtgcccctgctagggcgtaatttatatgcatgaccttcttgcaaaccaagccatggttggtgtgggagacagtgactcaggacccacaggtgaggcttctccgtatgctgcagcctcttcctgactaacacagcttgcccaggtttgggtgtacaatgtacacacacaacagtagctccctgctatcatttggattcattaaaaattaaatcatctcataagcttacaaatgttgatttttatttatttttttcatgataaaactttcatatttccatggtgtatggaactataattttttatgtgtttctttacgtgtaaggtgagagtggcaagaacataaaatctttacctgttagttttagattttcttgggctggggaggggcagtagggctggaaccaatcactgatgggcacccaggccctggactgaaatttcctgtgaatgcttcagctaactctgttgcggtggatcctttagcaatttctgccccagggaagactaaggcaagccagggtccctgtagtccctctagagctgcccataaggtattcctttctatgataggccatggaggagctggtggacgaggggctggtgaaagcccttggggtctcaaatttcaaccacttccagatcgagaggctcttgaacaaacctggactgaaatataaaccagtgactaaccaggtaaattctattcagtttaagggtaagggtcctgccctattacttcttaaacattgcggggggaatgttcaatgctatgccctgagtcttatctcaggggtcagtgatcaggacactttggggaggtgtgaggctgatctcatgggtgatttagcaagaatctcagtgcgcacttgtttggcctttgcttggtggactttttttgtgtgtagaactccctaggaacaatgcaaaacagagccggctttccccgtgatgaggattgtttgctgttgcaggttgagtgtcacccatacctcacgcaggagaaactgatccagtactgccactccaagggcatcaccgttacggcctacagccccctgggctctccggatagaccttggtgaggcttccaagtggtgggtctttctcttgataatcttaaaaacattattttataattggtaaatgtcggtatgggtccataagttactggaaagaaaaatgtgtgtaaggtaacacgtttggtacacacaaatgggatggcagtgggaaaaaatgggaattaaacaacaacaacaacaacaagggcgacatgcttgaccctctgggaatatttccagttcagccacccaagggtgaaccaggcttgcaaaatgctgaggcttcagagcccggggaaaggacccaagcttccaggtcctcctgcctgtctcccagatggagaggctctgatgatcagtcttgagaccctcattggagtggtgtccttctgtacacggtagccatggtgattattcacatcagcatctttctgcccctagggccaaacctgaggacccttccctgctggaggatcccaagattaaggagattgctgcaaagcacaaaaaaaccacagcccaggtaccatatttttatttttcttgttatccaaccactcatgcttccagtctcatgtttcatttctcgtgttgtcctcaactgactccttaaaggggaagaacacaggagctgaagccctctaaagtatttcctttgaagtctgttggaacctctaggaaacacaagagctgtcactgaagcaaagatagcttctgtctcacagcttcctgtcaagccctacagcccagtggcaaagcatggctttggagtctagggatatgggtgcagatgccaactctacctctgatcagccttatgacccccaagctactttcttcattcctaaaaaaggaagatcacagggttgtctctaaggtgaagggagagaaagaggtgggggtctggcacaagtctaatagctgtgaagggctcagtaattattagcgattgtacctgaagccacagtgagctgcagagatgttttattcttcctttccataaaaggaggggtccttgtagctgagtggaaacatgatgtcccctttctgcacaggttctgatccgtttccatatccagaggaatgtgacagtgatccccaagtctatgacaccagcacacattgttgagaacattcaggtaagtttccggctggtcgggcctggtattcctcagtggagtgggggacaggcagaccttctcactaggcttctcacctcatccctgcactgtctttggccccctccttccccaccaccctatcattttccagcccagggagctaggctcggtagagctgagatgaatgacccatgggctaagaacatcctgggggcagtgcctggtaaagccctatcaggtctgagcacagttgtgcctcacaccactgagaagaccctcagttgcccctgagcagctaggccctaggccatacacaagagcagactgtcctggcctacctgctcacctcccagcagcagaggaggtgtgaactgtccttggagaagtgtcctctagaagcacctgtcatggagcacagggcctgtgcacgcctggggtttagtgcctgtgagcctggtctccctccccccagaacactgagcactacaaatactgtggtctttgtgtaggacctaatttagagaaaaatttgtatcccttggacagaatgggaaaaactcctatggccagtttgtgctgtgaatgtgagctccctccctgctagaatggccggcagtctccagccacagcagtaacagccttaccgataatgtattggaattctttcctttctaggtctttgactttaaattgagtgatgaggagatggcaaccatactcagcttcaacagaaactggagggcctttgacttcaaggagtaagtggcatggagttaactagaagaattgccaggagtttttctaaactggtagagggttagttggaaggattagaaggttgttgggactacttgtgtcttcaaatactattttggggcagttttgaaagttaaaatttgggtacctgggaatcactgtaagggacacatctctaattgctgcttattgtctgaacttctggatgtagagctagaattgtaagagaaggtgtgttatcaataggcaggaggcagaacattcatttattcattcattcagtcaatatctagtggtcatctgtgtgccaggcattttctaggtgcttgggttatcatactgtacaaagctgctgcctccacaggcttagggagggagggaagaagagacaacagaaataaatcaactcaaaatattgatgtcagacagcaacaaatgctagacagaaaagtaaagtagggcaaagtggacaggaagtggtaggtggtagtgggactgatcctttatacgggttgggtcaagggaagctttgctgtgagggatatgccatatgtatatttgggggaagagcattcttggcagtgataacagcaggtgcaaagtccctgaggtgggattgtgtttagagcattcaagcaagaaggccagggaggctggattaaatcatctccaaatgcctcttaaaggaggtggtgctaactttactttaaatctcagataagttgttgaaaaaaagtctttcactctggctaggcgggaattctacatcatctctttagaatcaatactttctgattaatgtgtctaattacatatatcaaatagaattgtctggcatttattactgcgaggtctgcaattcaatggcaatttgaatttcttcaaatatttgtgtagccaaaaatgatttttcagcttttaaaaatgatttcagtatctcaagcgttgcttgcatgtcatgatattccatatctatcctgcccaccctcagtatcatagcagcctttcctcatcttacaatggcttagtttcatccgtgcttaacaaagtagcagctatttagagtaaaaaggaagggtgaacataagatgtgactctcccccaaactaaaacacttactttcctatgagcatcatttctggtgtaggcaatgggttggtggactcagaagtaaatccacctggcctcaaatccaactctaacactggtttcttcgctgtgtgacattgggcaaatttcttagtttttctaagttggtttctttacctataaagtaggatgataatactaatcgcagctaacatccattgaaccttagcttagaatgtgccagggtcctgagcccttttccggtggtattatctcatttaatactcataacaatccccaagctgtcaattctgctgttgtttcctacctcatgatgttgtgagagtggattgggacaagacttgtctgtcacctcgcctgacaccaggcttaccgtgagttgtcattacgagtttattctgctgccctgctcactgtctgccctccttcctagcaaaaccctcatatcgatttgaaggaaggtcaaggtgtaagcacccttcttgtgttcttgcagggaggaggctgagagaccacaaataccacagagtccaccagagaagaataccttctcagcgagagttgttgctttgatggaacacagtttctttttttttttctctctctctgtagattctctcatttggaggactttcccttcgatgcagaatattgaggttgaatctcctggtgagattacacaggggattctctttcttcgctgaagtgtgactgtctccactcaagaactattttagccaagcttatctgagatcacagtgaactttgtcctgttgtagaccagaatggaggtgctgttttagacatgtatttctgtatgttcaactaggataagaatatcacagaaaagcatggcctgaataagcaaatgacaattttttccacttatctgatctgatcaaatgtctgttaagcaccagaaactctgccaacactgaggatgtaa

SEQ ID NO: 622 - DNA, 31376 bp, Homo sapiens
caatcctggactctcccgacccctagctgtcggtccccctccctgcgcgcgcgccggcgggtttcctaccctccgaggcgtccgctggcctgcgccctggcggggacgtgggcggggcgggcggcatttaaggctggtgccacctccccggtgcagcggctggcgatcggccgcggaggtgcgtgcagggcccgcgccgccgccggtatctccaccgccaacacctcagccactgccactgccacagccacacgaggccccccaccgtgcgctccgccgctgcggtcccggatccgcgctccacgcccgcagcccgcggcgccaccagcccagcatgcaccaggtgcgtgcagcccccgcgccggccgaggatgcgagacgctgggccaaggccccggggaccggagcaggctgacgggaagcgaggaaaaggcgaagaggagaaacgccccgtcccggggcaaggggaggccgcctttcctctgagcgccccccggcctgggcaccgcttctctgactccccgccacggctccgtgcggccgccggggctggctggggaaagaagccagtccagaggagcgagaaggggccaaggggtcctaggccagctccatggcacctgcgggctccgactcggaggatggggtgacatggattcgttgcggtctgaaaagacttccggttagggccccctgatcaggactgagggtcgtaagcttagtgggtgcctcctccccaagaaacaggacgcacagctgttgtgtcccctgggaaggacacctcagaggaaacctcgaggtgcctaaggaacctcgaggttctaaggaaacctcacagctccttggaggcatcagtcaggagttgggggggtaacttcccacctgctccacccagagaagggtcaccctgaggagctgctggctggcctgtgcccaccccgcctcccctctacacggacggagaggaagccaaggtcggcgggaggtgggggagagactccactgtccgactccctccggcctccccagaggagggaaggaaagggagaaggggctcctgactcctgcaggtcctgaccccgcagaggggcgctcagcacctcttcggaaaccccatttggggccaatattgcacctgggcttctctttcagaaaaccccagaaatttactccgtggagctcagcggaactaaggacatcgtgaaaacagacaagggggatggcaaggagaagtataggggtctgaagaacaactgcctggaactcaaaaagaaaaatcacaaagaggagtttcagaaagaactccatctggtcagtagccttaagccacggggtcctgccggctatggcccttccccgcaagagcttgcccctagaacccacctcttaccacagacattcagtctgagggatttgaaatccccttgagattgtgtgtggtgtgtggtgtctgcgtggtgtgtctgtgtggtgtgtgtgtgtggtgtatgtgtggtgtgtgtgtatgtgtggtgtgtctgtgtagtgtgtggtgtgtgtgtgtatgtgtggtgtgtggtgtatggtgtgtggtgtgtgtgtatggtgtgtggtgtgtgtatatggtgtgtgtagtgtgtggtgtgtgtatgtgtgtggtgtgtgtgtatggtgtgtgtgtatggtgtgtgtatgtgtggtgtgtgtgatgtgtgtgtgatgtgtgtgtggtgtgtgtgtgtggtgtgtatatgtgtgtggtgtgtgtgtggtgtgtgtatgtgtgtggtgtgtgtatgtgtgtggtatatatgtgtgtggtgtgtgtggtgtgtgtatgtgcatggtatgtgtggtgtgtgtgtagcgtgtggtgtgtgtgtagtgtgtggtgtgtatgtgtggtgtgtgtatgtgcatggtatgtgtggtgtgtgtgtagcgtgtggtgtgtgtgtagtgtgtggtgtatatgtgtggtgtgtggtgtgtgtgtggtgtgtggtgtgtgtatgtgtgtgtgtgtgttttgaatggtgtgatagtatccacccagaggtcagggcctctgcaggattcctgcattctggttggaggcagtccctgtagaactcagaaggaagagcctctgattccaggccccacaggcatggccagacctctctccccgcagctgcttcagtgagagttaagtaaccacttgccagttttcaattgattagtaaaactatttgagctggaacttctgaggaggaaaaccaaagcccctaggccatgctagattgcaggtgtgaaacctcatggaaaagcagtttcagtggtaaaaatgtggagcttggattgggaggacctcgggccccatcagagtcccacttctccactgagctgaaactggcaacaaatgactgaccctcactgaaggtccatttcctttatgtaaaatgggaaataaataatttgctggggtctatgaggggaaaaaatgagatgaggattttgtaattcacgtgctttaggggagtacaatattattattattaaggaagagctctggagttattaaaactagccttttttttttttttgagacagagtttcgctcttgttgcccaggctggagtgcaatggcgctatctaggctcactgcaacctccacctcctgggttcaagcgattctcttgcctcggcctcccgagtcactgggattacaggcgcccgccatcacacccagctaatttttgttgtttttagtagagacggggtttccccatgttggccaggctgctctcgaactcctgacctcagatgatccacccgcctcagcttcccaaagtgctgggattacaggcgtgagccactgtgtccagcccaaactggccactttaataataaaactgccttgggtctgaaatgtgacagattttatcttgggaacaccgaaggggaaacttctacacggagcttgagatgggctggattgtccccaccgtccttggcagatcttaaagctctgtgactcctgaggggagtctcttttgtgctagagagccatttgttaagtattcagaaacttggcaggctgactgacatcctgttagcagcttcaaacttggttctagtgagaaatcagcaaactctacaaatccgagctttgtattgatcgttcctggagagtttgttaaacatttaacagtataccactgggcatttgtccgtatctatcatgagagacatttaagaacgcttccctgaaactggactgacctcaattcaaatcccagtgtaactgaagttcagtttcctattttgaaaaacataagatttttttttctacctcttaagggttactaggaagattaaatgagataaaacagggaaaagacagcacagcaccagacgatagatcgttcttattatttcccattatctctagcatttaagattgaagacatatctgtttttcccttgacattacaagggtcctgtaattttcagcagcatattgaatgcttttgcctcccaacctttcttggcaaattagtgcctaatgacaactgaagtatcccggcctttgaatgaaagggccaggcagtgacccgaggggtgggtggggtgctgccctgtgctagtccagtgctggccagcagagggcaccccagataaccaccaccacctcgtcccacccctcccccatgctctcatcccccagcccaggaagtctgaggtcccatgcatgcaaacaatggctcggatcatccactacttgtatctgcccaaaacttagtgggttgtgctgtgctctgtgcagaacacagccttaatcttctgaatccccagcaatatcacactcaatcagtattagtagaagggatgaaggagcaaaacagaatctggctgagaagagggctagaagcaagataataatgataataatgaattctgctttattggaaggcctagtctcttactgcaacatggaactattttttgcatatacttaagaaaagagatgatgtgagcaccagtcaacagtatcaatctttgtttcagacaatcagggtttaaaaaatcctgagtgctggactttctagggggagtgaggaagacttaccctaggttttctgctacaggaagagacttcttgtcctttagcccagtggttctcaaagggagaggagaagaggattcccccacccctctcccaggggaaaaatggaaacatttttggttaccacaactgaggggaggatgttagtgggtggagcccacaacaaagaattattctcccagaatggcagcagggccacgggtgagaaaccctgctgtagtctaatgattctgtagcagaattcacaagtggcagccacaatgctgtgggtttattcagcagaacttttccctgcagggtttctctgcccagtgagctccctgagcgtcacagcttgagtgagggaagctgcttttccctgccagagcccacacagcgaaggaggaggagttgtgccagcccaggaagcggttctagtgtggttttgccatcagccccagccaatcccagggttcaggcctgagggaagcctccagctcactggcacctggaagatgagggtgccagaacctgtatgccctggagttcagattgaagcgaggtgcatggctttgttcagaaaagctgcaggcagcttctgggtagtaacagcaagtgcaggattgtgccgactcagggacagtcactcctgaggcagtgccatccttcgctgggcagctgcctggcacaggggttctttctctcctgtcccccacactcctcgatcccctcccatcctcagggctgctactcccagcttccatggctggtcaaagcttggggcttgagtcttttggaattatctaattcactctgttcttcctttcatggacttcaggatgaccacaaactcagcaatagggaattggaagagaaatatggcacagacatcattatggtgagtcgtgggaaccagggatttggaagagaagcctcccaactctacagagggaaggctgtgtgtggcggggggctgtgtggaagagtagcggcacctttaggaggaggggcccctgcagcgcctttgagactgcagttatttgcatctggacacagttcaagtcaacagaaaaacctactgtggggctcacactggcctggcagtgagagggaccaagagggacagatgacccctggcctcaaggagaaagtggccgggtaggggaggcaaatgtgtatggaagtgtcctgagattcactctatccccctgggatggctacaagaagtagaaacgctatgctgggacaaaggtggattctgatggaaggggccagagccagctctcgggctgctgccatgtttgcgctgggactcaaaatgcttcggatttaagctggtgggggaccccagggccagtaagcacagagcctgcttggagagaatctgggcttgccggaagctagtatgtgtggagaggggacaggtgcagcaggaatgaagccaggaaggtcatctgggtgaagctgtcaaagtattcacattaaactaatgagtaggagctgtcttagaggcagaagggacatggtttccacacatggaggtgctttcattggttttcaaaaggcagttctcatagaagattctttttttaaagtgagaaatggaagggtctagaagaatggaacaacagcccaggactgtgaaatgaggatctgaaataatgtcgaaagacattacaggggccagacgtggtggctcaggcctgtaatcccagcactttgggagactgaggtgggcagatcacctgaggtcgggagtttgagaccagcctgaccaacatagtgaaaccccgtttctactaaaaatacaaacaattggcagggcgtggtggcacatgcctgtaatctcagctactcaggaggctgaggcaggagaatctctgaaacccaggaggcagaggttgcggtgagccaagatcatgccattgcactccagcctgggcaacaagagcaaaactccatctcaaaaaaaaaaaaaaaaagggccgggcgtggtggctcacgcctgtaatcccagcactttaggaggccaagacgggcggatcacgaggtcaggagatcgagaccatcctggctaacacggtgaaaccccgtctctactaaaaatacaaaaattagtcgggcacggtggcgggcgcctgtagtcccagctactcgggaggctgaggcaggagaatggcgtgaacctgggaggcggagcttgcagtgagcggagatcgcgccactgccctccagcctgggcgacagagcgagactctgtcgaaagaaaagaaggaaagaaagaaagaaggaaggaaggaaggaaagaaagaaagaaattgcagagagacacaaccagcaggacttgcggggatttttattgagcccctcatctcgctagtcatgtcacagcagcaggaggaggagagccggtcgggtgatgggctggggtgggggcagggaggtgagagcagggaaggcaggagggtggaggcgatgatgaacttattgtgagttataccaggagaagtctctccggaacacccctgaggaaatgttccacagttattcagaaagatgagtctggggttctggaaaaggaattggagtggagggagatgggatcgaggtggtgagcctgaatctagccattcaacagatatttgaatcactaccacagaaaaagcatgagacccgggagagaacacaaaaatgaccaagactggcctgtcatggtggcttaggtctgtaatcatagcactttgggaggccaaggtgggcagatcacttgaggtcaggagttcgaaaccagcctggccaacgtggtgaaaccctgtctctactaaaaatattttaaaaattagccaagtgtggtggccgctgcctgtaatcccagctatttgggaggctgaggcaggagaatcgcttgaacccaggaggaggaggttgcagtgagacgagatcgcaccagtgcactccagcttgggcaacagagcgagactctgtctcaaaaaaaaaagaccaagacagagtcctgccctttaagtagcttacaacataattagggagaagaggtatctacagacttgtccaccaaagatcgtctgtgggggaaattcctgtgaacatgtagggtttcaaaggtgagggtgcctcacggatggcaggccccccagggcaggggctgctcacatgggctcagggcttgggtaggatttatgcctgtcaagatgaatgagaacttaggctggatgtgtagaaaggtggaaaaggagcaggcgtaaggatggaaactaaagccacatgctctctgtgcaggattccagaagcttccctatttcctggggagttactgcattgcccttagccctggtgagcagcttcttcattccaagtcctccttcatcaaattagtcctctcaccggataaacctctaagaaactaaaaccccttagcagagcagagtgcagtggctctggacccagtcaccacgttgaacctggtcgctaccattgacaggccaggtcccttcgacaggttacgtaatttctctgtgcctcaaattccacctctgcgaatgacgagagggaggaataatggcccctgcctcaagggttattttaaagactaaatgagtgaatatacagagcacagtgcctggctggtattaagcattacatagtctttcaaaaaagctgggcagctggagaagtgaggcacggtctgcttttctcgggaccttctttggccacgttaatgcctcaccccaagctgcaaaaatatgcagcccaacccctgagggaggaggaatgtctaattcgtatttgttttggttgtgcatgtgctttgtttggctttcccagggtctctccagcaccagagctgccgagctcctggcccgggatgggcccaactccctcacccctcccaagcagacgcctgagatcgtcaagttcctcaagcagatggtgggggggttctctatcctcctgtgggtgggcgcctttctctgttggattgcatatgggattcagtactccagcgacaagtctgcatccctgaacaacgtaaggctctggggtgtcccctcctggttttgctggcagagccatccagtgaggccttgggggcacagctgggggctgaatgccactgcctaggtgtgggaaagtcaggcattttcccagctgtaaaacagaaattctatctggctttctgatcttctagaggcagtgtgggcatgaagagggatacacaaaacaccttgaatttttaagggggagaaaatctgcatccatgtgaagtagtttggggttctgtctcccccaagctaacctcttcctttaacacggagagcagctgtgcctgccgagacatgagtaccaaatccacaaaactgaattggccaacgtgatgccaagagacagaagccagaggcaacaagctacatgtcataggattggattgacatgaaatgtgcagaacaggcacatccttggaagcaggaaccagatcggtgatgccagggcatgggacaggagcagggagtgacggcagaggggccggagggatctccaggcaggatggagatgctctgaggctgcggtggagggtggtgtcatggctctgtaaacttaaaaaaaaaaatcaataagttgcgcacttaacatgggcgaattccatggcctgtaaattataccagggcgtaactgccagcattgcatcctcccgtggagagctctagccccagggcccggctgcttcccactgctggtttctctgactgacgccctccttctcacccaggtgtacttgggctgtgtgcttggtctggtggtcattttaacggggatctttgcttattaccaagaggcaaaaagcaccaacatcatgtccagcttcaataagatgatccctcaggtgagtggcagccacctatcctctggcctctggtgactcccaggtgaggaagcctcagctgggaggggcacagggccctgagggctacgggtttccacttccttccctgtcggagcaatcgtgggcgaattaacccatctgtcagaaccccagttcctcacaggattttgatggtcaaatgaggcaccacccagggcagtgctggttagcccaaggcatcttctgttcctgctcctcagtgtttgtggatagtccttctgggttctggaagggacctgtggaaggtcagggagtgttctttcactggcagccaaggagaccagcctgcaattgtttatctgtgaccatttttgctcctgagccccagaatgcatttggtggggaagcccagtgctcccttcttccccaaaaacccctgtcaggtgtccacactgtctctggcccagagaactgtgggctggagagattctgggtggaaaagacgcctcctgccaagcttgaagcaggagatcacctcgttaaaatttccctgacactcgcaagattatcagcctccccagccccaccttcagtgttctgcccagacgcccagccaggattgctcacccttagtggtctccttttctaggaggcccagggctctggcttggccagatctggccaacagcgactcttctgttccaagaactctccataagctcaagaaaaagtagttcttagagtcttcaggcctcgggtgaagcagtcttctgtttcattcttgctgttctgacagcctcatgctccagcagcaatgctgtgtccacagggccaggtgcaggctgcataacagcatggactcaacagtgagagtgatcaggaagttccaaggcctctgtcctggggttcggtgcggcacagacttgggggagggccggtgtccttccagggtctgaggcatctgtcatggtttttttctgcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtaagcggcaaggggtatccaccccaaggaccatgttccaaacctgctggctctggggtctttcccagcatcagtataagaggcagggaatgaggtacccagctgtgaaccaccttcaacatttcttctaggtggataactcatctctcacgggggagtctgagccccagccccgctcctctgagtttacccatgaaaaccccctggaaacaaagaacatctgcttctattccacaacgtgtctggaaggtaaaaggcctctggctctcagcccacatgtccacctgtgtcctttctccctcctgggctctcaggtctgtcctttgccacaccccgttacaaagctcatcccagaggaagcatggaactgaagggcctagaggacgatgcttggccttgggaatgtggtgtgcctatcgattgtgccagcccccagagagggctgcaagctggctgcacacccctcctggctgaggacccctggaataaagcatctacttcccctgtaggcactgtcaccggcatggttatcaacacgggtgaccgcaccatcattggccatattgcctcattggcctcaggagttggaaatgagaagacgcccattgccattgagatcgagcactttgttcacattgtggcaggagtggctgtctccatcggcatccttttcttcatcatcgctgtgtccctgaagtatcaagtcctggactccatcatcttcctcattggcatcattgtggccaatgtgcccgagggcctcctggccactgtcactgtgagtccatgctgttagacagcctgcacctggccctgtggacacagcactggtgctggggaggcgcccacacaaactgcaatctcccccaagtccagagcaccacgccctccccgccagcgacaaccctggaacattctgcatagactgttccttacagagacaaaaaatttgtcatattttcaatatttgactgcgttttccttgaaaacgttatgctttcaatctgcaattcacacagcttactctgccccataagatctagataagacagactccaccattcacaggttttctagaagcttgatgccttccgcacatttctttggcagtttctacaacttaggcatttaggcacattgccacactccacttacctctcttacgaaaaaaaaaaattcctcccatttttcctgccgaggactccagccctttcctggccaaccccagacccagctgtttgtatgggcccatgtcattcagtccctagagaagagccccctcctcctcagtctctcctgtgggggtctcaaggggtaggagaggagggggtttatgtttccagttttgtgactacatgatcattggcctgctattgtcctgaccaaagaaaagagaagaagtttttgaagtccaggtctcctctgactccaggagatagtaatttggggaaattggagccaaaagaaccctttgagatctaggggtttaaaagaatctttaaaatatggagcttttaaaatgaaacaacataaaggctgctgaattccccaaagcaacaagtgtgtcctttgggacaactctttggcatgcactggtcagtctctcttacacactcctgcttagggatcacaggaggcgtcgtgattgtacgtgaacacgagccacagcagcgtgtccgtgtttgctgcccgtgggtcccttgttttcttcaagtcatgaaggaacaagaaaagcatctcatatttaatctttaaaaaaggattgtggcatagagggctcttggcggcgtataagccaccaggtcagcttagctgcgctgacaaccacacctctcccctaaaactagtccagctctctcctaaaattcaatcacagctcacattggctatttctgtattattggacctgagttcaaatgaggatttttcccaaagcgtccttccctctcctgctaggtgaccctgtcgctgacagcaaaacggatggccaagaagaactgcctggtgaagaacctggaggctgtggagaccctcggctccacctccatcatctgctcggacaagactgggacactgacccagaacaggatgacagtggcccatctgtggttcgacaatcagatctttgtggctgacaccagtgaggaccattcaagtaagtcttatggagagctcggtctggccaaagctgtggactccatcctggggctgagctgagcacacagcagggtctgcagccagaggattgctggacagtgactcatggacggccagcccaacccacagcagccactgttctttctctgtcttccagaccaagtctttgaccaaagctctaggacttgggcctccttatccaagataataacattgtgtaaccgagcagagttcaagccaggacaggaaaatgtccccatcatgaaggtaatgcttctgcagcacttggtcttaaatcacagccagtttgtagtcacttgctgaggtctgattgggtgcttgatttcatctctccagttgcttaaagtttgttcagtgcttgcaagagcaagtcagactcacaagacatccagaaatttttctttatgcacactagctttgagaatacaaagatgcttaaaaggtttcagaatattgctttagcgtcttcagaaaattctggaaatgaatgcacttctaagttactttcctgacttttctgccagctaagtggatataatcaaagttccttttaatatacacaccattcatggaaatttaaagtgtgattgaataaaaataaaaggactcctgttaactagaatatggctgcagacaaagctctaaggggtcctggaatatcggaacatacaataaactctccccctccctccctctcctccttcccttcctcccttttcctctccatctcaatgagtcactgaatccctgttctcctggcttttctatttgccatctgtttccttccctgactctttttctttcttatttttttgtttgtttgtttgcttttctctccgtcagacagctcatgaatgctctttttggccaattgcttctttgtcgatatcttccaaatctttatgtccagctctaatttcttacctcaactccaacccgaatctctggctggctgtgtgcttccgctaggaagttgcacaaatcatgcttgttaacttccacccgtacccagcctggctgcacatcagtgccttgccgcaattttctaattgtctatgatataaccattctatttgtcattggaacagaatatttggaagtcatctttgactttatcctttccttatatccagtaagccaccaagttctatcattcttgcttcaaaatatacataactttagtatttgtcagcagtaccttgcatctaaatagccgattaccggctgattggaattaaacctctttgattccggtttatccctcctggggtctttctcgaatgccactaatttcccttaatggtgcttttatagtcacttaactttgctcaaaatctctccgtacttccctgttttctgcttctcaagtctagacctcaggctacctttcagggccctccaggtcttgccacaccctccacatccgcttgtaccttgaacactcacggacgagcctgcccctcatgcccctgcacccgcatcctggtttctggaaggctttcttctctgtgtatcggtaacccacctatctatcaagatctagttcgtagctgcttttttccacgaaatcttcagtcctcgcagaggtccagcttctccaaacatccctaatgccagtaggtggcactgttgtttacacgcttaccacggtcttgcggccctccctgatcacgtgataatgtctctccagctaggtggtaatgggatcaggagggtgtgttttgggtcctatgctgagggcatgttggttcattaaatatgtgctgcaaatatttttcttctttgattcccagaaagctgtgattggagatgcctcagaaactgctcttttaaaattctcagaggtcattttgggtgatgtgatggaaattagaaaaagaaaccgcaaagtagctgaaatcccttttaactctactaataaatttcaggtgagtttttcctcacaaccggtaatctctgtcatcggcagcatgacctttctacttgcatgcatcctttgcttacctcatattttgaaggatacctggcttcaaagacagtcgtcagggatacagcacccaggcatctggtcccctaggtcaagctcccttgctggcctccttcctaaccctgaagcagggcagagaaagaaagaaaggcaaggacttcatcagggcctggctgctcctatgaatgagccatctctgtcacaggcacacactctctctctctcacacacacacacacacacacacactcacaccaccactatcaggtaccttctgccgtgaggagcagcagccatactccaaagcataaatgccaggtgggcagcagggaggccgaacacctgctcctctcacctctagtgcatcaggccctcgacctacgtggccttgttccatgttcgcatccggcctgtgaggtaggactgacgaatcctgactcagaggaggaagcaggcccttagaaagtgttgagagaccagagtcacacagcacccagtgttcccaagcctgacaccaggtccacgattcttccaccatcacacagagggagtgcggcacagttcaggccatgggagcaagccctgccctttggggagaccggtgagcagcccctggggtgacagccccgtcgttttctggggccagcccctgtgctgtgggtgggggtctcctttccatcccctgctcaggtagaagacggccttccttgcctggttatctcagcaagcagggctggccgacagtcagccatcacagcctccccatgttaagacaaatgacagttgggagccccaggtccccatgcagatgggattttccacagagcccacactggatctggacttgggctttgcacaacagtaaagtatagaaatggaataaccacaactgtacgtgtggagatttctggtgattatccacctgtcttagttcggatggaatttagggttagggaagaactcttttttttttttttttttttttttgagaaggagtttcactcttgtcacccaggctggaatgcagtggcacgatctcggctcactgcaacctccgcctcccaggtataagcaattctcttgcctcagcctcctgagtagctgggactacaggaatgcaccccctgcccagctaatttttttgtatttttagtagagacagggtttcaccttgttggctgggctggcctcgaactcctgacctccggtgatctatccgccttggcctcccaaagtgctgggattacaggcgtgagccaccaagcccagcctagagaagaactcttgtgttgcaaatgtcttctttgtggatagtgagccaacagagaatcacagttagctaaatagacaactaaccagaaacatatgatgtaaaatactcaagccaagaaaccacatctcttacgtaaaaccaaagtgaaaatagagtgcgcaacagtcctaaaagactgttttaggatgagtattattatactaataatactagtgataataggagctattctgtgctaatttccacaagtattaaattattcattcgcacgacaacactgtggggtggctagaggatgaggaggttgaggtgccgcgcatcagtgcacagtgtgaagatggggttagatgatgcctccatcagcagcaggacttggagccctgctgaagctccatctcccaaggtaaaggcatgcccagttgcaaaagggagaaaaagcaggttccatgaggcctcatgtacaagttggaggagaaagtggctacacagagtgggactagaaaggggagaggggggccgggcgcggtggctcacgcctgtaatcccagcactttgggaggccgaggcgggtggatcatgaggtcaggagatcgagaccatcctggctaacaaggtgaaaccccgtctctactaaaaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaagaaaggggagaggggctgtgtgagttcctgctgaagaggtcggaggtgctgtctggatgctgttagggtcattttatatctacacatgagcggtgctcagcctcaccagggctttagatgtcatggccttggaaggagacgtctctgcgggaaggaaataaaatggaaagcctgtgtcttattgattagaatggtgatgccccaaacacactggtctgttaagacatttgaaacagtttacggcaaattggaaaatgttttataaagttttatataaagatgaatgtatttaatttaaaagattatcctttgtagccaccatgattaagggcagggactctggagcctgctagcctgggctcaaatcccagctcagccaccagatagccacctattgctcagtgaccctgagtgaagcattgaacctctgtgcctcagtttcctcctttgtaaaagggaataataatagtacccatggccttaaagttgttttgagaataaataagtcgatgtggacagcacttagaacagtgcctggcacgtggtacataccataaaagtgtttcatattatccctatgttttaaatgtaaaaagccttatcttggccaggtacagtggctcacacctgtaatcacagcactttgggagatcgaagaaggcagattgcttgagcccaggagttcaagaccagcctgggcaatataccaagaccttatctctacaaaaaaaacaaaaaacgaaattagctgggcatggtggcacatacctgtagtcccagctacttgggaggctgaggtgggaggattgcttgagcctgggaggtcgaggctgcagtgagctgtgatcgtgccactgcactccagcctggggcacagagtgggaccccgtctcaaaaaaaaaaaaaaaaaaatttaagagagaaagagagaaagaaaaagaaaaggcctatattttagaaagtgatagagctgggaggttttctgtttggtttggtttttgttggttggttggttttctcaatgtctttacttgatcattaaaaaaagcagcagcagcagctggtaaccctatttgccctatacttctttttgtactcatctttgatacccagaagtctaagaaatactgatttgtaaagaactgttttacccaaaattgtagcacttttctttgcaacttattttctcccaaacactccagcttcctgagattcctcttgagtgcttagaagagtacctggcttatcagaagggctagataagagttagtccttttattcttgtatatcgattttttttgcatatcttattaggatggatctagaagtagaattgctgggtcaagagcattcctattaaaatggagactcctgtgactcggctgtcttcctgaaacattatacgtggaagtgtccacttcctcacaccccgccattttctatgacatccaagcaggaaaactgggtggacaatgaggtgaggaggtgcagaaattcctgtcgcctcctcccctcctgagctcagaatagtttgggtctgaaagacggctgctccccacagggaggtagaggaggtgagatgcagaggctcgcagccccctaactctcacgggcaccctgggagatcttgttcaaggcacaagatttcacacgctgacggccacaactagcctgcctaaagcagccagttttgcttgaaagatgagctccacttatccagagtgggtgccccactctgggctggggccaagtctagagctcttcgtcttacttggccacagaaagaaaaagggcggaacatgctgaggatgccattgtgcctcttcctcctttacatttaatggaccagtagagaagaaggaatgcgtttcacctttctgtaagtaacacgctcagttcattccttcccagctctccatccacgagatggatgacccccacggcaagcgcttcctcatggtgatgaagggggcccctgagcgcatcctagagaaatgcagcaccatcatgatcaacggcgaggagcacccactggacaagagcactgccaagaccttccacacagcctacatggagctgggcgggttgggcgagcgtgtgctgggtgagtgcggcggcagggccctgcccatcacctggtgggcacagagatgaggcaggcgccttgaggacctgtgacctagcccagtggccatggcatccacgtgaagcatgtaaaggagaacatgataagcaggatgggaacaaggagaggatgctgtgtgacagcaccaagcagggtgggatggcctccagagaggcaagctcagggaagactttatggaaggagttaaatttcaaactgggccttaagtgactgcatttgaggggagataggggaaagtatccagggcccagggaacagcacaggccaatcacagaggcagaacggcgtggggcacattgggtgctgccagcaggtgagatggcactgtcacagaaacagggttcaagggctggactggaggtcatgagatggaggtcttgaacatctgggtgaggagccaggtttcatcctgcagtcagtagagagcactgagggctgtgccactagagtgagctgggcagtcgcagggctggggaagactttatggaaggagttaaatttctttaacttctttaaatgtctttggcggcagcagggagaggagagatgcacatctccataggaagcagctgcccttgctcaggcaaaagggatgggaattttttcagggtgatgggaatgggaaggagagatcagggcaagagacttcatagaggtagagtttggtaagatttagaacctatcagagaaggataatgtttaaaaatgattaagcttcccatttaacgactaggaagagagtgatgccagtgatgcagacaaagtgtcaggaaggaaggaaccttagaaatgcaacaggaggaggacccaatgggggtgcctgcggtgttgtcaaaggggacagtgtgtcctgttgtcagcaccagggctggcggaatggtgccccatcaggaccacagaatgacaaattcaaggaaacagaagtgtatggttgacgatccggctcattaaacaccatggaagtcctcaccaatacagatgcagtctgtggaatgtgtgtttctaaaggctattggagttggcaaatcagataaagcatataaatgagatggtgatgctttaggcatccaataacccacagtaccgggtattctacacgggatcgatgcccacttgcgtttgatttctcaaagcctgctccattgacatttgcaaagcagtgggccaggctgaaaataaattggatgtgaaagctgatcacacaatcttggaggtcccaccagacacaagagtcccttccacctcagcctatgagaggctgatgccttctgagaaaaggatggctcggccccattcctgctggcctttctcttgggcttatcttgatctagcactgaactttgtgcccctccgctgaacccccttgttccttcacatgctgttttctctgctgaaaatggccttcccacctccaccctcccttttttccctagaaatcatctttgcccctctcaagcttcacctcacatgtgacctccttggggaagtctctcctaatcctccaggcagctgaaatgtgtctctgccctgagatgtaccctatgcttgatccctttaactctgtgccccgctaaacttcagaagtcgagactgtgtattgccctagaacttggcaatatagcaagatatatttctagaacacagagcctaatgagctcacagtgaattatatttggatgaaatatgtctttcctaaaaaaatgcattatggagttgaagaaattaaacaattctggcttattctaatgtattggtaaaacagcagaggaccaaggtgtatgagcatgttctcctcttattttttttcgtttcctattctagtttcactgactcactaattcatctgtattacaggtttctgtcatctctacctgccagcagacgagtttccagaaacctactcatttgacatagacgctatgaactttccgacctccaacctctgttttgtgggactcttgtcaatgatcgatccccctcggtccaccgtgccagatgcagtcaccaaatgccggagtgcagggatcaaggtgggagttattttcctgactcaagaagttctttctttatgtcgtgttcctttctaataatggttttcatagcagatggtcagtatttaggtgtcttcaagtaaatatcataattcctattttatttctagtttcactgtgctaaggttactgaaactgtcccacaaaaagaaaatgattgtgtctatgtggaatgaaccacataaacagtaaatgcaatgagaagaatctcctagtgccttgaagtgaccatatctcgccctagtccatggtagatactaaaaggctttattggctgggcgcagtggctcatgcctgaaatcccagcactttgggaagctgaggcaggcggatcatctgaggtcaggagttccagaccagccatggccaacatggtgaaaccccgtttctactaaaaatacaaaaaaattagccagatgtggtggcacacacctgtaatcccagctactcgggaggctgaggcaggagaatctcttgaatccaggaggcagaggttgcagtgagccgagatcacaccattgcactccagcttgggcaacaagagtgaaactctgtctcaaaaaaaaaaaaaaaaaaagaaagaaagaaaagaaaagaaaaaaagaaagaaaaaaggctttattactcagtcttgaggctcagcccccataatccatgttcatcattactaggttaatattaagactgttgaagtaacatggggctacccccaagtagacactcaccagccctttcacaaataaagtggcatcaaaggggaagggcttcctttcatgtcagaggaggaagcgtatgaagcttaggagcaagggtagacccaatgggattagtgtttcctccaaagacagttgtctcgtagatccagagctgccactgtaatcaccaaccacgttctcccagggcactacagagtaggtattactgaaccatccccactttggccaaccgagttcttcattacccgtgggccttctcgttgtctttgctctaggttattatggttactggtgatcatcccatcacagccaaagctattgccaagagtgtggggatcatttcagccaacagtgaaacagtggaagacattgcacatcgcctcaacattgctgtggagcaagttaacaaacggtaagcacaggagcagcatagtaaaaattccagtttatacccatggggccccactggctctaaagagctgcactacttggaacaaatcagctttttgctctcagagttatgctaggcttgtttgagctattatttgcatatccatgtattcactctaatttcactgagcagctaatatgtgccaggcacagtattgataccatgaaatgaccctttatgtgttccttgtttgaaatttcaaaatccagtgtgccctgggcacaaaacctatgtgcccaatttagaataagaaaaactgaaacaaagggtttatgtgaaattacttgccatagatgcagttgcataatttggaatcgtaagaaccctgtgggttgtttcatgcaccctccttggtaagcatcttgggtatttatccacccggtttcataacgtgtagctatgtaaacacacccttcttttttatttggtaatagatagaatggaagcttcctaaggaaagtttttttccttgtttctcctaattcttttaatcatgtttatccttattcttttaatcatgttcatccaactgtacattcactcatgtatttgttctttcaacaagtatttactgcgtgccaactatataccaggcaagacctggaactacagtagcaaactgaacaatactatccacaccgttggggaatctttccatcgagccaaggagacacaaacaaagctaacaatgatgtggccagtgtaatgagggagccacacaaggctagggagctgggcatgcaggagagtggcctggactgtgcctggtctccatgagtcaaagactccgaattctcaggttgagaagtaatgttcattagctgggttatgttttcacgcatgcgggagatgagggaaagaccaatgcacctcttcagtttccccaagcacttaggtcttttagggacacacagctgtcaggtcataacaaattaccacgttagacaaccaaccagggttcccgcctctgggcacagcagcagtacctgaagtctaagagtcttgcagtgccctttagtatacataacatccctctatgaaaacaactttggggcttgtttatttgtttggttttgtaagataatcggattatactttttttcactttagaattttaaacaaattttgtttgtttgtttgtttgtttatttagacagagtctctctctgtcacccacgctgtaatgcagtggtgtgatctcagctcactgcaatctccacctcctgggttcaagcgattctcctgcctcagcctcctgaatagctgggattacaggcgcccgccaccatgcctggctaattttgtatttttagtagagacggggctttgccatgttggccaggctggtctcaaactcctgacctcaagtgatccacccaccttagcctcccaaagtgctgggcttacaggcgtgagccaccacacctggactaaaagaaatttttttaagagtagtcaagtgcagtagtgagaagaggggaaagagtagaagtttgatctgtaactgactgtgaacaatcagttgagctaattcactactaccttcagaccagccgagtcttctttttttagatacaaggtgtcctgtcagatcacccaggctggagtgcaatggtgtgatcatagctcactgcagcctcgacctcctgggttcaagggatcctcccctctcagcctcccaagtagctgggactacaggcttgtgtcactgcacccagcttcattttagcagatttttttttttttgagatggagtctttctctgttgcctaggctggagtgtggagtgcagtggtgaaatctcattgcagcctccacctcctgggttcaagggatcctcccctctcagcctcccaagtagctgggactttaatttaaaattttagcagatttttttttttttgagatggagtctttctctgttgcctaggctggagtgtggagtgcagtggtgaaatctcattgcagcctccacctcctgggttcaagcaattctcctgcctcagcctcctgagtagctggggttacaggcatgtgccaccacacccggctagtttttgtacttttagtagagacggggtttcacgatgttggccaggctggtctttaactcctgactgcaagggttctgctcgccttggcttcccagagtgtagagattacaggcgtaagccactgcgcctggcccattttagcaatttttaatgaaagttgtatataagataccttattcctgcatcttctcaattgcttcttttttatatttgcccttccttccctacttaggaagatttgtttggccttccattcaaggatcttttgtggtctttgtctagttttagcctggtgatggccatgtgctggtgacgtgcacacgacggtcctgcccttagcctcctcctgtgctcctgttcagtataggtggcacatttcttcctataaacctggactgctttgccaatttgctggcccgtatagtgtctttgtgcaacctcaacttcctcatcctttcagatgggcatggatggaactgtgcttgtagcagactccagaatgtgcttctgtctcagctctttggaacgagagaaagacataatcttcctacgaatgtgggaaggtgcattgaaatgacttttatgattcttgcctcagtcaaaagtcacaaagggactgcacttcctcttggtcactgccactctgctcatggccacaaaagggaagagtggattacacatttgtatacaaatcaccacactgagtgaagtggatgcttttgtgaatgttttcagttattcacttcatcagctctagtttcatgaccatataaaaattgcatcttagcaggtgtaaggggaaaggaaacaccccttctttcttctcttactttcttttgttttgttttgttttgtttttttgccagcggttaaggagacctgtagtttgagtcaagtgctagaattccagtatttagcaccaagaggtaaaacagacctagaaagctcaaaacttgcaaattgtaaagaaaaagacctgcagcagtttgtacctacattgtttaagctgagatttgaaggctgaaatgtagtgttagccacgagaagctgaggtgagagatgcccattcctggtcagggagcgagacccgtgaaggccttagggtacaggggatggaggatgtcagaactgagagcatccagcgggcaggagggagagcccaaggtgaggcgaagcttgacaacgcaggccccacctgggctcgctggctaaagttagggattccggggtctgctccaagcacggtggaaagcccctgaagagttttagcaggggactggctcaggcagctctgcataatcaataggccctagaaccttacttttatagtcagcaggcaatagcgctgctcaaagacttcagtaaacttctgcctacgtagcacattgcacaaagatgacactctgtaaatctgaaatacccaacggcaagtaattattaccccttgtttggccataaaagaattctaggacccaaaacatatgaacaggcagtttgggggttttatttttatttttgtttttgagacagggtctcactttgtcacccaggcttgagtgtagtggcatgatcatggctcactgcagcctcaaccccccaggctcaagcaatcctcctgcctcagcctgctgagtagctgggaccacaggcacatgccaccatacctggctaattttttaaaattttttgtagagacaggggctctcactatgttgcccaggctggtcttgaactcttggcctcaagtgatcctcctactcagcctcccacagtgctgggattacaggcatgagccactgcgtttggccatgaatgggcagttttttaacttccttttacttctgaagtaaagcgttgctctaggaagtaccactctcacctgttctagtagggataaggctacctggttttttattcctattgttatatggtaccaagaaatggtgttatattttagcctcagtttgccctcttgaaatggagactaaagtgttcccaggactcctgttacctcactagagcattaggtatcaaggacactgggttccaggtcaagtcagagaggcttcagccagcatcctgcctggaacagtgtttcaacctaagatctgcccttgggcctcacccagtttcttctggcccttctagggatgccaaggccgctgtggtgactggcatggagctgaaggacatgagctcagaacagctggatgagatcttagccaactaccaggagattgtctttgcccggacatccccccagcagaagctgatcattgtggagggctgtcagaggcaggtgggtggacagcagtgtccagaggactgacaggcccatcactgtccatgggcaagtgcagaggtctggatctcacatcaggctgtggtgcctttgaaacttcaagagagagttcttggctcatccccatcacctgacctctccaacctctcaggtgggctggcccctgtcctcctttgagacccccaccacatgttccccgaaaggctcaccccagctctctgcattttgtcatgagagcccggtgaagcatttgccactgtggtagttgtgagtaaagagagatttaaaatgcaaagatttaaaacaaaaaatgtgaagacataagatacaagacacctgcgcattaggttttcctcatttgcacgtatcttgtttggagacccttgttcctgcttctaagatttctcatctttatcttttcccctaaatgggcctttccgttcagctataatcatcctcgcaacctcaagagaaagggaagtcttgttgctcttgccaggcctgcaacccactgggcctgctcactcccactttctccctgggtcccccgccataggatgctgttgttgctgtgaccggggatggagttaatgactctccggctctaaagaaggcagacattgggattgccatggggatagcaggttctgatgcagccaaaaatgcagccgacatggtcttgctggacgacaacttcgcatccatcgtcacaggggtggaggaaggtgagtgagtctcagggggtcttcccaagggccagggtggtctgggggactagaagtaagttctgaaggagaaacctctctgcctaggtcgcctgatctttgacaacctcaagaagactattgcttattccctgaccaagaacattgccgagctgtgcccctttctgatctacatcattgtcgggctccccctgcccattggcaccatcaccattctgttcattgacttggggacagacattgtaagtgacactgaagggaacaggctgtgatgcctgccccaggggaggtcaagttcagggtcgctaccttcaagggccggggatggactaactcaaggcttctcagcttccatgtgatggggcctgtagctctgcatttctcacaggttctcaggtggtgcccattctaccagtccacatgccacacctcaaagcaagggaccagaggcatctgccaaatgtttggaaattaaaaacactctatagtgagcttttttttcttgagacagagtttcactcccatcacctaggctagagtgcagtggtgctatcttgcctcactgcaacctccgcctcccaggctcaagtgattcttccacctcagcctcccaagtagttgggactacaggcttgtgccaccacacctggctaatttttgtatttttagtagagatggggtttcctggcctcaagtgatccacctgcctcggcctcccaaagtgctgggattacaggcatgagtcactgcacctgagctatagcaagcttttcaagacatgagtcttcatcctcaaaaaaaaaaaagaaatgccattggtcagtttcagcctatgggcttcccttttcttttgggaagatgaagctgtcactcagattaatcacccaaataaccactgggggcccagtgactaaagtgataatctcacagccacctcttgttaagtaagagagtctgacatggaagacctttacctaaacacagtaagaagtagcagttatgaagactttataaagccttgccctacagtaatgtcacctaaaccttccccttttccagtatccatttaaagaaagccccgtctaagctgcccatgtggctgtggcttacgtgggcaagcagggaaagcaacagacagcaagctgaattcttagcaggaaactggcccttcgaagtgcccccttccccttcaaattgcccccttcccctctcttgttttctacaacacccaggtaatccctaattcctagagagactggagatgtctttccctttgaggggtattgaggtccccaaagttgatggatcattttccaagcccttcacatttgcctgctttgctctgctgcagtgcttctccaggcctggtgcgggcatcacctgggaacttgttagacatgcacactctgggcactggtggacacctgtagcctagctactcaggaggccaatgcaggaggattacttcagctcaggagtttgagtccagcctggtcaacacagagagacctagtctcttaaaaaataaaaattaagaacaaataaaataaaaatcttattccagataactgggctaggaatggaaataggttgtacacccattgtcttttaaaaaagagaaagaaagaaagagaaagagagaaagaaagagagaaagagagagagggaaagagagaaagagaaagagagagaaagagaaagaaagaaaggaaagaaagaaagaaagaaagaaagaaagaaagaaagaaagaaagaaagaaagaaagaaagaaggaaagagaaagagaaatgaatgcaaattctctggccccagcccagtcctcctgaattgggaagtctggaggtggggcgcaatgatctgtctcttagcaggtcctcccacctggagggagaggacggcacaagaaattctccctgtaggggaagagtgttttataaccagcatccttcagaactgccagcacagggtgataaaaagcagctgatttctaaaggcactattcttaaatttccatacagacaacacgccctctactgcctatagcctggatgggccagctccatgccccccaccccatccagccagtgccccacccaccccagcccccctcccctactgtgggtagagcagaacatcctggggttagacctcaccagcctcttcccctctagatcccctccattgccttggcgtacgagaaagctgaaagtgacatcatgaacaggaagcctcgccacaagaataaggacaggctggtgaaccagccgctcgctgtgtactcatacctgcacattggtacgatgagggcgcgtcttccccatcacacgagggcctgccccgagaattcactggagtggggggcacagccagaaagtgtggttttcctgtggggcctgggttggggagggagggggaaccgagagtagacaggatgaggcagtttcctgaggccatcatagaacctgtgtcctatctctcttgttctttcaggcctcatgcaagccctgggagctttccttgtgtatttcaccgtctatgcacaagagggctttctgccccgcactctcattaacctgcgggtagaatgggagaaggactacgtgaatgacttgaaagacagctatgggcaggaatgggtgagtggcgggagccctgctgcagagtccacctgattctctccatgctcattgccctgcgcagaattacatagaacctccatgtccctgaacagcctgggaaagcttcaattaatagggctcagggcccccttgctgacacgtgtttggcctttgccaggtctcatggcacagcctcctgtcttgggctagatgacaagaggtccctttttttaccttagctttgccattggtatagaagagtgaccagcccagccacacccacagtgcggccaaataaatttacatctttcaggccgggtgcagtggctaatgcctataatcccagcactttgggaggctgaggagggagaatcacttgagcccaggagtttgagaccagcctggccaacacagtgagaccctgcctgtgttagaaataatagtaatgataattttttaaaaaattaacatttttctctactcagctggttcaagaaagaaaaatgtttctttccaaacactagaaggtggtccattctcagtccgggtgaggtgtggaaagaacatgaagctttagagaactgcattggaatttcctagaagttttcctttaggcctcaaggtctcttccttctctgcccattaacagacaaggtaccagagggaatacctagaatggacgggctacacggctttctttgttggcatcctagtccagcaaatagcagatctgatcatcaggaaaacccggaggaattccatcttccagcagggtctcttcaggtactgcctgtgcccggcctcctggggcagccctgggcctgccgtgcaaggatgatgatgatttgtttttcacaagacagagttctggccacacttgtaaccccagaggcattgatttttctggtggcatggtctgctgggtgtatgatcatgaagccacaagaatcccaagtctgtctgcttttgtgtgtcttgcagaaataaagtcatctgggtggggatcacctcacagatcatcattggtctgatcctctcctatggcctcggaagtgtcacagccttgagtttcaccatgcttaggtgagttcaccctcaacagcatggaggaaagagccagcctctgctttgagctgtcgcagcctaaataaacctgaggattcccagggttcttccccaagtctttcaaaagacgtcaaactgatcccatgctctgtgagcccaaagctttgatctgcattttccagaagtggaaatgggttttctagacctcaccaaccggccttcatcctcatccaacaggttgcttcaaaggcagacattgcttctagcagtcacagtgcaggttaaacaaggagctttccacctttattttgtgggacctcgtggatttgtcgttctttgcagtaaagcaagacaaatgaacgagaagccccattcccattgggcagggttgggctatccctgtggatgagtcagggttcactttccatccctttgcttccagggctcagtactggtttgtggctgtgccgcacgccatcctgatctgggtgtatgatgaggtgcggaagctcttcatcaggctctaccctggaagtgagtagcctatgattttagaggctctgtttacccacttcaacagactctccatttctgatgtacttttttctacctctacaggctggtgggataagaacatgtattattaagaccacctcccttcctatgtctctcagcagcacgttggggcacacttgttcatcttctgaccgtttgctgggctattcccctgcagtgcagacatcgtcaaaattcagacaagaggaaattttcatgcagaaagctgtatgcaggatgctcactgatgttttgcactttaaaactgaaattcaactctttatataggattttcttttctatctccatctcctcattaaaaaatacgtacatttcgaggtaatggtatagggaa

SEQ ID NO: 623 - DNA, 31376 bp, Homo sapiens; identical to SEQ ID NO: 622

SEQ ID NO: 624 - DNA, 48671 bp, Homo sapiens
cccgccccggtccgcaaagccggtggcgcccggaggctgcacggagagcggtgcccgcgtcaggtgaggcgcgcgcggggaacgggggtcgcgcgcaggggagcgggggtcgcgcgcggcttccatagagcgctagggcctgagctcgaagccccaggcccgcaggaggcccgggcccgcggccgccagagccgggacgcagcctgggcgccgcctgccccgccccgccccgcccgggcccggagtgaggacgcggtcggaggcccagcagcgcgggtcccggcaaggggctttctcaactacacaaaagacagtctaaaaaattaagtctccatttcggttaagactgcccgtagtttcggtttttatgtagacccaagagggcaggctcggcgtccgcgtgccgcgtagtccggcggctccaggagcgcgagcggctgggcccgggcgtagccaccgcagggccgctagctcggccgggacccgcctgggatgccctggggtctgctccgctggggcgaatcctgaggcgccacgcgaggcacttggcctctcctagccccgctttcgtttttggaaactggaaactatcacttatttcgtagacggtgtgagggttacatgacagtgttctgtaaagtgcactctacatatgaagtgctcagaaatatggctaataatgagggtatttataaactacttaaattataaaaagaatgagacatcagacttacagttttggatactaatttttttcacttaacgttcattatgtgataggagttttccatcctattataccgctgtgcgatctgatcttgggcacgttaaccaacctcttgttgcctcgattttctcacctgtaaaagtgggggtaatcataatgcttacttagtaggatagccctgaagaataagtgacttagcgaacataaatagcttacaatagggttttcagcatgggaaggattcagtaaatgttagctgtcatcatcaccacctacaaaggaagcaatactgtgctgaaagtttttccatcattaatgtaatttctatagtacgattcccaagaagatattaaaattatggaaataaaggtattggtatattcctaattatttcctaaaagattgtattgataaatatgctcatccttcccttaacgggatgcattccagaaaaacaagtcaaatgttagacaaagtatcagaagggaaattctgtagccagagagctaaaaattacaatagggtctctaattatacttcaacttttttaggaataattctcagtgtgttttcccacatttcatatgtaatttttttttttttttttttttgagacagagcctcgccctgtcaccaggctggagtacagtggcgcgatctcggctcactgcaacttccacctgctgggttcaagcaattcttctgacctcaggtgatccacccgcctcggcctcccaaagtgctgggattataacaggcgtggcatgagtcaccgcgcccggccgatctttacttttttattctttgtaccccctgcctatccagttagcatgtgattaaagtcaaagatttgccactttgggccacatctattaattttcatctttgttataattgtatttagtttttgatctacactgcttattactcccagtcattttttctagaactgaaaatctggtaaaatactcaaaattgcactgacttctatgtagaggcgacactccatcagaaccgtgggctgacagggaatcccactgtgcaggagctgcgcgcattttcatttctgattctctttggcgtatccaggactctgatgacatgatcatatatttatcagtagtaacaggttgggccatttgttttttgtggtaaatcatatatttaagattttagaaataagttgatagccatgtattttggaatttgaaaaagacattgcattactcagcttcaaattaagctttaatcaaatagtgaaactttccattaatggacagtgtatacctttttgtgtatttaaaaaaaaaaacactgaatatagtgcctttgtgacaggggagcttagttcctgacaatgtcctcttgagtcttttttttttttttttgagatggagtctcactgtgtcgcccaggctggagtgcagtggcgccatcttggctcactgcaacctccgccccctgggttcaagtgattctcattcctcagcttcctaagtagctgggattacaggcacgcaccaccatgaccagctaatttttatacttttagtagagacagggttttgccatgttggctaggttggtctcgaactcctgacctcaagtaatccacccaccatggcctccccaaagtgctgggattacaggcgtgagccatttcacccggcctctcttccgtctttgagctgtgaggaaatagctacattacatgagctgctagatctgccttatggtcagaaatgaaggttgaactctcaggaacagtgacatatatacacactgatatttccaaagtacaatgccccaaattgatccacaaaggaattaaggtcatttgcaacaaaatcacagaatagtaacaaataaatagaagataaatatggccaggaattgagatgagagaaagtataagtacaagaaactattccaggggaaaaaaagaatgaagtgtttcagtgttatccaatagaattttctgtgattatgaaaatgtgctatatttaattaatttatattccaatagccactctgtgtagcggctcccttataggtcattgcaggcctatatttttgtagttgagtcccaaatttgtttctagaaaggtaaacttggtcagttacatggttcttgtcttttgaaagtaaaacatacatggcaacttcattcattcattcattcattgatcccccaaatgttaatggccttgaaggaagcagagcctttcctgattctcagttatagggaaaattttctgtggacttcattatcagagcaccttgatatgttattgccctgtgaaagtctgttcagtttggggctaggagggatgcagtcagtgaaagtggcatagtttgtaatgttttttagagttttgaataattatgttaactaatctttatagaaaagtttaaagtgtacagagaagcaaaaagaaagtagtcactaaaagtttcaccacttagagacataattactggtaatattttgatgtatatatttccagacttgtgtcccatgtagctattatatttttctcaatagatcccaaagtatccaactccctccagggcaagagttgcttttacctttacccttagacctctgaggctggcagctggccccacctgagagggtcaccctctccctaatccttccccatacttctgtgagtcacctggctttggggcaataatagatacttgagagggcgtttgaggaggaacaaggaggaaggtcacagctgtagttcattctgcatgatgtgtaatccaggctttttcaactctggcactgttgacattttgggctggataattctttgtgtatgtgtagttggggtaggaaggtgtcctgtgcatcacaggatgttttgcagcatccctggcctttccctactagatgccaatggcacatacccttttccccccgagtacaacaatcagaaatgttggtgagaaatactgggttaatgaaaatcactaatttattgctgacaaagctctggagtttcagattccaatttgcatgtgggaaagagactgaaatcaaaagggaaacataatgtaagccaaggaagctgtttagtcctggctgtgctattaatttactgtgagattttgcatctctcccacgtgcaaattggaatgtgaaactctagagctttgtcagcaataatttagtgatttccatgaacccagtagttcctttttttttttttttttttttttaagatggagtcttgctctgtcacccaggctggagtgcagtgggacggtctcggctcattgcaacctccgcctcccaggttcgagcaattctcctgcctcagcctcccgagtagctgggactacaggtgcacgccaccatacccaggtaatttttgtatttttagtagacatggggtttcaccatgttggccaggatggtctcgatctcttgacctcatgatcagccccatgcccgcctcggcctcccaaagtgctgggattacaggcatgagccaccgtgcccggcccttaacccagtagttgttactgacatttctgattgtcgtgctggggggaaaacggtatgtgccactggcatctagtggggaaaggccagggatgctgcaaactgatatactgccaagtttatcagttgggaatcccaacagtgaaaagcataaaaatgaaaggaattttaaggagactttttatagaagagtgggcaggattggaggagccaacaagtgatggtgaggcacacagggaagagcttcagtgggcaccatcccctctctggtttgaaggggtagggaggggaccagagctgggaggagggggctggaatactgctggaggagccactcccttccagacctgctgtggccatcacagaatgcagccactgccagagcagcagcctgaggaaccaggcagggggagcacaagtaccctagcctctctctttctgtttcttgcctgccgatctcctccactggctaaacccagctggatgctaagagtacagtcagcctgcctgctgaggagggaccaccagggaccaccatcagcaagggatccaatgtctttctgcctctgcagaatgaaggttggggcacggggggcgctctacttcttagggatattgtgggaataaaaggaaataggcaaaaaatgtttttgaaaaacaaagcacatactgcgcacccgtgggccactactgcttttgacccctggctctgtttcatgaagtaatgtcgtgtcattctctttttaggtgctacaggatttctttaggtttgttttctgtccaccatatttcaactcatgtgtgctgtttgttgtgctaaaacaaatatttgctgatgcctgagtgaatagttgaatattttatataagtcaaatttatacgtaatgatttttcttgtaacttagccgtttctcttttacaaactcagaaaacctcagactttgaaaaggccttgaagttcctcacctgaaatctgagaacttggagcgccttaaaaaatctaaaggaaaacaaaacagtgaaagaacatgatatagtcagtgtagagaataaaattatttatgtaattaatattgaggatgcagataacacgttgtgaaatcttgcttgtaaaaaatctcgatctgctgaagaaagatgttctctctagagatctttgaaagcataattattgagcttttaaaatgttagaaacaaaagttagacccacacatattctggcgtgtggaagatttgcattccttcccctgcccgccccgcccccgcacttgtgagttgtgcctgtgtacgcagttcctgtagcactcggctgggcagaaatcatctttcagcactaagggaacatagttatgatctggaccttctgggagtggtcagtgcccaagaacaggtatgggactccagaaagttctgctctcaaccctattttgaaatagagttacacattgttctacaattatttgagttaataagcagctcttttcaaacgtgattatgcccttccaagtttaaatacactagactttagtgaaagtaattgacctcatctcatttctctcctgttatattaagatcactttcagtaaaaggtagaagcttttgaagtggtgaggaggaggtagaggagggacatagagcagataggggctggaaagtggggtggggaagagagtggcttctctttggcagagtaccaaggaaaagccctatctgtacagaacctttgtgcctgggaacttgatggctgcaacctgagcctcaacctagtttgcttgcggagccagaagagaagctaaaaaccttcagttaaccaagccagacaccaagaaagttaaaccgaaagagaaccccccaccccccgcaaaaaaaagaagtaaagtgggttaaagtgatatgttagcacagaaagagaacataagggtcatctaagttcatctgccccctcttctatttcaaggtgcagaaactaaggcacaagggaccccgtgtcctgctcttgatcacatagctagtgggtgccaagccaggtctagaactctgttctctggggtcacaggctggctcttcatccctctagagagatagctcatctgtgtgcacctgagcccgttgtgtttcggagtcaaagcaaataaaggctcaaactccaagactgttttgcagaccggctgcagtagatacggggggaggagaaacctgctttaaattgcttcaagcaagttgtttctgcaaaggtgttgacttttttctttcaactttctagtgagtcactgcagcctgagctgttatttgtcattatgcaataattcaggaactaactcaagattcttctttttaaattatttgtttatttagagacagagtcttgctctgttgcccaagctggagtgcagtggtgtgatctcggctcactgcaacctctgcctcctgggttcaagcaattctcatgtctcagcctcccgaatagctggtattacaggctcgtgccaccaccccctgctaatttttgtaattttagtagagacacggtttcaccatgttggccaggctcgtcttgaactcctggcctcaagtgatccgcccgcctcggcctcccaaagtgctaggattacagccgtgagcctccacacccggcctatttatttatttttaaattggctgctcttagaaaggcataccatgtttctggatgggaaggcttattaattcaccctaatttaatgtataaatttgatgcaatcatagtcacagtcccagtggaattttttaacttggtaagatgttctaaaattaatgagagaacttgaattaccaggtattgaaacactgtaaagccacaatcatgtaaacagtatgttataaccatgggaatagaggtctgtgatacagcagaaaaaagtgaaaaaaagaataactgtattcataaaaatttaaatgtggagtcactgggggaaaggattaaatattcgataatgtagaaacaactcaactatttggagaaatgtaaatttagagccttatctcatgccatataccaaaatactatttagatttgattaaaaaataaaaatgtaaataaagaaaagttaaggcaaggcgtggtagctcatgcctgtaatcccagcattttgggaggccgaggtgggtggatcacctgaggtgaggagttccagaccagcctggccaacatggcgaaaccccatttctactaaaaataattagcgtggtggtgtggtggtaggcgcctgtaatcccagctactcaggaggctgaggtgggagaatggcttgaacctgggaggcagaggttgcagtgagccgagatcccaccattgcactccagcctgagtgacaagagtgaaactctgtctcagggaaaaaaaaaaaaaaaaaagttaaaaatctaaaagaaaataaaaatgtatctatttaatataagtcttttgggaaaatatttctcagcataatactaaaagttagaaaatagaatgtttttgtgtttgaccatttaaatagtacacctttgaaatttaaataaaaaaaggaaaactaaacaaaccaaaacctttttgttacaggattaggtcttagatattttaagatatattaaaatacagaataaagttcctccttgattctgttcagagtttaactagtcctggccagacaatggggaggaaaggagagggagctgtgtgatgggcaggcagagagttggaaggtggagccagatctcgcttggcctgggattgctgcctctcctgacggtgcatcttatcgtaagggggagttgaaagcagaaggggaaacagcacagaaaggatctgtctggccgttacagttatgtgaccatggcaggtcctgccagtcactcacagctctgtgagcaactagctggggtaccccagctgaatgtgctttaaaaacagcaatgtggccaggtgcagtggctcatgcctgcagtctcagaactttgggaggccgaggcaggaggatcacttgaacccaggagttcgacgttgcagtgagctgtgatcatgcgtgccactgcattccagtctgtgttaaagaacaaaaccctgaccctgaaaaataaacaaataaacagcaatgccacttattctaggtggtacacccctgatgcccagtgtacgagttccatttaggcttctttctcgtgcatatgcatctctccacatcctttcgtttgtttgttttcttttgttttgctttccccagattatgtaggaaaacaataaagttcataagtaatgttctgtaggccacttttataggaaaactttcctctaagatctcattagaaaagaaaagcaagtagcctgccaccgagcacctgtgccagcacaactacactgtggagcacccagataaagtggcgctgaacgcactgcagcctcctaagttcggaaaagaaagctcattagcatctacactgaagacgctcctgttcttcacagctttaatgatcactgttcctatcgggttatttatatttcacaactaaatcttatatatctggaggcgcccttgggatatccaataaggacagctgtttttatgctgctattgttgccgtggtcaccggccatgtggtgctggccctctttatgtatgtggtctggaatgaaggctcatgacagtgacatgaaggcaaacaggattaaagtgaacatcaccttttgatagcattaaattcattttttaaaatgataaatgctggaggggggacatctgatttgaataaaattgaaagaacatgttaaagtcagtcttaaggagtcatgtttgagtagtgtaaattttgatcctcctaatatgttgtttgtatattcagttttaactatatgaatctcatttgcaaatgagaatttggaaaagttaaattagttacaaatagatatgttaattacaaaaaaaaaagaaagggagagcaagtagtagtgagatttctgcaaggtcaaaggactcagggcagtttcttctgaatgtagtttgggggctggagaaagaaataggaagcagtagaattgctaggtcagattggaattttaagagctattgctgcactaccctccacagagatgctacccacttgtagtcccccaataatatcagagtgtattcctgaccacactttaaccaacacactctggcaaacattttgatctgtcagtcagataggccttcttgctataatcagaatttacattctgtgatcatgactgagggtatcattctgcctgttataagagttacctgaatttccttttctgggaaccagagagcaatttagagctggagcagaccttggagatgaagtccaaccattcagcctacagcctatgacccgtttgaccgtcgttgttgcttgggtagttcaggactgacaggactggacaccaggtctcctgtttatccttgaagctctctgggtgaatgtaagacaggacctgtcaaggcctctggcacagcctgggtttgagtctagaaccagaaagtctggaaattgcagggcagtgccgcagtgccttggctgtgaagcagggtgctttaccctccctgaactccaggcacttcgtctgtaaaatggaattaatactagcttttttttttgccagggttctgaggattagggttaatgtgtatgaactagctgacccagagaggctcacatctgttctcatcctcctcacatttgggtgttctgttatctgttatctgttctgtcactgttctgttatctgactatcactcacgtgcaagctccaagggagacttgaatgaaagttcttaaaaacagaagtaaagcacagtagggtgttggggagggcatctctgtggggcctccaggtagccaggggagggcgagcagagtgtgcttgctggggaccctctgctcccgtgtcttcatgcaccctcctacttagagtgctggcgctcccaccccacccaccacctgcgggtcagctctcagtgtcttagttatccttctgagattttttttttttttaaatgagacagggtctctcatctgggtacaaaatagtttggggaaaaaagagataaggtctctgtcaccctgtgagtgacagaggtgacgacatgtgagatagtgactcatgtcactatcactctaggctggagtgcagtggcgtgatcatagctcactgcagcctcaaattcctgggctcaagtaatcctcctgccccagcctcccaagtagctaggactataggtgtatgccacaatgcctggctaattttttaattttttaagtaaagacagggtcttgccatgttgcccaagctggtctcggactcctgggctcaagcaatcctcccacctcagcctcccacagtgctgggattacaggtgtgagctaccgtgcccggcctttctgagatattttatgcataaaaagacatcacacctatactgcctccccaggatctgagaagaaagtccactttctttgtcacattctgctttttggagtttttcttctagtaggttccctttttcagatttttttcagatgtgaaaaggctccagactgcaaaaggaaaggcatcatgtgtgctggccaggttgggtcatgagacccactctcaaagcaggaaggagcaatgggaagagagaagggaggggagttgccgaaagcaggctattttctttttttttttttctttgagacagagtctcactctgtcgcccagtctgggagtgcagtggctcgatcttggctcactgcagcctcctcctcccaggttcaagcaattcttctgcctcagcctcccgagtaggtgggaattacaggcatgcgccaccacacccggctaatttttgtatttttagtagagacggggtttcgccatgttagccaggctggcctggaactcctgacctcaggtgatctgccttccttgtcctcccaaagtactgggattacaggcgtgagccactgcgcccagctccaaaagcaggctattttcaacacaaagcctacacgatcacccatgcccccttccccgggtagtcttaaggttgccaaggtcggttttgtttgttttggaatgggggtggttatttcactgtcattcatggttctcatccctgtgcttaaccaaagagaatgagatcaaatgctgtgctgggtccaagggcaggggttgccacagccttcccttttcagaggccttctgccctctgcaagctaggagtggtcatcgtcatcggcttcctggacagcctatgcaggtggaggggctggagaggcatctgtagtgcatttttcatcacctctggttatccatttgcctgacctttcctgcccagttttagttaaaatacagtggtgattctagtggctctaacaagtgagagaaaaaattaatctttacaggcctctgttctactgtcattccagtgtttgtccaggtgtggctcctgaccgtctgtgtgcctttacctggatgcttggtgaaaatgcagattcatggcctcccctccactcttggccttccaaatcagaatctgggagtgaaacccagaaatatgcattttcaacaagaatcctaggggtacattaaagttgaggacccctgttaagccgtgttgttgctttcttttccttcactctctggtctcccctcatctcctcttgtcacccctccttccttgctacccctgctcacctgtttgccccctccttcgtcttaatgctgagggtccggagcggcttcttggactattctttgaacatactaaattgcagtcctccagaaactcagctaggaagaaaaaaaagtacatatttcttattgccttgcttgtccccatttaaaaagccagataaaaaactgtcctcttcaagcaccagttttgggaagtgcatccttcccatggaggcatcccgattgcagctgctcttccaatgtaggagacggatctgggcttggaaatgcccttctctaaggaagcattgctggtgtgacatcccagggaagtcagctaccaccagccccaaagtagacactggcctgggtatcctagctggaaggcacaggtggtgaaggcatttgggaaacatgagaatgatgggacaggaagcagtgggggagcatggggtggcaaaggggaatgtttgcctggagtttgggcaggtgccaccagggacctgaacctctgcttttgtctttacagtgaccgaaggaagagaccaagatgaatgcagaggtgagttctttacaaagaccagtttaagggatgcttttcttattgtgtccctcatttctcctttgcagagtctccattccctttcagaaacatcagcacaaacttgagaacatttcccctctagcctactgaagtgcacgtggttctgggtgatgcaggaagaactaggcccctctgagttcttatctgtgtctgtctggcttcattcgaacttacccactgcagctaatcctgaaacaacactccctagctctggctagtagtggggcatggaggttgctgggcccagatccctgctttgtgttattctggaaacactttctctgcattgtctccttggtgctctcacttccagttctttgatgcatggagatgtctagctccttatccttttgttttttccttttgttttacccatcagccccttcctctgttcactcccttccaagtggagcctagaccttggggttcatcacttcagccactgctgtgctgacgcccactatgcttttcccacttgtcctgtccatccacatggcaaacacagaggccatccccacaagaggggggtcttgggtgagtggcacagccttgtgctgtttgcagctggcagatgtctcaacacccttatctggtgctcagcaccacccgccaggccccctgtcactctaggcagctccttgccagtgccctgaacccccagctccaggcttcatccctctccctaagctctgtcctcctcgaaggtccccctcactcttagcatcaggatcccttttcattttacagaggaaaatgtaaacattccatctgacatcatctccctcaattcctgcctctccatttgtcctgttcctcctgtcacagtgcaagggatgtttgtcagtgagaaagttccaggttgtgaacaccagaaagcctgacttaatgtggctttttcctggaagtccaggtgaagggcaggcttcagggctggtcgatcctgcggctcagtgactgcctcaaggatccaggagcttttcatctctctgctctccatccagctgttggttgcatcctagggcaggtgcccatgtggcagcaagatggctgcagtggcagttggggccacatatgttcgcattccctttcatcagcaggaagaagtggcttcctgcaactccttcaggggagtgggagcctttatttgaagccccatcaaatgtctccttcggtcttattggccagaatcaggtcctggaccatagtgtgtctgaggagcagggattttgtgattggcttcaactactcaggcccatcctggagcagcttcccccctgccccagggctgggtgtggaaagaagaaagggggatgtatccctgtctggtatgagacattcctggtccattttcatgctgctataaagaactgcccaagactgggtaatttaaaaaggaaagaggtttaattgactcacagttcagcatggctggggaggcctcaggaaacaacaattatggtggaaggcaaagggaaagcaaggcaccttcttcacaaggtggcaagaaggcaaagtgctgagcgaagggggaagacccccttataaaaccatcagatctcgtgagaactcactatcatgagaacggcatgggggaaaccacccccgtgattcagttacctccacctggctcctcccttgacacacagggattatggggattacaattcaagatgagatttgggtggggacacaaagtataaccatatcacctagtgacggtatacccttctcctctgaaactgcacactcctgcctgctcagaccttgcaccacctccttagttatctcctttgccatgtgcatcattaacctaattcccactacctctttctcatcgatatttcaaaatgctttcttcagaacaaaatgacacctcacatcttgtccagcaactgttatcctatctttctttttttaatttaattttattttattattattatactttaagttttagggtacatgtgcataatgtgcaggttagttacatatgtatacatgtgccatgttggtgtactgcactcattaacttgtcatttaacattaggtatatctcctaatgctatccctcccctctccccccaccccacaacagtccccggagttcgatgttccccttcctgtgtccatgtgttctcattgttcaattcccacctatcagtgagaacatgcggtgtttggttttttgtccttgcgatagcttgctgagaatgatgatttccagtttcatccatgtccctacaaaggacatgaactcatcattttttatggctgcatagtattccatggtgtatatgtgccacattttcttaatccagtctatcattgatggacatttgggttggttccaagtctttgcttttgtgaatagtgccgcaataaacatacgtgtgcatgtgtctttatagcagcatgatttatagtcctttgggtatatacccagtaatgggatggctgggtcaaatggtatttccagttctagatccctgaggaatcgccacactgacttccacaagggttgaactagtttacagtcacaccaacagtgtaaaagtgttcttgtttctccacatcctctccagcacctgttgtttcctgactttttaatgatcaccattctaactggtgtgagatggcatcttattgtggttttgatttgcatttctctgatggccagtgatgatgagcactttttcatgtgttttttggctacataaatgtcttcttttgagaagtgtctattcatatccttcgcccactttttgatggggttgtttgtttttttcttgtaaatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtccattttggcttttgttgccattgcttttggtgttttagacatgaagtccttgcccatgcctatgtcctgaatggtattgcctaggttttcttctagggttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcgggtttgtcaaagatcagatagttgtagatatgcggcattatttctgagggctctgttctgttccattgatctatatctctgttttggtaccagtaccatgctgttttggttaccgtagccttgtagtatagttagaagtcaggtagtgtgatgcctccggctttgttcttttggcttaggattgacttggcaatgcgggctcttttttggttccatatgaactttaaagtagttttttccaattctgtgaagaaagtcatttgtagcttgatggggatggcattgaatatataaattaccttgggcagtatggccattttcacgatattgattcttccaacccatgagcatggaatgttcttccatttgtttgtatcctcttttatttcattgagcagtggtttgtagttctctttgaagaggtccttcacgtcccttgtaagttggattcctacccattttattctctttgaagcaattgtgaatgggagttcactcatgatttgactctctgtttgtctgttattggtgtataacaatgcttgtgatttttgtacattgattttgtaccctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcgttatgatattggctgtgggtttgtcatagatagctcttattattttgagatatgtcccatcaatacctaatttattgagagtttttagcatgaagcattgttgaattttgtcaagggccttttctgcatctattgagataatcatgtggtttttgtctttggttctgtttatatgctggattaccgttattgatttgcatatgttgaaccagccttgcattccagggatgaagcccacttgatcatggtggataagctttttgatgtgctgctggatttggtttgccagtattttattgaggatttttgcatcaatgttcatcaaggatattggtctaaaattctcttttttggttgtgtctctgccaggctttggtatcaggatgacgctggcctcataaaatgagttagggaggattccctctttttctgttgattgtaatagtttcagaaggaatggtaccagctcctccttgtacctctggtagaatttggctgtgaatccatctcgtcctggactctttttggttgataagctattgattattgccacaatttcagagcctgttattggtctattcagagattcaacttcttcctggtttagtcttgggagggtgtatgtgttgaggaatttatccatttcttctagattttctagtttatttgcgtagaggtgtttgtagtattctctgatggtagtttgtatttctgtgggattggtagtgatatcccctttatcattttttattgcgtctatttgattcttctctcttttcttatttattagtcttgctagcggtctatcaattttgttgatcttttcaaaaaaccagctcctggattcattaatttttttgaagggttttttgtgtctctgtttccttcaattctgctctgattttagttatttcttgccttctgctagcttttgaatgtgtttgctcttgcttttctagttcttttaattgtgatgttagggtgtcaattttagatctttcctgctttctcttgtgggcatttagtgctataaatttccctctacacactgctttgaatgtgtcccagagattctggtatgttgtgtctttattctcattggtttcaaagaacatctttatttctgccttcatttcattatgtacccagtagtcattcaggagctggttgttcagtttccatgtagttgagcagttttgagtgagtttcttaatcctgagttctagtttgattgcactgtggtctgagagacagtttgttataatttctgttcttttacatcttctgaggagtgctttacttccaactgtgtggtcagttttggaataggtctggtgtggtgccgaaaaaaatgtatattctgttgatttggggtggagagttctgtagatgtctattaggtctgcttggtgcagagctgagttcaattcctgggtatccttgttaactttctgtctcgttgatttgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttatcattatgtaatggccttctttgtctcttttgatctttgttggtttaaattctgttttatcagagactaggattgcaacccctaccattttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgctcgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtggataacccgacctttctctctggctgcccttaacattttttccttcatttcaactttggtgaatctgacaattatatgtcttggagttgcttttctcgaggagtatctttgtggtgttctctgtatttcctgaatctgaatgttggcctgccttgctagattggggaagttctcctggataatatcctgcagagtgttttctaacttcgttccattctccccgtcactttcaggtacaccaatcagacgtagatttggtcttttcacatagtcccatatttcttggagactttgttcatttctttttattcttctttctctaaacttcccttctcgcttcatttcattcatttcatcttccgtcactgataccctttcttccagttgatcgcattggctcctgaggcttctgcattcttcacgtagttctcgagccttggctttcagctccatcagctcctttaagcatttctctgtattggttattctagttatacattcatctaattttttttcaaagtttttaacttctttgccattggtttgaatttcctcctgtagctcagagtagtttgatcatctgaagccttcttctctcaactcatcaaagccattctccgtccagctttgttccgttgctggtgaggaactgcattcctttggaggaggagaggcgctctgctttttagagtttccagtttttctgctctgttttttccccatctttgtggttttatctacctttggtctttgatgatggtgatgtacagatgggtttttggtgtggatgtcctttctgtttgttagttttccttctaacagacaggaccctcagttgcaggtctgttggagtttgctagaggtccactccagaccgtttgcctgggtatcagcagcggtggctgcagtacagcggtggctgtagaacagcggattttcgtgaaccgcaaatgctgctgcctgatcggtcctctggaagttttgtctcagaggagtacctggctgtgtgaggtgtcagtctgcccctacttgggggtgcctcccagttaggctgctcgggggtcagggacccacttgaggaggcagtctgcctgttctcagatctccagctgcgtgctgggagaaccactactctcttcaaagctgtcagacaggaacgtttaagtctgcagaggttactgctgtctttttgtttgtctgtgccctgcccccagaggtggagcctacagaggcaggcaggcctccttgagctgtggtgggccccacccagttcgagcttcccggctgctttgtttacctaagcaagcctgggcaatggcaggcgcccctcccccagccttgctgccaccttgcagtttgatctcagactgctgtgctagcaatcagcgagactccgtgggcataggacccgccgagccatgtgcagaatataatctcctgttgtgctgttttttaagcctgttggaaaagcgcagtattagggtgggagtgacccaattttccaggtgctgtctgtcacccctttctttgactaggaaagggaactccctgaccccttgcgcttcccgagtgaggcactgcctcgccctgcttcggcttgcacacggtgcactgcacccactgtctggcactccctagtgaggtgaacccggtacctcagatggaaatgcagaaatcacccgtcttctgcgttgctcacgctgggagctgtagaccggagctgttcctattcggccatcttggctccactatcctatctttctcatcccctgcaaggcaggcttctcaaaaaagatacctgcagttaatttctccgttttctcttccctgggtcattctcagcctgttgcagtctggtttcttttcccatattatataccgaaatgagtcttgtcagggtcaatgatgatctctgtaaattttataaaaatttattttgtaataatgtagacacatgttcatagtgtaaaactcaggctacagaatggaaaacagccaaaagtaagtctccctattacgttatcttgaccagccctgccccacttggggctgacttctggtaaccactttcttgtgcctctgacctccttatctgaaggcccctgtggctcaccctgtggcttgctctaattcttaggatcttttaagttctaaagaaacaatagaagctttgcattaatattaagcttatacaccctggtccaggagcagttccatcagtcatcagtgatctcttctgtcctttttgatggcttttcctcttaaccttgtaagaacatgctagacttgggtcctcctctgctgttccttacatatatatattttatattttttttctttttctttttttttgagatagagcctcattctgtcacccagctggagtacagtggcgtgatcttggctcactgcaacctctgcctcccgggttcatgcgattctcccacctcagcctaccaagtagctgggattacaggagcaccaccacacctgggtaatttttgtgtttttagtagagatggggtttcactatgttggccaggctgggcttgaacccctgacctcgagtgatcctcccacctcggcctcccaaagtgctgggtttacaggcatgagccaccatgcctgtcactcatctcagtcacagctgccacagggaccccaagcccgttataacccaggctgtactttctgctttcacctgccccaaatctgctcctcctcgaagggccatctgtgggccaggcgctccagtcccctcactctgttcccacaagccagcagccagtgaccaaggctgtaaatcctgtcattgccttgatgtagtcaccaatatttatgtgacaccatactgtaccagactctagacctggcttgatggctctaatggtaaaaatgtaagtgtggtactcatgctcatggaacttatcgctaagtgggaccaccatatctttccagtctgtcccttccttatcctacttcctgcctcctcatcacttcctcacttacctaattcttttcttcttctcctttgctttcctcaccctcctctaggccattccctctcccttttggaaggcagggggaagagacctcaggcacagggacggtccacacacccagttcctgacacattgcctctgttgtgctgtgcaaggccccgctctcagacttatttatattttattcattttctctccatccccattctcaccctgccaaagccaactattctaatgaattaagtggttttccttttttatttgtgtatgttcatgaaacattttgtttttgtgcaaataccttctaaatttatatacagtaggctgggcgccgtggcgcatgcctgtaatcccaaaactttgggaggccgaggtgggcggatcaactgaggtcaggagtttgataccagcctggccaacatggcgaaaccccatctctactaaaaatacaaaaattaggcgtagtggcacatgcctgtaatcccagctactcaggaggctgaggcaggagaatcacttgaacccaggaggcagaggttgcagtgagccaagattgtgccattgcactccagcctgggctacagagcaagactctgcctcaaaaaaaaaaaaaaaattatatgcagtaaaactgcctctttttttttggtgtagaggtttacccattaaaacacatatgtgtaaccatcaccccaggatgtcaggatgcagaacctcaccccaaaacattcttttctgttgcccctttatagtcacaacctccccttgctactgacccctggcaacatatatcacctcctgtgtgatatactttttttttcctgaaacagtctcacccttgtcacccaggctggagtgcagtggtgtgatctcagctcactgcaacctcggcctcccgtttcaagcaattcttcagctgcagcctcccatgtagcggggattataggagtgggccaccacacccagctaattttagtagagactgagttttgccatgttggccaggctggtcttgaactcctgacctcaagtgacccaaatgcctctcgacctcccaaagtgctgggattacaggcatgagccacagtgcccagcctgatatacttttaatgtacataattgtattttatatcatttatatctcattctccatttttctgtatgttaaagatatatagttaatctgctacacagcagcccagaatgtgcatccatttagtcctaacaaaaggcctaggagcaagatgctattattacccattttgtagatgaggaaaatgagcaataagtcaattgctgtaagtcacagggggttaaggagcatcacagagatctaagccctgatgtttttgacccatgaatgcctttgttcttgcctatatccagctaatcccatccatccagttcaaatgtcctttgtactgcacaaacagttttctcaagagtcctctctcgggaagtcatacctccctcttatgaatttccattgtgctttatgtatcttttctttcgttaccttcccctcctgctttgactgtagctgtcggggtgcctcgctcatcttagcatccccatggcatctgacttgatgcctcatgcatagcttatcttcactaattatcagttgactaaatgataggatgattcagagactgttaagtaatcttctaatgcaatccagagcttgggagggtcagtgaaagtgtagagaaaggaaatcatatgacagaaattttcaagcaaaactagttgtggcccagaggctggctggagggagaaagacagaagaaggaccatcggccacagtcgggctttgatcccaggatgtttgttgaatgcaggaatgactccaagcatttaaagctgggggctgccaggattcctagagctactggcttttgcccagaagttcagagtacaacctgtcaggaagggtggataattggagtttagcacacagcgtgaagatccagggcgcggtgggaaagccaggttgaaatgccttgggaatgcggcttggaagagaggatggcccacagctcaggatgctagggtctttggcatagaggtggtcatggaaaccctgagaatgagggacccccatattctggggacatgggagagagagaaaaatagagggatgaagactgagctttgggaaatatgcacatcttgggtaaaatgaagaaagaaagtgaaatgtgaaaagaaaacctcggtagcatgaggtaagagaagaaaggaaggagtgagtttgaagaaggtccaggtaagggtcactcatgtctgaagtccaggaggatgtggctgagaagaagcccttgaatgtgatgagaaggtcttggatgacccacggtgaagcagggaggtatgggagtgaaaaccaattgcagcagggccaggaggggtgagaggagtctggggcacttggggtcattggacagggcaggggcaggggcagcagaggactctgagcactgtagagggagctccaggaagggaagcgggagtgagccaaggcgctatacactgcagaattctcaccttcctagagcagccctctgatatttatgtctgttttcagtggtggtttatattttagatagtgaatacatttgtgtgattctaaactttaaagaggaaaaaaagaaaaaaaaatattttctatgagaagccttcttccctcctatccctgtttcccagccactctgtttttcttgctcccagcaagagcatgtcgccagtttcagtgttacaggtttctgggctgtcctttcaaagagattctaaacatagacagtatctttttcctttggctaccacccctcctgttactacacagactgtagcacacagtgcacactaggctgtcgtttgcttctttcacccgatcatctatcttggagaccagtccctttcaatatataaagggcttcctcgttcttttatttttatattgccatgtaatactctatatcacgagtctatcataactttcatagccagcctgttattaatgacatatagattatttccatcttttgcttgttataagcaaggctgcagtaagcctaagtcacttgacttgtgtagctctataggacacattatcttacagttggatttaccagaacaaagggcatttgcattttaatttgtaataaatatttccaagttgctctccataaagcaggttcttctctccctcctgcaacatatgaacatacctgtttccccaggccaaccaatgtgttatcaaacttttttttaattcttgcaaatagtggatgaaaacgactagtttgttctgtccaactgcctggactctccttccaccttttcagcacctgccctcatgcctcaccttgaagtttttctacagtgattttacattttcttctaccctctttatctcaaaaaaaattttttttctaagttggcagagcacattcctaactatgaactccatttttgcatctggagtgccaaacaccagcttctctgagtccaagggtgggggcgcaagctcactctgtgactgtgatttggacctaagtgagttttttagtcactttgctgtgcttatgtgtccttttctgctgtctcaaaactgctcctgttctttgttccttaaataccacctctatagggctatttgtagtggcattttcccaaaggttcaggatagcagagcacagcagacaactgaaaatggaactgtggatgtcctggtttctggaagtccattgctccctcctccactgggcgtttctcactggcttccttctctgcagattttagccttttgctaacctgcgtgcactttcccctttcctctgcctcctactggttcctagccccaaagttttagctgctactacagagtggtctagccatctctgatttgcagtttcccttcagaacgcaccttcaagatccctcatgtaaaatgaagaggctcacgttaaaaggcctaacaagtaatttttctcaaaaataaagttcttcccctaagagcagcttgactattaagataccagtgtcttcactcatatctttttttttttttttttttttttgagatggagtgttgctctgtcgcccaggctgaagtgcagtggtgcaatcttggctcaccgcaacccctgcctccccggttcaagcgattctcctgcctcaggctaccaagtagctggggttacaggcacccgccaccaccatacctggctaattttttgtatttttagtagaggcagggtttcactatgttggtcgggcaagtctggaaactcctgacctcaagtgatccgcccacctcagcctcccagagtgctgggtttacagacatgagctactgcactgggcctttcacccatatcttgtccctgtgtgtcagttttgcaaggcagtaatatcgaaaccaaatcctaaagcagtttataatttagcctgacacactgtgcaagccaggttttgtatgcaagtttgtgtgtatcattaactaatgaaatcttaaaaagcagtttggcttatttatagataatggagctgtttcttaaccttgtgccttttttttaagctggtagaagcatatcctggttattatctggaatgtagtaatacggtaaccttaagaatgccataaatatttaacctaataaggggattgctagtcttcttttcttgattgaaagggaaacaaatattaatatttgatcattaatatgtgttttggctgtacagatttctccagaggctgtcttactgctttttggtaattagaaattaccaaaaaaaaaaaaaaagaaaagaaaacaagactagtaacccaaaaaggacttacttggtgaaattgtcaattgtcagttgggcactgtggccactccttcctatactcttccctgacttccagaagagaagccaggaactaggtctcccagagtccccttttatatgtgaagtccactcccaggactcccaggaaacttgcaaggctgaagaaagagaggcagttagtcataggagacagttcagtcagatgtgtgagccaaggccagtgtatggtttagcagcagtggacagtcaggctctgtgaatcactcttcccaagctgcaggctgacagaggctgagatcctttccagacgtcttggcttctgggcaagttctggagaatctctcgcttcaatattgaattgtataacaacagtacaaggtctaggagaaaagaaatggaagtgtactgttgtcaggttctttatagtatatgtggaatagtgcataatattactttaaagtagactgtggtaagtaaaatatataatataaaatccttaacttctgaaaaagagttatagctaatagccaacaaatgggataaaatggaatcataataaatattctaattaatccaaaataaggcaggaaaagaggggaaaaagaacagattgaacaaatagcaggatttctatagaatttgaatggaaacccaaccatatcaataatcacaatgtaaattgtctaaacgtttcaactaaaaggcagagattgttagactgagtaaaaaaaagcaagacctaactatatgctgcctataagaaactaactatagctatgaaaacacatatagattaaatgtgaaaggttggggaaaaaatgtattatgcaacactgatcaacagaaattgggaatggattgttaatatcagacaaaataaattatagggcaaaaaatattaccaggaataaaaatggtcattttagaaagataaaggggtcaattaaaaaaaaggacataaccatcctaaacttgtatgtatctaataacagagttttgaaatatgtgggtcaaaactgatagaactgaaaggagaaatacacagttatatacaattatattcagagatttctctaccctcaataattgctagagcaaggagacagaaaatcaggaaggatacgaagacctgaacaacacaatcaaccaacttgatctaacagacttatagaacactccacccaacaatagcagaatacacattcttttcaagtgtgcccagaacattaaccaaggtagaccacatcccgtatcataaaatatctcaataaatctaaaaggattcaaatcatttaaagaatgttctctgaccacagtgggattaaatgagaaatcaataatagaaaaacatttggcaaatccccaaacatttggaagaaatcctggaaggagaagacaagagcagtgggcacaggaagaggggcagagtcagtgggaagtggtgacaactgggtacagaggtgaagaaaaggggcaaatctgagatgacattcatgtttctatgctcagaggcatccaagaagtgagtttaagggatgcatggagataatttttttttttttgagatagagtctcactctgtcacccaggctggagtgcagtggcgctatcttgggtcactgcaatctccgcctcccaggttcaagcaattctcctgcctcggcctcctaagtagctgggattacaggcgcctgccaacaggcccagctaatttttgtatttttagtagagacgaggtttctccatgttggccaggctggtctggaactcctgacctcaagtgatccacctgcctcggcctcccaaagtgctgggattacaggcgtgagccaccgtgcccagtgcatggagataaattttatcagtttttattatactgagttgctgtataacttaaaagtcagtttgatttttcactgtaatactgttcacatacagcctccagcagtgcacttaaataatatttaagatactgcagtatcttaaatgtggaactcagaaggctgtagtgaagagtcaaagcctctggatcccacgctgagtaaggtgaccaatcatggtttgcccatttgcctcctctgccagcatctgatgaagaagctgtgccctctgaatgactcccagtagtatcagattcatgtgtccactggaggagggacccagggagggcagaagtaccaggccatgggctgggtctgggttaatggggaaagctccctcattattggagatggggcagtagaagtggagagccaaattgggggaacactttctgtgggtactcggaaggttttcaacctaaagacatggtggagcaccttcaagaacaggttttggcgggactgacttctctccaagcccccatttcggggactgtctcatcccatcctgatgctgtggcttcctgtgtgttttgggctggcttccatcttgctcgtcgggaccctgccagctcctttgttttgtagttttctgctcgatgcctacagtgttttcagactccaccttggtcccttgtgtttcagcccgagaggaagtttggcgtggtggtggttggtgttggccgagccggctccgtgcggatgagggacttgcggaatccacacccttcctcagcgttcctgaacctgattggcttcgtgtcgaggtggctcacaatgtctttgtgcttcataattcatggaaagcccagtgaggcggattagctgcaggacatggagattttccagacccagggcagggagagccatctcccaactgagaactgtgcttagggtcagccccataagatctcaggttgggatgggtctgggaactgaagcttgctgggcctgcagctgggatgcacagtaggttggcctgggagactggaagacagaggcaggagggtgagctcaaggctgacagttagagaaggggcacagaaaacacatgcatggggctttggcctgaaaggctttcggtgtgcaccggggaatcctgacatagtcatcatgacagccatcctaggtggtcctgggctctacatgtgatatttccttctgcgtagtgttattaaccccccagtttacagataaggaggctgaaccacagaaaggttaagtaatctgcctgaggtcacacagctggaaagtctaagaactgaagttgagcagaagtctgtttccaaagcccatcttttaaacaccatgtgttcttttgccattggtaattttgagcctcacttttattattattattattttttttgagacagagtctcactctgtcacccaagctgcagcgcaatggtgcaatcacagcgcactgcagccttgaccgtctgggctcaagtgatcctcccgcctcacagctcaagtggtcctcctgcctcagccttctgagtagctgggactacagacacacacaccaccacgcctggataattttttttttttttttgtagagacagggtctccctatgttgcctagactggtctcaaactcctggggtcaagtgatcctcctgcctcggcctcccaaagtgctgagattataggcgtgagccagtgcacccagcctcccccttttctttaaggattcatttatctccagtcaaaatcaaacttatcaccttgtttcttcttcccccatgctcaaattttccactcacccctgtacacacacacacacacacgcaccactcaccagactaatcctgtataacatcatttgtcaatattaattgtgaactagatacaggcaccagactaatcctgtgtaacatcatttatccatattaattttggactaggtgcaggcactgggctgggcctgaagacatggtagtgagcaagttaggcaactctttttctagtgctttagagacatcagataaatatttacacaaagcataagtaacaattgtgatagtctatgtagaaattttttcatgttttcattcatggggccatcctcttccggcctgtctcaaaacatggccccacttttaaggatttaaaatgggcttggaagcaccagggagacccagaagtgctagaatctgcccttgggccagccttctcctccccataagattccaagggagctgcacacaaatgggagagcaaagttaagatcaggcagcaccgtaacccccatcgcacccctatctggagctgggaccacacacagcacttgggcgcaaggctgaaatgggacctttccttttcccttaagccccagtcctctgccagttggcttccagggtcagctcagtgggaacacctacactacccaggttgtatgggaggatggccaggtcacacccctgcatgacagccctgccagtactcacactgtttccctcttcacatacccttcccttcctgacctacctgctaagttctacctcctccccaggaagcttttctggtgtattcctttcccaccctgagtctccatctcctacttccaagcaccacatttctcctggtagtcttgtggtagtggtatgtacgtgtgtgtgtgtgtgtgtgtgtgtgtgtcttcctctagctgactgagctcattgaaaggcgatgattttaatttgttctccatgatttctcctacagcgcctagtacataataggcaaacaataagtattgctgaaattgagcaatttagtttgggtggccccattaaagaaacctagcataatactctttgggagctaaattttcctgaatgctttctgcctgctgcagctcagctggagctctgagcgggctgagggccttctgcttgctagctgtcccacattcccccatgactgccacccttagagggctactctcctgccccagccgctgcactgggaggtgtacggactgctggggctttggctcttcgaagactgcagctcccccatgctctagaagagtcagaaggccttgggttcccctcctgcttctgctcctggttagtcaaggctatcactgcctattatgtgctaggcattataggagaaatcatggagaacgaattcctcaccttccaatgagctcagtcggccagagggaggaagacacacacacacacacaaacacacacacagacacacacacacacaaacatgtgtgcgtacatactactgggcttcgttagcttagctataaagtagctcgaagtcgcatgccagtttgcaccctaaatgtgttaacgtattggatttggattaggtttggtagtcacaatgtttggccaagtgcttggaactggaagtgaccatagagatcacttctcatgagataaaagtagattgttccttttatttttatgttattttatttttgaggagtcttgctctgtcacccaggctggagtgctgtggtgcaatctcggctcactgcaacctccatctcccggattcaagtgattctcctgcctcagcctcccaggtagctgggattacaggcgcccaccaccacatttggctaacttttgtattttttgtagatacaggttttcaccatgttggccaggctggtcttgaactcctgacctcaagtgatccacccacctcggcctcccaaagtgctgggattataggcttgagccaccgcgcccagctgtttcttttgttttggagatgaagtaattcaagactctcccaggtcatacacgctgtgaatggtactgttggcactcaatgccagatcccctgacttgaactctgaggctatttttctcactccacaatggaaaatagcctggaagtgggagagaagaaactcatttcttcatttctggcagcagatcaccaggacctgtcgggaggaggggagaaggatggtgctcctttcttctgtctaccattgagttccatttctctgttactctgaaatagaagggagctcgggagcattgatggagtccagcagatttctttggaggatgctctttccagccaagaggtggaggtcgcctatatctgcagtgagagctccagccatgaggactacatcaggtgggttttccacacaggcagtccttgccttacacagcagtgcagtactgcaaaaatgagcaagcaagctaaaacaccctgcaaaggagtcagaagagccagtgagaaaattacaattgctctgtgaccaatcacagaagtgtcaaaacattaagaaattcttattgctggttataaatatataaggaagtgaaaaatagtaaaattaatatttagtatgtgtaatttgaaacattagaaacattcagaattaaagtgttttatttctctgtaaaaacccatcgagagtagttttcaacagtagtggcctccttcttctcaccagacagtttaggatgtggagccggcatccttggcaaattatcatactcccttctcagtttggatcagcttccaacgttttctcctttgtgctttcaatgtcataaaataacggttgagttcctttaaccctcaggacctggcagctaacagggaagtgccagctgccttcctcagtctagcttccttctaggttcttacagctgctcccaccatgctgtttcccacgggtaagatgcttcctctttatcagtctagctctagagtagacaaaaacacctctccttggctttccttaaccttttctggcaccagagtgtatttccttaagaaaagtgattctgacataagtcccatgcttataaatatttgtactctggtatccacagaatgaaatctgaactgctgagcacagaattgtaggtccttcacagtcaggcccccagctacttttccaacgttattatcctccacggcctgtagtccactcccctgccacactgaagtttgccgattgaacaaagccccacaaatgcccaagcccctgcatacgctgctcacagtgaaatatactcacatgttgcacctggaaaatgtctgctcatactttgagacccagttcataggtccttagtgaaatcttttcagactgcctcaggcaaagctagccgctgtgggttttgtagcctttatagctaccatgtggtgataggaaatttatttgttaatgtgtctttatttctcctccacagtaattggtaaatagtacttagttgaataaatgaatggttgaatgttcaaattaacacataaccagaaagttgatctgtcacaggatagtagaaaacaatgtgggatacagttcttcctccatatcccgtggcactgactcctacccccagtcatgacacattcacacacagaaactctcatgcctttataacattctgttctctattatgcagagcatttcagtgaagcttattcgaagtgttctttctctgtatttgtctcgtttaccaaaggcagttccttaatgctggcaagcacgtccttgtggaataccccatgacactgtcattggcggccgctcaggaactgtgggagctggctgagcagaaaggtaatgtatcttaccaagagtttctgcctccaggatttctgtgatatcatctttatgcctttaaaacttaaccccatttcagatatctcctcctcctggctacactggcactgtgggctcccaactgcctcctcacccccacactgtaaacacagatagtggagggcagaaggatgggtgggaatttgcaaacttttggtcaaagcttatcagcttattttactcactctaaggaaaaaatatgaattagttttcacctatgcttatgtcatgatattattttggctttattcatgtgatacttatattgctaaatgctgggatatcctaaaaatgctcaaatcagagaaactgattgtcttatttgcatagtttgtagtttttgttgtttctaaacaggaataaccatttattaaatatttagtatatgctaggaacttggaaactctgctaagcacttcatatgttattttgcttaattcttctagaatcccttggaggtatatattttctctagatgctgtatagaaaaatatggctcaaagaagttaatttgtgccaggtcacaaagctaataacatgactactaagtgggaggtagagattttaatcaaatcctacagggctcttaagttcacatttgttcccctaagccataccaccctccagaagggagaaattaagactttcccaggccagacgcagtggctcatgccctgtcagcccagcactttgggaggccaaggagcttgggacaaccctgggcaacataatgagaccctgtttctacaaaaatcttttacaacttttttttttttttttttggtggggtacagagtcttgctgtgtcacccaggctggagttcaatggcaccatctcagctcactgcaacctccgcctcctgggttcaagggattctccttcctcagcctcctgagtagctaggattacaggcgcccaccaccatgcccagctaatttttgtatttttagtagagatggggtttcacgatgttggacacaatggtctcaaactcctgacctcgcgatccacccacctcggcctcccaaagtgctgggattacaggcatgagtgaccgtgcccggcatacaaaatttttaattacaagaaaaaaaaaaaaagactcagctgggcacagtggctcacacctgtaatcccagcactttaggaggctctgatggatagattatttgagcccaggagtttgagaccagcctgggcaacatggtgaaaccccatctctactgaaaatacaaaaattaactgggtgtggtggtgcataccggtagtcccagctacttggaagttcacctgaaccttaggaggttgaggctgcactgaaccatgatcgggccactgcactctagtctgggcaacagagtgagaccctgtctcaaaaataaaaataaaaattctttaaaagacctacccagacaaacaaaaaccaagtgagttgatcactactagacctgccctacaggaaatgctaaaggaagtctttcaagttaaagtgaaaacactagacagcaacacaaaaatattgctctctggtaaaggtaaatatatagacaaatacagacttccgtagtattgtaatgttgacatataaatcactttaggccaggcacggtggctcaagcctgtaatcccaggacttggggaggccgaggcaagcagatcatttgaggtcaggagttcaagaccatcctggccaacatggtgaaaccccatctctactaaaaataaaaaaattagctgggcgtggtggcgcttgcctgtagtcccagctactcaggaggctgaggcagcagaattgcttgaacctgggaggcggaggttgcagtgagctgagatggtgccactgcactccagcctgggtaacaccatgaaactctatctctaaataaataaatatcactttaaatcctggcatagaatttaaaagacaaaaaaatacaaactatgttaatggatgtatagtataaaaagatgtaattggtaacattaatagcaaaatggggggtcagagatataaaggagtagaattttgtatgtgattgagttaagttgttagcagtttaaaatagattatgcagtcgggtgtggtggctcatgcctgtcatcccagcactttgggaagccgaggctggtggatcacctgaagtcaggatttcaagaggagcctgggcaacatggtgaaactccgtctctactaataatacaaaaattagctgggcctggtggcacgtgcctgtaatcccagctactccagaggctaaggcacgagaatcgcttgaacccaggaggtggaggttgcagtgagccaagattgtggcattgcactttagcctgggcgacacagtgagactccatctcagaaattaaatacatacataaataaataataaaaatagattgtgcctgtaatcccagcactttgggaggctgaggcgggcgaatcacctgaggtcaggatttcaagaccagcctagccaacatggtgaaaccccatctctactaaaaatacaaaaattagccaggtgtggtggcgcgcacatatagtcccagctactggggaggctgaggcaggagaattgcttaaacccaggaggcagaggttgcagtgagggagatcgcaccactgcactccagcctgggcgatggagtgagactctgctcaaacaaaacaaaacaatacaaaactgacaagatgtaatgaaagcagtactaagagagaagtggatagttgtaaatgcttacattaaacaagaagaaagatctcaattcaacatcctaactttacatttcaagggactaggaaaagaagagcaaactcaatcgaaaattagcagaaaaaagcaagtaaagattagaacataaataaaatagagagtagaaaagcaatagaaaaaaatcaacaaaaccaagtttttttgaaaaaaatccataaaattgacagaattttagcagattaagaaaaaaaagagtcggccgggtgcagtggctcacgcctgtaatcccagcattttgggaggccaaggaggacagatcacaaggtcaagagtccaagacctgcctggccaaaatagtgcaaccccatctctactaaaaatacaaaaattagccaggcatggtggcacatgcctatagtcccagctactcgggaggctgagacaggagaatcacttgaacccaggaggtggaggttgtgctgaggggaggttgtggtgagccgagattgcaccactgtactccatcctgggcaacagagcgagactctgtctcacaaaaaaaaaaaaaaaagaaaagaaaagaaaagaaaaaaagagtaaagactcaaactaaagtcagaagtgaaagaggagacattacaacaaatgctgctgaaataaaaaggattatatgagactacaatgaacacttatacaattgttatactccaacaatcggataatctagaaagggataaatacctagtagcatataacctactaagactgaatcatgaagaaacaaaaatctgaacagatttataactagtaaggagattgaaccagtaattaaacacctcccaataaagaaaagcctaaaaccagatggcttcactggagaattctaccaagtgtttcagtctcttcaaaaagtggtcccaggaaaacaggatatccacatgcaaaagaatgaagttggacacttaccttacaccatataaaaaattcactcaaatggattaaagaactaaatttaagacctaaaactgtaatattgttagaagaaaacatgggaaagcatcaagatattggatttggcaataatgtcttacatacgacatcaaaaacacaggcaaaaaaagcaaaaaacagacaaatggactaatcaaacttaaaaccttctgtgcctcaaaggaagcaatcaactgagtgaaaaagcagtctatgtaatgggtgaagatatctgcaaatcttatctttgataagagatcaatatccagaatgtctaaagaactctacaactcaacaacaaacaaaccaaataaactgattttaaaatgggcaaaggacttggatagacatttttctgaagaagttattcagacggcaaacaatcatatgaaaagatgctcaataccactaatccttatagaaaatgcaaatcaaatccacagccaccgtcagtaaccaccagcatcagtcagcagccatcaacatggaagcaagaccttccttcagcaaaaagatggaggatcagatggtagcattttttgtttgtttttgttttttggttttttaagacagtctcgccctgttacctaggcttgaacgcagtggcgcaaacctccgcctcctgggttcaagtgattcttgtgcctcagccacctgagtaactgggattataggtgcacaccaccacacacagctaatttttgtatttttagcagagatggggtttcgccatgttggccaggctggtcttgaactcctggcctcaagtgatccgcctgcctgagcctcccaaagtgctggaattacaggcatgggccaacatgcccagctcaataacgtatttttaaattaaggtacgtacgttgttttcctaaacatagtgttatcacatacttaacaaactacaatatagtataaacataacttgtgtatgaaccgggaaactaaaatattcatgtgactccctttattgcaatattcactttattgtggtggtctggaatgaaacctgcaggatctctgaggtatgcatgtaaccgcatacaaccatcaaaatctggaaattggcattggtacattacaacaatctaatcctcaaacctcattcaaatttcaccagttgtcccaataacattctttatggcaaaatgactgagttcaaaatcatgtattatcttttattgacatgtcacttttagtgtccttcattctggacagttcctccatcttttcttgacaattatgaatattacagttagttattgtgtaaaatgtccctaaatttgaatatatctgatgtttcttcatgattagatttggggtatgcatctttcacagaaatagtatgcaagtggccaggcatggtggctcacacctgtaatcctagcactttgggaggccaaggcaggcagattacttgaggtcaggagttcaaaaccagcctggcctacactgtgaaaccccgtctctactgaaaatatcaaaaaaattagccaggcatgatgtgggcacctgtaattccagctactcgggaggctgaggcaggagaatttcttgaacccgggaggcacagtttgcagtgagacgagatcgcaccactatactccagcctgggtgacagagggagactccccatctcacaaaaaaaaaaaaaaaaaaaaaaaaaaaaaggaaacgatgctgtttttcacattgtgttctgtcaggtaacatccaatatcagttcatctaattactaatgatatcacttcattaggtggtgtctgacgggcttttccactgaaagttactttttttccctttgtaatcagtgattattttgtgagaaggtagtttataactagttaaatatccattctcatcacactgtctgatattcatttattattttatatcagtagaaactcatagctttgttttgtttttctattcagtgctgttgttactttttattattcatattgatgtccacattgttccaaatttgctcagtggggaacctcttcctgccagctcccttgtcattttgttatgtttccattattctttgaattcttgctttctggcacaaagtggttaaggctcatcttgtactttctctgcctcagccttggaattagtcagttctccaatggctaataacgttttgatggcaagatttggacactgcttgtgcttatggctttgggctatctctgcaagccctttcagtgaacagacctgggaatatatggatacggatgtgtgtgtgtactgtggttaccatgtgtgtttatcacaatcaggcattgagtgaacgacaggaaaacaacaaaagacacagctggaaaatacatagtttctttaataaccatggatgtggaaacacagagactgttacatagtgctggggaaaatataacatgttccccagagtttcacggtggggtggggggcagtgggcgaaactacctgtgaggagaaaagcttgtacttattgcaaagcattttgtgccatttagttgttgcaaagccattttgtgccagaaagcttctacttatcacaagaagttccttttgccacattcacgtctgaaggagtgggtgggaaggaccccatcctcccacacacctgacatttctggagactcctgcgacagacatcctccttgctcctgaggtgcaggtcaagcccagagcatttggcagtatttgctgtgatgctgggttagacaaaggcaaccgtcccaggagcatctcccactgacccagatttctgtctgtttcagtgaaactgtagatcataaccacactttgtacttaatcacaaaatagttctggtgttttaggaagcttttggcctagaaatgaaaaaatttttatagagcgaaaaaattttatatagcaaaaaaattgttaacagctttcttttataatccaaaatttattttattttatttttatttttattttttgagatgggctgcagtgcactggtacgatcttggctaactgcaacctccacctcccaggttcaagtgatcttcccagctcagcctcccaagtagctgggaccacaggtgcatgccaccacacctagctaattttttgtattttttgtagaggccaggttttgccatgttgcccaggctggtctcaaactcctgagcttaggcaatccacttgccttggcctcccaaagtgctgggattataggcatgagccaccaagcctgggcacgttcttactctgttagatttttatgctgcactgcctcctcctgtctagaacagtagctaactgtctcctggcccacagacacatccctgatctcatcttgcctttggacacaggtagataccatcttgttctcttaaattttcatttcatttctcaggttttcgtttcattcatttctctttttttctttttctttttgaaacggagtctcactctgtcgcccaggctggagtgcagtgatgcaatcttggcccactgcaatttctgcctcccaggttctagtgattctcctgcctcagcctcccaagaaggtgggcttacaggtgcccaccaccacacctgggtaatttttgtatttttagtagaggtggggtttcaccatgttggccaggctggtctggaactcctgacctcaggtgatctgccagcctcggccttccaaagtgctgggattacaggcatgagccaccatgcctggccttcatttcattcatttctgttgtaagcttagaagtagcagcctcttcagctggggtgggtgacagtggtagggaggccatcctggccatgtgcccagggcagttatgagtgcttcatgtcttgtgttaggggatgacagagtaccctctgggatgcacacctagacacaactgacgactgccctttttattccatttttgtcgttacaggaaaagtcttgcacgaggagcatgttgaactcttgatggaggaattcgctttcctgaaaaaagaagtggtggggaaagacctgctgaaagggtcgctcctcttcacaggtcagtgctacgtgggatcacaggtcacatgtgaggtccaaagaccagccagattctttcctggctctctgggatgggagcttatattcatttctgctcaagactctctgactcagggccacttaattttcccagatgggatttaattccttggtggcccttgggtaaagagtatgttagaaatctcaagcatatttgtgctctgtcccaacctattaactagttggagattatttttcaacaggaagttgtacattaaaactcttttaaaaggatgagaggtgcttggagaggagaacatttttatacttccttgcaaagcaaatataatatgaagagctcccttcctcctctagcaagttacaaggacattggcagcaaccacagtatttatttatttatttataataaataataaatatttacttattctgttcttactctgttgcccaggtcttactctgttgcccaggctggagtgcagtggtgcaatcatagctcactgtagcctcaacctcccaggctcaagcagtcctcccacctcagccttccaagtagctggaaacacagatgtgcgccacaatacccagctaattttaaaatttgtgtaaacagtgtctccctatgttgcccagcctcatctcaaactcctgggctcaagtgatccacctgtcttggcctccaaagtgctgggattacaggcatgagccaccgtgcccagctgaccacagtatctgatctgtatttgtagctgtttacttgatgttggtcactctttgagcagctccgttagcaataggaaatgggcatgcaggaagctcctgctcttgtggccacttttggatgggctccttctctggccgtatcgttgggcacctgggccaccattcctgagggctttcattacagaaaggagaccctgacatggcctggcatttttgcacggtaaagccactgatacatagtagaacctcatttcaaaatctgtcttcatccttgaaaatggtaatataatgagagtacaaaccattaatttgtacaagaaactgtgttaagttaagtaagttaagtacaagtaactgtgatgtgcattaatccatatgacaatcctataaagtggtattcactacccccattatacagataaactgaagttcagaggcatgagtggcttcacagaggtaacgtagcggtcatgagacagagctggattggagctcagctctctaagtggctggaactgttgtgggtggctgcttagtattctgtccaaagaactaggctgggcatagtggctcacgcctgtaattccagcacttggggaagctgaggctggtggatcacctgaggtcaggagtttgagaccagtctggccaacatggtgaaacaccgtctctactaaaaaaaaaaaatacaaaaattagtcgggcatggtggcacgcacctgtaatttcagctacttgaaaggctgaggcaagaaaatcgctttaacccaggaggcagaggttgtagtgagccgagatcgcaccactgcacagcctaggtgacaacgagactctgtctcaaaaacaaacaaacaaacaaacaaaaaagaactagagcagacagtaaccagccctggggaagtctttttgttttgtaagtttgatacttaggccccagtgatttcaaaccatattgtctatgaaaattctaatttttgtttggttttatatataacttattactttttaagaatatactcattgttattagtcattgttttaagtgaatatcaaggtcataagaaatgttttgtttataatgtaatgtaacagatatgaagtcttttaaacttaggttatgtttaagattttggctggaggcagacgggagcagtatcttgaccaaatggatttctcacaccaatactcttttttatgtttatatatatatatttttttgatatagggtatcactctgtcacccaggctggaatgcagtggtacaattatggctcactgtaacctcgaactcctcaggcccagatgatcctcccaccttagcttcctgagtagctggggctgcaggtgtgcaccacgacacccgcctaattttgtgtgtttttttgtagagacagagtcttgctatgttgcctaggctggtcttgaactcctgggcgcaagcagtctgccagccttggcctcccgaagtgctggtattataggcatgagctactgtacgtggcctttttaggcttactgcaacctctgcctcccgggctaaagtgattctcctgcctcagcctcccaagtagctggggttacaggcacccgtcactatgcccgggtaatttttgtatttttttttactagagacggggttttgccatgttggccaggctagtctcgaactcaagtgatccacccaccttggcctcccaaagtgctgggactacaggcgtgagccaccacgcctggccccaatactcttttgagtgtacttttttgttcacaagattaggaagactaagaaaacatttaacattgtatcaattttcttgatattgaaatagctcaaaggtattaccattttctccatagctattataataccttcataccttattgccacttacacatcaggtagttataagaatacaggcttgcagggctaaaatactttgattcttctacttttaccagactactttaaatcactaaagaggatatatatatatgtatatgtaggtatgtgttgtgtgtgtgtgtgtgtgtatgtatatctacatatgtgtacatagatgtatatattagaagcctgaaacttttttattatcctgtttggctggattgactgctgtttccagtagaatgttttactaaaactcaatttaataaacaggaaaagacagagatgcttttatgatagagttgaagttcagccacctgagttttcatcagtatcattaatcacgttgcctgcctaccacataaggcaaggtcccattgtactgatcactcggccacatcttttcacacccccgccacccccacccccctgtcctgctttccacttggcattcctgcttcccagttcccacagcatttgtgatttcccacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtgtgtctggagacagagaagaaaaggtaagtcatgagaagccatgaggaggaggaaatttaaggacatcctagtacatttgcaggtatgatccaaagggagccccgaggggctagaccctcactcccagctccagaagggctgtctgcttctgcagatggagtgctgagattgcacttgtgttgcctcatctcatcctctcagcagccctgtgaggtaaagaagacaaacataatcccatctgccagtcagtagacagaggcttacagaatgccagcaggttgcctaagtcatgcaagtcattcatagcagattagtagtggaaattacattaccttggctgggcgtggtggctcaggcctataatcccagcacttggggaggccaagggtggtggatcacctgaggtcaggagtttgagaccagcctggctaacatggtgaaaccctgtctctactaaaaatgcaaaaattagccggtgtggcggtgcatgcctgcagtcccagctccttggcaggctgaggcaggagaattgcttgaacctgggaggcagaggttgcagtgagctgagatcaggccactgcatttcagcctgggcaacagagcgagactccttcttgaaaaaaaagaaaagaaaaagaaattatgttaactctgtgacctgatttttttcctgtgttttcttatgaaagttttcgggcatattgtgaagttgaaagaatttttaagtaaacacccatccacctactccctagaccctgccattaacactgtacatgttccccgcagggccacacattcacccctcagtgcagccagagtgtgagggtctgtgtttcagctttagcatcccatcaccctgtcacactgttcccaaaacattctgacttatttctcataccaggtcttttttaacaaaagcacattcataattttcctcccaaagcacctgggctctgtaaattatttagaacagtaagggttttagagtgtttctggatgcctttgcagagaggtgggtctcctggtagtaaaagaagcagacactgggtattttaaaaagaaaaaagaatttgagttcctgaatgaagcctgatctagtccattttgaggagtttcttcttcgctaggaaaaggcagagaggcctggcagatgaaagcaaagcacatggaacttggcagtgctccctatggagtgaccaacagtggtggcccgggctctggtgtggccatgtgagtgttaggattgcagccgtggtcagacctatacacagacagttgtagcaccctgtaattagaggtaaagatactgtagggtgctgtaggagcacagggaaggggaacctggactaggtcagctcatggttctgatgggaggcggtgccttgtttggtcttgaagttgagtagaagtcaatgaggaagcaagatgttggggaggcagaggctgactctctctctcttttttttttttttttatgagacaaagtcttgctctgtcacccaggctggagtgcggtggtgtgatctcagctcactgcaacctccatctcccgggttcaagtgattgtcctgcctcagcctcccgagtagctgggattataggcgcctgccaccacgcccggctcatttttgtattgttagtagagacaaggtttcaccatgttggtcaggatggtcttgaactcctgacctcaagtgatctgctcaccttggcctctcaaaatgctgagattacacgcatgagccactgcacccagccctggctctcatttttgcacaggagaggcaagcatcagatgagggattgggacagagagcagttaatataatataatagtaacttcttaaaatcatagtactttccgtgtcccaaattgcatttttaaatttttttatctatttatttatttattttgagaccgggttatgagactggctgattttcgtatttttgggtaagatgggtttttgctatactgtctaggccggtctcaaattcctgggctcaagcgatccacccacatcagcctccacgcctggccacaaactgcatttttatctcacaatgtcacagcaagataggtaaagctgtatacttattaccattacttatttttactagtgaggaaattgaggtacaagaaagatcttgacattctgcattccctcaaatcccaagattccatattatttaaaaggacatgagaggccgggcacaatggctcacgcctgtaatcccagcactttgggaggctaaggcagttggatcacctgaagttgagagttcaagaccagcttggccaacatggtgaaaccttgtctctactaaaaatacaaaaattagccaggcgtggtggcaggtgcctgtaatcccaggtactggggagcctgaggcaggagaatcgtttgaacctggaggcagaggttgcagtgagccgagattgcaccactgcactccagcctgggcaacaagagcaaacatctcaaaaaaaagacatgagaaattttcttaggcagactacgtagaatacctcaagtttatttttattcagtgccaaaataaaagttaatctttgttgccatctcccagaacatttgctagactgtactatgagcttttaaaactagtcatgggaggccaggtgcagtggctcacgcctgtaatcccagcagtttgggaggccaaggcaggtgggtctcttgaggtcaggaattcaagactagcctggctgacatggcaaaaccccatttctactaaaaatatttttttaaaaagtagccaggcatggtggcaggcgcctgtaatcccagctacttgggaggctgaggcaggaaaattgcttgaacccagaaggcagaggttgcagtgggtcgagattgcaccactgcactccagcctgggtgacagagcaaggctccatcccagaaaaaaaaaagtcactgaatgaattcccctgcctgatggcaaaattaaattaaagactgtttggctgtgaggttgacacagtcacccacagcctctgggaggctggtggctgcaaggaggatgggtgcctgacaaggacatgttaccaggcggtctggtgccagcaagcacccacttgtgctcttgtgtaatctctaacatgattcttttgtcttttgtctttgcagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttccaagatggcaccagcatttggttcttctcaagagttgaccattatctctattcttaaaattaaacatgttggggaaacaagaa

SEQ ID NO: 625 - DNA, 48671 bp, Homo sapiens; identical to SEQ ID NO: 624

SEQ ID NO: 626 - DNA, 43567 bp, Homo sapiens
tttgttacagaggatctttatttataatgcaaaaaagaaattataaatcccattttggactgtttccgtatctgtaaaacaacttataaaaaacagccactccacctgcaagaagttcttgttggtgcttatggcaggggcatgtgtttgcacagccctgggggctgggagggtgtgtttgtccagaagagagcctctccctgggaccccaacagccaggaccatggcgctccctttcaccaggccggagtcagcaagaacctggaggtgtcagaggtccggtccactcagcggggcctgggaaacactgttctggaagtggacaggctggattcctcgctggtcctgccacgtctctctgagcggaggcccgggttcgctcagttcccatccagggtattcagcacacctgctccaggcagccacgcccccggacacctgaagccgggccgctggagcaggagccagccagccaaacccaggacacctcctcaggcttctgggtcgatttctccatcatctgggcacgaccctgtctcatccagccagactaggagaaagaggggatggacacctggatgcaccctgcccccaccacaccaagccccgtttccctgggaactgcagggctggggcctctgggattccttgctttctggtgctgccagaggctgagatgggacccagcccagtgatgctggatccttctgggtgaatcggaccccggaactgcttcagtttaagaggaacccctcccagcgttcaggaacctccctggggctcggactttgtagagtaaccctgtgtctcccctatgcccccactggtcctgggagcagggaaggtggtatgatcccattttataggtgaggacacaggctcagagagggaagagactttgacagccgagctaaggacctgcgcctctgtccgcccacactgggctctctgattagacagtactggggtgcaggaggcgcactgcagcaggagcccagctcttctcccaccttgctgtgtgtccctgggcgaggcactgtccctctctggacctgtttgtttccccatttctaaactagagataagggttggaatgagaattaaatgagatttgtgaaaagcatttagcctggtgccaggcacttggaaaggtcacagaggaatgcgccccattgcacccaccatggctccacccagcacctgcactggcccaacccagaggggcctgacagctttctcccagtcactcgctctgctgggcaagtggagacccaagctcaggacatctggaagggtctatggattccccctcccagacagccttccatgcacactacaccagcctcatgggtgccttgtcccctgcatgggcccagcgagacccatgtcatgatggctgtcagctaactgatgccacttgcggggaggacatccggcctgggggccacggggtgaagtgcagatcacacagcctggggctgcatgcctgcggcacccgtgactagcacatggcaagtgtctcagcctctctcaaccttagtttacccctgtctaaaatgggggtgtggtggctcatgcctgtaatcccagcactttgggaggcccaggtgggcagatcacctgaggtcaggagtttgagaccagcctggccaacacaacgaaaccccatttctactaaaatacaaaaattagctgggcgtggtggcaggtgcctgtaatcccagctactcaggaggctgaggcagaacaatcacttgaatgaaggaggtggaggttgcagtgagctgagagtgcaccacagcactccagcctgggtgacaaagcaacactccatctcaaaaaaataaataaatacaaataataaaatggggatgaaatctgtacttaactctgaactctgagaattcctgtaagaactaaataagaaaatccatttgttacgctcagtacagtgctacctatcatgaccatccccaatgttattattattattattattattattattattattcatagcagcagcctcagcacccggcataggcccagctcagtaaatctctgctcaatgaatacatgaacaatttgtcccaccagctccagaggtatcacagagaggcaggtagggctgccgatttgggcctctgtctcccacctcctcaccctctccctgggaagaactctatttcctcgccgctcccagcagtgagctgcatctggaaggcccagggtccggccccagcctgggcacgagctgtgtttccaagtctgtcctgtccggccaaactgcagcggccaacaagatggagcagcggtcctcccgctggcaggggaaggagcatccatcaattaccttggctggccggagccgcggcgtggcgggccagcccggccccatccatcaagcgtcctggctgctggcaggggctgtctactaattacttaacacgccgcgtcgtgctgaggctggcgccgtggcagggggctcacggtgcagtgtacacaggtctgaccataaatgtttaacgaacccagtgggaggtggggacgcaagctaggccccgtggccaggaaggacgcccctgagagctgtctccaccgggcccccacagccgacccggcttggcggtggaggggacggcctcacctgtgctccccaagtccctcggcagcatcatgcccgtgggggtggggggcgtgatgatgatgtcgggcacgtccaggtgcttgtcgttcaggacgggggcctcgtcgtggctgctgctgctgctgctgacacacatttgaaagcctgagaagccaggcgtggagcacacacgcacgtacacacgacagagagacaggcatcagtggccgccgggaaccgcgggcgccaccctcccttcactatcacctgggtcctgacgcctcgcagcaaggagcgcagctgtccccgcatcacagatgaaaaccggcgtctcaggaatgaaaaaggagcccttgtcacatctcacagaaccatgagtcgggaaacagattttgggaaatgctgatcataggctagttggcctctgggtccagttgtcagcctttaccatgtggcccagccagctgcagcctcattcccggccaccagcccccactctccacagcgctccagcctccactctccaaagtgctcacacttccccagactccctaggctcctggggccccttcgtgcctttgcatatgctgctccccccgcctgggatgctctttcttcctctgcctgagtaacaagctcctgcttatccttcaaagcccagtgcaacgggctcttccttgggaaaggtgtcccagcagatctggctgctccctcttttgcccatctgcactcactcattcatcaatgaatgacatgatttatttttacttctgcctctctttgctgtgaacacctggaggacagtctctatttcattcatctgtgtttcccttgagcctagcgcatgctcgagacagagtaagtaggagtgctttaaatttcaaatgccagccgggcgcggtggctcatgcctgtaatgccagcactttcggaggccaaggcgggcagatcacttgaggtcaggagttcaagaccagcctggccaacatggtgaaacccccatctctactaaaatacgaaaattagcccggtgtggtggcacacacctgtaatcccagctactcaggagctgaagcaggaggagaatcacttaaacccgggaggcagaggttgaagtaggctgagatcacaccattgcacttcagcctaaatgacagagtaagactccatcttaaaaaaaaaaaaaaaaaggctgggcgtggtggctcatacctgtaatcccagcactttggaaggctgaagtgggcagatcacctaaggtcaggagttggagaccagcctgaccaacacggagaaaccccgtctccactgaaaatacaaaaaaaaaaaaattagctgggcatggtggtatgcgcctgtaatcccagctactcgggaggctgaggcaggagaattgcttgaatccgggaggcggaggttgcagtgagccaagattgtgccattgcactccagcctgggcaacaagagtgaaactctgtctcaaaaaaaaaaaaaaaaaaaaaaattaaacgcaaccaaaaacccttcaggcagcattaagctaggtgttacaatccttgtctctatgtcccatcactttggttttgccccaaacggtgccaggctgggattaaattagctcaagtatcagagcccctgaccaacaggagaagctgagtaataaggggttgggggaatatttttcctactgttctcaggcctcccttgaccaccattaggacaatgttcctaagtgaccactgtagggtcagtgtgggggttctgaaatatggctctgagaggcagagtctaagcccttgagtgtggatggacttagtgacttgcttccaacaaataggactgccatgatggtgtgtgacttccacggtgaggtcataaaagacattgcaacttcctccttgctctctcttggaacacttgctcttggggaagccagccaccatgttacgaggatgctcaagcagcctgtggagcagctcacgtgggtgaggaatcaaggcctctagccaacagccacaagggagcctcctcagcagtggagcctccagccccagtccagccatcagatgagactgcagccccggctgacatcttggatgtaacatcatgatcgaccctgagccagaaccacccagataagccactcctcaattcctgacccacagaaactctgagataataaaggtttgatgtttaagccacaaagttttggcatagtttgttatgcagtgatagattactgacagtcagcaaatctttccctgacccagtaggaagggatggcaggtgcacagtgggaatctcatacccggctgtggggaaatcacaggaggcttctcagggtaacctttgttcacccaaggggtgttcctctgagaggcaggttacacctgggctgtcagggatgatctgtttgaatccacaaaagcatgtacacctagaggacctggagccatgccattcaggccaaattcttggttcacctgcagcttgaccaaggctgcaggctcagaaaaactgaaagcagtaggcacactggctttggaatcaggccaccagctgtgtgaccctgcgtgcactgcacctcctctctgggccctttgtgcagtaaataatttaatcttgcctaaaaagaggtctggtctctgtccgcggtttctgagaggtgctctctaagcccttggaatatcttgcctgataggagagtctttgtttgccgggggctgtggttacactgggtgtccaaaggcgtgattgatggaggggggctccgggtcatgcccggagagacagcagcctgcagcctgagctccaaagtgagcaatcaatcagcctccagaggagccccagtgccttcgtctcctggggttgccacaacaaagcaccgtcaaccaggcggctggaacaatggacattcattgtcttatagatctggaggccagaagttccagatccaggtgttggcaaggctggttcctctggaggctgcaagggagactgttccaagcccctcccctggcttctggtggttgctgacaatctggcgttcctaggctcgtagaagcctcaccccatctctacctcttgccttcacattgtattctccctgcgtcttgtctctgtccagactcccccctgctttttttttgagacggatctcactctgtcacccaggctgcagtgcagtggcacaatctcagctcactgcaacctctgcctctcgggttcaaacaaaatctcctgtctcagcctcccaagtagttgggattacaggcatgcgccaccatgcccagctaatttttgtatttttagtagagacagggtctcaccatgttggccaggctggtctcaaactcctgacctcaggtgatctgcccaccttggcctcccaaagtgctgggatcagaggcatgagccacagcgcccagcccagatttccccttttgataaggacacccgtcatattggactaggagctcacactactaaaatgacctcatcttaactcattacacctgcaaagacactactcccaagaaggtcacattctgaggccctgggggcgaggaggttgacttatgaatttttggaagacacggttcaatccttaaagcccctggacactgaagccaaggggcttccctcctgatgatgctctgtgctgtcacgcaccatcgtcaggaggagttggtgctgtccatggctccacgaggagaggacagtgggagactgtgcctgggaccctcgtgggatctgccctgtgagcgtcttccctttggtcttaacctgggtcccttccctggaatgagccataaccgggaatcagagcctccagtgacttctgtgagtcctttcagcaaatgaacaaacatgagggtggtttggggaagccccaaacctgcagctggtggtggaagggtgggtggtcatgtgtgcccccgccccacttctgttagtctaactctttgcagccttcttgttttcacagacaagcgcaaggtggtagtgggggaatcagccgactccctgggctggggagagacggccacggtccctgggacacacggctggtgtgaggtgaccatgatgagccccctttgtcctgtgcacagccactcacttccctcccctcattctcaaacccagtgacgagcatccgcccctcaccccaggcactgccccagtcacctccccaccttctgaaccccaacactgtttcctcctttggaagacctattatttatttatttatttatttattatttatttatttatttatttatttatttatttttgagacggagtcttgctctgtcgcccaggctggaatgcagtagcgtgatctcgactcactgcaacctctgcctcctgggttcaagcgattcttctgcctcagcctccctagtagctgggattacaggcgcctgccaccacacccagctaatttttatatttttcgtagagacggcgtttcaccatattggccaggctggtctcgaactcctgaccttgtgatccacccgccttggcctcccaaagtcctgggattacaggcatgagccaccgtgcccggccttggaagactcttggcccccgactgctgggtagttttgagggaagaggccacctcagcccaacagaactccgagcccctcagcggcacccacacagtcccatcgaagcaggtctaatacagtggggtttgaaccttctttaaagaagagaacatttcagccgggtgcggtggctcacgcctgtaatcccagcactttgggaggccgaggcgggcggatcatgaggtcaggagatcgagaccatcctggctaacacaatgaaaccccgtctctactaaaaatacaaaaaaattaggcaggcacggtggcgggcgcctgtagtcccagctactcgggaggctgaggcaggagaatggcgtgaacccgggaggcggagcttgcagtgagccgagatcacgccactgcactccagcccgggtgacagagccagactccgtctcaaaaaaaaaaaaaaaagaagagaacatttctcctgcaatcttgcacagaagcccagagtgtgaaacaaatcaaaggaagtcacttggagagaggcgcccctaccccaaacaaccacagacaaagggatgtgttgccaccgcccagacaatctactggggccgaggcgtgcgctccttcaggctccatggccaccgtgctcggtgtcaccagccccatcttacaaatgtggaaactggggacctaagagagtaatatccacccacaactgaacagctagtgggaggcagggccaggatccatccccagactggaatctggctgaccccaagagccggtgcttcctgtagcataatcccatgtaacagctggcaaactttctgcaaggggccaggcaggaaatatttgatctctgtgggccacacaaactacacacacagctttgccacggcagcctgaaagcagccgtagacaacgtggaaatgaacgagcatgactctgtctcaataaaactttctttctaaaagcaggcatcaggcaggattgggtctcagggctgtggttgccaatccctgctctataacatccaggactggctgcggaggggagctgagatctaggacacactggcaatagcagaacctcgaaagcctgaggcttgttcgtgccaaaaacaaaagccacagccagaaccccagctgcaggtgggcagggcagctccctcttgaagggctgcgtgtgaggacatgaatgaattcacgaaagcacttcgcccagccagctgccccataagtgttctctattatcatccacaaagagctccttgcggaggcccccgacaaaaggaatcgctgatgatcggaggcccccgacaaaaggaatcgctgatgatcgtgtctgtaacaggagggagcttccctgctcagtctccaaaccccttcctcggtgaatactccaagattctaaaataaaacaccccacgtttgcattttaacgtggtctggagcttgaggacaaaacctacacatataacctggaaggatcaggttctcagtgagccctggagaggcagaagtctcggaggagagggggttggagggagaggaggaaaggaggagagaacggagggaaggaggagagggaaggagggagaagagggagggaggagtaagttgggggagaagagggagggaggaggaagaggaggaagggagggaaggaggagagaggagaggagggagaagaggaagggaggagggagaagagggagagaggaggaagaggaggaagggaaggaagagaggagggagaggaagggaggaggagagaggggacgaaggagaggaggaagggagggaggagacaggggagaaggaagaggagggagggaaggaggacagagggagggaaggggagagggaaggagggagaaaaggagggaggaggaaagacagggcaggaagaggaagagaggaggaggagggagcagacaaggcagagggagaaggaggaggaagggaaggaggaggaaggcgagagggaggaggaagggagggagaggggagggcaggcagggaggagagagacaccccagcccctctcacatccccagggcctgccaagcctcagcagcagaggtggccaaacaggagggaaagctctcaggaggatgaagccaatgctggggattaaaaaccaaatgccagccctgccccagacaaggagctcatttgtgctaaggccagaattgttatttgttaattatgtgcctgcctcgggctattaaaagcctatttcctgagcctgggattccagaaggaagggagcagatcccagggacccaggcccgtcccaaggcttcagaaggatggagcctgtgcaggaagacctccccacttccggggaggcttcgtgctccgggtcaccaggccctgacccccgctctgcggccatgcactgtcctcgcagtgggggcagagccacgcagaccagaccacagaacccaggcccctggagctggatttccacatgggttacataggcgggtgctggcatggcgaggttggacaggctttgagacccggctctgggccctcctagctccaggacagcggttcccatcgcggctgcccattgagatcacctgggaagttaacatcacctatccagggcctcagcccaggctgattcaaggctctgtgagaagtgccaggattttgaaaaactcccaggtgactttaacagccagggatgggaacccctgagctagggccactgtgggaacaggtggctttactcttgcagcctcagtttccctggctgtaaaactgttatgacaccagccttgcaggaagtgccaggtgtggggtgtggggctgccaagtgtggggagaaatgaccctcggggagccagctggccggggcctagggggtcctgagctgggggtgccgtgccgcctctccgctgagaccactacttccaaagcatccggagccaggctctgggctgagcctgccatttgcactcctgcattcaaccctcacaccatccctcagggagaacactaggatcacgcccatgctacaaaggagaacactgagctttggagaagggaggtaacgtgctggtaatacacagagcctggggagcagggctggggcttgacgtggctccaggccccactgccctcaccattgctgggatccgcagccctgatccttcaaaagccctgagccaggcaagcccgtgcccgagacgctacatccaggctctgtggaggatgcccaggtccctggggtcagggcaccattccctgtgccagctcttggtgaactcccggccgcccagaggtcaccgcagacacccgctggagacaggagcaagcgtgggcatcacggctcacgtgcgccctctactagttctttttcatttcatttaaattaatgaattgattttttgagacagggtctctctctgtggctcaggttcactgcagcctggacttccctggctcaagcgattctcccatcttggcctcccaaagtgctgggtgaaactacaggcactctccaccacacctggctaagttttaaacttttttgtagagacagggcctcattatattggtcttgaactcctaggctcaaacgatcctcctgccttggcctcccaaagtcctggggttacaggtataagccaccccatacggcctgattcttttaaaaacagcgtttgggcttgcaccccagacgtttcacttggaggccctgaatgggaccacgccctcttccccaaggcaccatcacacacacacagggctccagcctgtcggacccacgatgcgatggacggccagacggcccacctgggctacggtccacctgggcagtggctccccctctttgggcctctgcttcctcacctgcagaactggggtaaataacagtgcccaggtccgggtgggcaggcatgagaggttaaggaccacacttgagtcctcactccagccaatgcggtgcgatgattctatatgcgttttgtggatgagaaaactccagtgctggcctcgctgtgcacacgtaataaacacaagctgtcattcagatcacgagttgatgctaagcttagatccacatcacgtgatttgaactgcaggtgtaagtgtcctcagggcacttattcattgattccttcaacattcagcacctactgggtgccaacggctactgttccagccccgagtgtgggtcgggggacttgtcgcccccttgcggtcacgcagctggagtgggtgctacacaaaatattcctggttccagcctgactcttggggcacaattttcccttattctatgggaatggccaggggcttgggaaggaggacatcctccatctgaatctcacttctgcttcctgctgtgacactgcctctcggcctgggctttctcacctgcagagccagcttatgtcaccctcctttgcagcacaggtgtaacaccccagctctgagcctgggccagggaggtggccagtcaacaggcatttattgtgcacctgctgtgtgccctgcatggccccaggtgctgcagacactgctgcggaaagaacggcctctacagaggtttatctgtgcctttcccctacacctcctgtccaggctccagtagcaggaatcaggtccccaagatttcagggtcaactggagaaaaagcaggagggtccccagtgattcaagctatcactgggaggggcccacgatgctgagctttgagaacagtgcttgtgggaggctggactgtgtgagtgcctctgggcactgatcgtttgatcctcccagtgaggcagcccccatcttccagacgggcacactgaggcacagagaagtcagggcacagcctgtttgcgcacagcctgtgatctgggggctggaagcacaaagatatttccaagatcctgggtcagttcaagcagggactaggggcagatgataagcccactcacagtaccaagaagcagggtttaggggagactgggaattggaaaaggcttttcagaaggggtcaatcagaaagcggcaggagagattcccgaggcacccacagcacacacaaaggccctgaggcaggaacagaggggccacaggccacagcacacacaaaggccctgaggcaggaacataggggccacaggccacagcacacacaaaggccctgaggcaggaacagaggggccacaggccacagcacacgcaaaggccctgaggcaggaacagaggggccacaggggctgagcggggtgacactaatccctcagagatgaccgggtgtctggatttagtgcaggtctttcaaaagcaaactgataaattcctccaagggttccagatgcgtttaatctttttttttttttttaattccaattacagggaaagctttgtgttattatggatgaggctggggtagctcttggcggttttaccttttcgaggcatcccaggcccgatagagacagcagtggatgttttaaatctctttttaattaaggaaaaagccctagcttgcgtcagggatgagctgctggagagagacaacctgagaggagctagagacaggagcttcgacacaccaaggtgggggaaggtgcccagccgcctggctctgcccagccaaaccacattcctgccctgggcactgactgcacttcctccctcctgggcagccctcccagttcccgtggtctgttcctgctcatcctagcactgggcgctctgggaaggctgtggagggtgtaggtacagtgtggtgagcccagattccaaaggccaggtccagggtcgggcacagtgactcatgcctgtaattccagcactttggaaggacaaggacaaaggattgcttgagcccagcaattctgttcaagacaggcctggacaacatagcaagaccccatctctaaaaaaatttttttttaaattagccagatgtggtgatgtgcacctgtagtcccagctacctgggaggctgagaagggaggattgcttgagcccaggagtttaaggttacagtgagctgcaatcacaccacggcaccccagcctgggcaagagagatcctgcctcaaaaaaaaaaaaaaaaaaaagcggttgggggtggcgctgggcgtggcggctcatgcttgtaatcccagcactttgggaggccgaggcgggtggatcacttgagggcaggagttcgataccagcctggccaacatggtgaaaactcatctctactaaaaatacaaaaagaattagccagccgtggtggtgggcacctgtaatcccagctacttgggaggctgaggcacgagaatcacttgaacccaggaggcagaggttgcagtgaaccaagatcgcgccactgcaccctagcctaggcaataagagcaaaactctgtctccaaagaaaagaaaaaaatgaagcccaggtccagcccttgctccatcacttcccagcagtgtcccctcctccagccttcaatctactcatccctaaaatggaaacaagagcaggacaaccatgagaacaaaaaaaaaagccacgtacttggcaccctgcctggccacggaaacactcgtgtgtgacccagggtcccctagccttggcgctgctaacactttggtcattctctgcggtggggctgtcctgtgtgtcaggcaatgtttagcagtgtccctggcctctagaccctgtagcacccccagcttctatgaccaaaaatacttccagacattgccaactgtccctggagggcagggtcaccaggtaaaatgcgggccttccatcgcatttgaatctcaggttaacaaatagtttttttagtagaggcatgtcccatgcaatgcttgggacatgcttctacttgacagtattccttatctgaaattcatatataactgggcatcctgtttttatgttattttcctcctcaatctggcagctctacatggggctgtcgggggagcaggcccgtcacccacggtcttcaaagacaggggtaattgtcattcactgcaacaataactgggcatttcagggctggcgctggcactcctggcatggagctgctggcttcctctgtccccatgtggtcccagtgcctggggctacacggaggggctccaggatggcccaagccagaggaacccaagcccccagtctgcccttgacctgctgtgtggtctgaacaagtttcttaccctctctgtcacctactgcaaagggggttatcagcgctaacaattgctacacacagttagccttctcattggaatagagattctaaccttttttttttttttttttttttttttaaagaaatggtggtcttgctatgttgccaggtggaactcaaacttctgggctcacgcggtcttgctgccttggcctgctaactcctgcgctcaggtgatcttcctgcttgggccccctaagtaagctgggattctaggtgtgagccactgtgcccagctctgactgtaacttttgccctagataataacctgtatactgcagtgctgtcataaggatgcatggtactaagaggaaggtgtcgaatggcaggcacttagtcaggccatataattagcaccattattactgctttggaaggagtagtataagcaggccgattccagttagtaccagagaaaggtggtgaacgttgctacttgagcgaactgggagtatcccaggggaacatgggccctgtgggcagctgaagctgggaaaggccgcagccagagagcggagcagactgaaggctgggctggatttgcagctccaggtaggagcaacattcaggagcggaagcggcaccaagcactgtcactcccagctcaggtccagccactctgcaaggtgagctctccggggagtcctggctcccgctgagtgggcccagggccccaggactgccttgctctgctcgctccctgatcagggaccaggactttcctggactccgacagcagcaacatgctttgggacccggcctatgttgcccaggcaacctcagcgaatcttacagaggggctcactgctgacgggaaagccccggcccagggccccaggagctgctggccccagtgttgagaagagacaagtgcagtgacaggtccctcagcacgttctatgaacgcctatgtgcaccaggcgccacggtgccagtgccttcacaggacttggctcctgaaatgatctaaacagcccctggtgttatcccgcccagctcatcctggaagacacggaggcgaaaagaggttgagccacttgcccaagatcacacagctaatttcaggctcatgcctgaaatcccagcactttgggaggctgaggcaagtaggtcacctgaggtcaggaattgaagaccagcctggcaaacatgatgaaaccctgtttctactaaaaacacaaaaaattagccaggtgtggtggtgcatgcctgtaatcccagctacttgggaggctgaggcaggagaatcacttgaacccaggaggtggaggctgcagtgagctgagatcgcaccactgtactccagcctgggcaacagagcaagactccatctcaaaaaaaaaaaaaaaaaaaaaggccaggtgcagtggcacatgcctgtaatcccagcactttgggaggccgaggaaggaggacaacttgaggccagccaggcatttgaagccagcctgggcaacatagcaagatcccatctgtactaaaaaaaaaaaaaaagttaaatgcttcctgttaaaaacagaggaagcatgaacttctcctgaggtaccatttttcacccaacagattggcaaaaacgggaaagctgttaacgctatggccacggtcatctcccatggggtgagtggaaggggctgctggtgtgacttcagggggttcactggcaaagctgtcaaaatgtgaagggtacacaccctccaaccatctagaatgttccaccctaggccaccttctgagtggatggtagaaggatatttactgaagtcctgcttgggcaaggcaggccggatttgggttcgagggtggtggggcgtgcacgtagccgtgctgtgcagctgtgggaaagggtgggcagtactgtggggctgacaggagccatccctggtgtgtgctgttgggtgacaaaaacagggcacaagagcaggctgcccctgcccagacacacatctgctctctggaaaccaggcccctgggagggcagccgcgatgccctggcccaggataactaggctggtctgctcccgtgcccggccatgtccagcagctggtaattggtcaacactgccctaacttccttcgattttttttttcttttttttcagagacagggtctcactctgttgcccaggctggaatgcagtggcaccgggctacgtttattttgtagaaatggggtctcactaatattgcccaggctggtctcaagcaatcctcctgccttggcctcccaaagtgctgggattacaagtgtgtgccactgcacctggcccgctctgacttccgagtcttgagcaacacaaagccagggagacccccggtgggaccgtgagtcccagcacctccccatccctctgtctccctggaggctcattcctcacctttgtccatcccacagatacttctagagcacgtggtgcaggccaggccctaaggaaactgcagggaacgagggggaggctctgtctggactctggacttgctgggttgggttgtgttcctgaggcccctagggatccagctcggccatactctggctgggtgacctcaggtgggagctttaccacctgacacctcagcttctgtatctacagtggggacagtggacagcacggaagccttgctgtgcggatgaaaggagatggagggaaagagctgaacctgcctggtgaggtgtgagctttgggagcgctgagctccctgtgggatgatgggaatgacggggatgacggggatgatgggaatcatggggatgacgaggataatggggatgacagggcagccaccccggccggcgggagggtcagtccgaggagggtctccatatggtgcctaaggctgagagcacattcattctgcaaacatttgttgcgtggtctgtgtgtgccaagtcttgggccaggtgccagggctacagggatcaaaaagacagcgtggttcctgacctcacggatccaggagtgtgaggaggagaacatccttgggaactatcacccgaatactaacacagagtgctggggtgtagaccagccaggctgaccttcccaggcacggctggaaatggcgcttcgtctcccacctgctggcctccctcctttcggaggatatcaggtgccggaggtttagcttaagcatgggtgactgatgggggggggaccggctaagtccctgctgtaagccaggaggggtgcccgctctgccctgggcagggggcggggcgagatcagacgccatctgctccctcgtttaaaacaggctttgatgatccaccccactgccctgagccgaagggaggctggagtggggtgtctctcaggagctcctgcctcctgggcagagatctgttcagaaggttccagaaagagccctggaattgagcctgcacacctgggttcccagccaggctgacttgctccttgttaacttgggcagccagtccccaccgcagccccatctggaaggcaaggacattggctgtcagcctggaccacccaggggaatcacctaggaggcctcctagagcaccagtgcctgggacccatccacaccaatctcatcccaacctctggggaatgggcagtggctgcatccatttggaagccttccagaagattctgatgtgggtggaggtttagactcctgggctagaatgattccagtgctttgtatttcttcttttttgagacagggtcttgctctgttgccaggctggagtgcagtggttttggcaatttggcaaaatttggcaattttggctcactgcaacttccatctcctgggctcaagcaatcctcacacctcagcctcctgagtagctggcactacaggcgcatgctaccacacccaactaatgtttctattctttgtagagatggggtttcaccacgttgcccagactggtctcaaactcctgacctcaagcaatctgcccaccttggctttccgaagtgctggcctgtattaccgcacctggcctgtattactctgaagttctcaatccacacctcagcttctatcacctgctggccccagggacctcagctcctccagctcagcccggcctccatacctgcctcctcgctgctcaccagctcagtgtgcttggtcctgactcagggcctttgcatttgctgttccttctgcctggaacactgttccctgcatccacatggctaactccagtgtcggcaccacagagaacccctcaccttgcctcatcccctcgactgcacctccttgctcaattcccttcacagcactcaccacgaaatccagcctgctgggtgtgtgtttgttcacacacaccattccacatttccgtctctcccccatggacaggagctctgtgctgctcactgctgcatcccgagggctgagtgtgctgcctggcatgcagcaggtactcagtacatgtttgtgtggagttgcccgggacacactctcctctgggctctgtcccgcactggaagggaaccagcaccatggaacagcgactgtgcgttggctcctgttcgcagcttgggtgtggaggtcagcagagtagacaaagacccctggaacatggcggtggcaatggcaggcagtgggtgaggacctcccccaggatccccgcaggcaggagcctgagcccattttacagacagggacaggaaagctcagggaagtggggtgcttgaccttggctattttctaactcctggttcagcggggactggattccaccatgtgatctcccttcaaatgtatgaaatttccagtttgttctgaacactgctgaaatgtattagtggaatgaacgtttttctcaccctcccatttcacagagctcctgtccccagggatggaaactccacattccctgcctggctccacctggctgctaccatcctctccggcgttgtggcccctccagttcctccaccatgcacgccaggctgctgcttgcttcccagcccgtgcccatgagtttctgctaccggaaacagccaccccttccccgctctgtgccaggccagctctttaggctggggtgcttcctgggtgatgccacccctagccaccccgggtaggcaggtgctagcttccatccagcactgagttagcattaaggtcactcctcacctctgtacactcccagtggccaggaccacactgccttgttcatccctgtagccccggcacctgggccagcgcccagtgcacggtagggacgcaataaacgtttgtggagggaacaatctctcacgcaattctggcctgcagctgtccgccagcagagccaggcattcacactgtcacggggccatatggagggattctgggttttgggttgaccaggggctagacgcaagcctctgaaggcaaatcagaaaaatgggtatcataacggccaaccaccaatcaaccccaggctgagccccccgagcgagggagtcacagccatgcctggcagcctggggtccccacaaaaacgaggagtgtctgagaaactgtcacagccaagagcctaaggaggtatgacaactaaatatcatgtgggatcctgcgacagaaaaaatacatgggggaaatcggaatcacgtggacattcattaataataacagatctggccgggtgcggtggctcacgcctgtaatcccagcactttggcaggttgaggcaggaggatagcttgagcccaggagttcaagaccaacctgcgcaacatggtaaaacttccatctctactaaaaatgcaaaaaaaataagccgggtgtggtgcctcttgcctgtagtcctagctacttgggaggctgaggtgggagaatcgcttgatcccaggaggtggaggttgcagtgagctgaggttgtgccgctgcactccagcctgggcaacagagccaggccctgtttcaaaaaaacaaaaagtgtggatattagttaataagaatggatctggccgggtgcggtggctcatgcctgaaatcctagcaccttgggaggtccaggcttgaagccaagactttaagactagcccgagcaacaaagcgagaccccttctctacaaaaaaaaaaaaaaaaaaaaaaaaattagctgggcgtggtgttgtacacctatactccagctgcttgggaggctgaggcaggagaaccacttgagccccagagatcaaggctgcagtgacttgtgatggtaccactgcactccagcctgagcaacagagggagagtgagatcctgtctcaaaaatataaataaataagcacagaaataaataaaacactaataaataaataacaatggatttgtattgattggtttgctgtaacgagtggaccgtgtgagtgtaagttgttcataacagcggaatctggtgtggggtgtgtgggaactctctgtactatcttttcaatttttctgtaaattaaaactgtcctaaaaaataaagtctaattaaaaaaacaatgacaaactaccaacccaggacaaagccttcatctttcccaccaagccccaggcagccccaagggaccttccccaggacagttgctgggaccagtctcattcccaggagcctgtatccatggtgacactggagttaacccaggctggagctgacgcccaccccgcccccacagaacctcacagatcacaggggtcctcccaggtagccctaacgccccagccagccactctagtgggaaagcccatgcctgcagtttaagtcttcctgcagaggcccccgcacacctgcagccacctccatagcaggaaggtgtaacggctccttgggtgccatctttagtgcctatctcagaaaactctcgagacctgacccaggagatcttcccagtcaccactccattttacagacacagaaactgaggcctgggcacgggaagtgacttgcacaacgttgcagtcagtcagaggcagacccagaatatgaactcggatctctgaccccagagccactttgccagtggtcctcaaagttacacagccactggaatccccccggaggatgtgttgaaaaccctgagttcctgactcagttgatccagtgggtcctgagaatctgatggtctgactggttcctaagtgatgcctatacagaaggtcccggaccccactgagaaccatgcagcaggaccatgccatttccttggctgtgccgccctgctggaacctggagagggcgcacttaggaaccaaggagacgactccccctttccccttccgtctgtggagccaacccctcctaactggccatgtggccttgagccagtgagaggtcccctgtgcctcagcctccctgtctgtagagttcagcagtgatgagggtgccatgcccagatcctgttgatgccagcacgtgccaacccttatagggtgaggcacgagggagattttctttggcctgtgggacactcccgtgggtcacagtcaccatggccaggcccttgagcagagggactctgcagcccctttcctttggactcggaaacaaaggggtgttggcacagctgtgttcctcctatgccaccctctcaatatctaccacccttgggcagagtctttgttgccagacaggagaagcacattcctgccccccacaggggaagctcagaggtgaactgacttaatgggggctgaatagtgtcccccaaattcacatcaacccagaacctcagaatatgaccttatttggaaatgaggtctttgccgatgtaattagttaaggatctcatgatgagctcatcctggatttgggggcggaggggctctaaatccaatgcctggtgtccttacaagaggaggagagggaggttgaatgcagggcaacatgaagagaggaaggccacgtgaagacagaggcagagactggacccaggaggcctgaagctatcagaagctggaagaggcaggaaggttcctcctttggcgctgaggagggagggcggccctgccagggccgatttcagaacaatgagagaataaaaattgctgttttaagccccccagcgtggtcatttgtcacagcagccaccggacagtcacgcacggtagagatggaagccagcccagcagtgggcagatcccatcccagccagccaagtcgggtgccatcgacacaaagccagcccaatagggaaggggcctgtgtcttcctgggcagttacacagcctcagagcccctgggggagctgaggaaggaggaggtggcgagggctggggctgtggctggtcagagcgggtgagatgaagcccgcagggaagaacgtcatacccactgtgaccctcacactctgctgagtgggttcagcccatgcctcccgtaaccacgcctccaaagggaataagaacgggtctcggagctgcctccctagaggagcccatgtctcatttctagttggtgtgactgtagctggtcacttcctctccttggtcctcaacttccctatctgtaatgtaaggctttgcaagatgagtgccaaggtgcctcccggctcagaaagcctactttggttctagagggagagattcccagactggaggggaagggaaaggagggcagcaaactaaatcccccagaccaggcaagtgaacccccacatcagccgagggaacccccagaccagccactgaacccccacatcagccaactgaacccccagaccacacaactaaacccccagaccagccaactaaacccccaagaccagccaagtaaccccagtccagccaactgaacccccagattagccaattaacccccatacaagacaggtaaaccctcttagaccagccaaccaagcccccaagaccagccaagtaaagcctccagcccagccaagtaactcccagaccagacaacttaaaccccatagatcagccaactaaccaactcccccatacgagacaaccccccaagaccagacaacaaaatcccccaaaccacaaacctaaatcccctagacaactgaacccccccagatcagctgactgaacctcccagaccagtgaactggaccccactcattaaaatgatgtttggaatatactgaattaaataaaacatattaaaagtaatcgtacccgtttctttgtaccttattcatgggactgctagaaacgtcaaaatctatttctactggatggtgtggctctagatagtatgtccttgagcagagtcctgtctttatgattcttcaagtcctctccagaacccagcactcaataaaacctgtgggctggatgcaggatgcctcagtttaccccagaggaagctgaggcctagagagacaaggtcacttgccctaaggcaggaaccactgtgtaatttgtggggctcagtggaaaacgaacatgtgaggcccattgttcaatatgtattaagagcattaaactgagcatggggccctgtgcagctgcagaggtcacatgcctgtgaagctggccctgctccaaggccaaatcgttaaggggcagagctgggatttgaacccagggaggcctggagctgggggcatggtacaggagggtcacctggaaacaggtgggtgggtctgagtccctgggccaggctgcggggctagagcagaggggcagagggcctgggtcctggcgggtccctcctcctggtgccctgggcagcgtgtagtgttgaggccccagggagtgagagtaatcgtatccagggctgaacggtgcccgctccaaaagatacacctaaccggagcctgtgagtgggaatctgacattgttgaaaacaggatctttgtgatgtcattttttttttttttgagacagggtctggctctgtcacccaggctggagtgcagtggtgtgatcacagctcactgcagccttgacttcctgggctcaagggatcctcccacctccgcctcccaagtggctgggactgcaggcatgaaatgccaccattccctgataatttttgtattttttgtagggatggggttttgcaatgttgcccagactggtcttgaactcctgggctcaagagatcctcctgcctcagtttcccaaagtgttgggactacaggcatgggccaccgtgcagccccgcagatgtaattgagttaaggatcttgggatgacattatcctggactagggtgggtgctaaagcaaatgacagttgtccttaaaagagaagggaagacagaagaggaaagccatgtgccacaaggcagaggctggagctaagcccacaaaccaaagaatggctggtgccaccaggagcttggcaggaaggagcctccttagagcttccagaagaaacgaggccctgctcacacctggatgtcacacctctggcctccagaactgtgagagaataaattcctcttttaagccacctagtttggggtcatctcttacggcagccctaggacagtaagaccccatgttacagagttcctggctacttcaaatatggagttaaaatgattctctctgggccaggtgtggtggctcacgcctgtaatcccagcactttgggaggctgaggcaggaggatcacttgaggtcaggagttcaagaccagcctggacaacatggtgaaaccccgtctctactaaaaatacaaaaattagctgggcgtggtggcacacgcctgtaatcccagctactcaggaggctgaggcaggagaattgcttgaacccgggaggcgggggttgcagtgagtcgagattgcaccactgcactccagcctgggtgacagagcgagactctgtctcaaaaaaaaaaaaaaaaaaaaaaaagagttctggccccctaatccccattccccaagtcacccccatgcttgtgtgggcctcatcacctccagagacccaggctgggcgagtgggggtgggcaggggccggcagcaccaaagccagccatgaaaaatggatggacaagccacactcgggacaggcgctgttccagcacttagcacacttagcagctctggggccgacaggaagacggtccttttaaaagctcccagccccacgagccctgatctggctgcctgtgctttcactcgtgaggggccgagggtgggtggaggtgggagggcatttcccaggcactgtcaggatctgcagggtcttggtctaccttcctgatcaagtcccggccttgggctggaagaaaagtggtcccagagatacctccaggggcctggtttctccgtcaaagatgtcctgacacaatcgccaaaaggtggaaacaacccagtgtccatcgttggagaagtggataaagaaaatgtagtctgtccacatggtggaatattattcagccgtgaaaaggaacgaagcagtgatgcatgttcaatgtggatgagcctagaaaacaccacactgagtgacggagaccagacacaaaaggacaaatgctggatgattccactgacacgaggtccctagagcagattcttagagacaggaagtagaatggtggctgccaagggctggggagggaacggggagttagtgtttaacggggacagagtttcagttggagatgatgaaaccttcattctgaagacgggtggggtgatggttgcacaacactgtgaacgtgcttaatgccactaaccttgtacacttcatggttaaaacggtaagtttatgtgatatatattattttttaaagaagaaaagtatcctcaatgcctactttgtgacaggcactggggaactcatgtctaagggaagaaagtcctcaagtttcaaggggttaggcttgaccctctcaaccactgtctgctgctgaattaacctcagccactcacagatactcattcaacaaacatctccccactcctctgtggggtcagcctggagtctcagaggaagccaggtcctggagaggacgtgggctgtttgtgtctgtccggcatcccatcccgcttagtaaacgacaccccgattttcaccaggggaaccaatctctccgcaagcggtgttggaggagctgtcaatcaagatgcacctccctccaggccaaaggggcgggcctaagacctaaactgggccaatcggatgctctcctggagcggattcctcccagcctgggaatctgaagggtggtccattcatcccggctcccagcaggggccttttcacgcctccttacttcacttttcctgtgggctcccctcggctttccagtaaattccttgttaaccagtatccgcttctgtagcttgcatctaaaagccctaagcctgcctaaacccaaaggatgggctacagagcctggtgaatttgacgaaggaaatagtacaattaattaagagcagccaccgccagagtgttccaggccctgctctcgtgctcccggtgacctgagacgggtccgccatgatccccattttactgataaggaaactgaggcccttgatctaggtctcacagaggcattggtgaggccacaactcacaccatgcaggctgatcccaggcttggctcagctcccaaccacctctccaggtgggtaggtggcctctgcctggaaggggctgctggggtcaggtaggtggccccggggcaggctagaagcttggcactcacaccactggccatgggacacctggagccagaggcggtctcaggcagcggggccgcaagtcagaccaggggccgcccacgtgactcccaggtttttggctggggagaacaaagcaactgtcaccaaggtaaagaagaggggcagcaatggacttgggatgggaggtttcctgcaacattggtctgaggtgccccagggccatccacacacaggacagaagtctgggctgcctttgctaacacccacaacacccttcagtggttttgtgtccttctagaactttctcccgctggccttctctcctaccacctggacgctggacctcctgtctgggtgataacaggccccgggtgtgtccttgggaaagcaaacagcccagcatatgcctggctccttcgcaaaggcctcctcctccctcactctccacagcctgggattaggcaccctgagggggaaactgaggccccaaggcactgccaccttcccagtcacccactgctagtgaaatagaaggcctggaggggtgctcagagtcaggacaagcatttttagagcacctgctgtgtacaggactgctttaagggatggtgccctgctccctctgcagggcagagggcttcaactcccctctctcctgccccccaacccagcaccccctctgccatgagagctggtgggggcagagcttcaggccttacctttcaggcaggacatcttaagccccatgtcggcacctctgcaggcctgtggagagaggacagcgctgagagaggggagggcgcgacttgtttgtattggccacgtgcagccgggcccccacccttggccctgatgagtgcaaaacaggaggttgtggtggagagaaaccaccggcctccaggtcatgccacctgtcaactacatctgggctggatttgctcaaagatggagtctgtgacggtggaaaaaacttacgggtgcctcaaagttaaatatacaggaagccaaggcggcgtctgcagccctggctctgtgaggtcacttgaacccaggaggcggaggctgcagtgaactgatgatggggaaccgacaccaccaagcctttcctttcaagagccacaggacggccgcagctgcagagatgtgaagacctgccagcagggctcgggggtggcccagaggcccccatggccatgtacctcccgttctaatgctttttttttttcccctaatgcaggttctttggagatctgacagcctgagctatagaggacgtgtggcccccccagcccacgggtattagaattgtcccaaccagtgttctcatgatgttcctgcaacatgaggcatcccgagttctaagcaattgaaaaatagaagcagcagccagtggtgcggggcccctgcatgctcttgacactcactcctcagtaacagccccgcaaggtactattactgtccccacttcacagacacaaaaatcagggctcagagaggtggcggcacctgcccaaggctaccagcttactagggactgtggagctgagactcgaacccaggactgtcctaatccctaggctggggccccaccccacaggggcctgtagtgtgcagagatccagaggaagataaagcaacagtccgtgggaggaaccccaggggatgggaggtcaggcaggaacaggtggggagaagccgaagatgggtgggacctggggtttctggggctggtttggagttaagagcttattctgaggacgccaaggagcaagtctgctttctagaggggtgtgtggctagtacctgtgaggagaccccaggcctggccctcatgtgcaggctgttggtggattggtagcatcagcaacccggaggctggggagcaaggcagcagctcaggcccacccaggcgcacaaggccccagggattcctgtgcctgctgaggtcagagatgcttgctctgggccagaaatcggggaggtgaatgtgaagatggcaggccaggaagggtttggaggagaaggagctggaagtccaggtggagctagtaagacatgggtgggagataccaccaagacatagaccggggccttgggaagggagggaaagcgagagatactgatgggaacaggcttgggccagctgcgtatgaaaggcagccattccaacttacgagtggtctctggagcttccccattgcactagctgggccaggtcccagcttggcaactcccagccatgtgatcacggatagtttatctcaagacttcactttcctcatctttaaaatgggatgagctggccgggcacagtggctcacgcctataatcctgacactttgggaggccgaggtgcgtggatcaggagttcaagaccagcctggccaacatggtgaaaccccatctctactaaaaataaaaaaatgagccaggcatggtggtgggtgcttgtaataccggctactcaggaggctgaggcaggagaatcacttgaacccgtaggtggaggttgcagtgagctgagatcgtgccactgcactgcagcctgggcgacagagtgagacttcatctcgagaaaaaaaaaaatgtaaaaaggggtgaggcacataacagtctcattgagcagcagcgagaactgagtgtggggaagtgatctgtgctggggacagaggagaagtccgaacaatgtcagctgctgctgtccctcctgacagagagggagggaaaggaggtcgaggtttccagctaggccttttatccagggccttgctgttcccagaatggcccatggaacagcagcacaggcttcccggtagctgtgcatgcagagtctcaggccctgagctggccctgcccactcagaacctgcatccacactacagccaagaagagctgggcactgcagcctccgcacatcacccaggagctttacaaaataccttttcttccggattaggtaactcgcacctgtcatcccagcacttggggaggctgaggcatgaggatcacttggggccaagagtacaagactaacttgggcaacataagaagaccctgtctctataaaacaagcttacgcctgggcgcggtggctcacgtctgtaatcccagcactttgggaggccgaggtgggcagatcacctgaggtcaggagttcgagagcagcctggccaacatggtgaaaccccatcgctactaaaaatacaaaaaattagctgggtgtggtggtgggtgcctgtaatcccagctactcatgagtcttgggcatgagaatctcttgaacctgggagatggaggttgcagtgaaccaagatcatgccactgcactccagcttgggcaataagagcgaaactccatctcaaaaacaaaaaacaaagaacaagcttgtacaacccgcagccctccagctgcctgcagcccagggtggctttgaatgtggcctaacgcaaatttgtaaattttcttaaaacattatgaattttttttgtgatttttttttttttttttttagctcatcagctgtcattagtgtattttatgcgtggtccaagacaattcttcttccagtgtggcccagggaagccaaaagattggacaccctggctataaaacatttttaaaaaattagtcaagtgtggtggcctgtgcctgtagtcccagctactcaggaggctgaggtgggaggatcacttgagcccaggaggttgagactgcagtgaaccttgatcgtgccacttcacgccagcctgggtgacagcaagagcctgtctcttaaaaacaaaatgctgcttgctgcctgagccccacccccagagattctggggcaattggtctggtgtgtggctggcattgggattttttttttttttttgagacagagtctcactctgttgcccaggctggagtgcagtggcgtgaccttggctcaccacaacctccacttcccaggttcaagtgattctcctgcctcagcctcccgagtagctgggactacaggcgtgcaccatgacacccagctaattttttttttttcatttttagtagaaatgggattttgtcatgttggccaggctggtctcgaactcctgacctcaagtgatccacccacctcggcctcccaaagtgctgggatttcaggtgtgagccaccgcgccgggcccggcactgggatttttaaaagctccctgcaggactctcacatgcaggagagagaatccttccctatgggaggagtgaggggtagcggaggagtggggctggggctgagggacggagggcccaggcctgtgggagcgacaggcacatttcctggcactcaccatgggcccggcactgttcagagccctttatgtgtattcatggttagtgaatcctcactataaccccatgaagttgggaccgttcctgtccccatctcacaggaaacaggcacagagaaattagttaacttgcctaaggtcatctgggtagcaagtgacagaacagggatttgaagccagaactttggactctagagcccacgcttttagtgaccaggcagacctgggaagtcttggagtccccaggggacagagcttccaggaacaggggagggcggagcagacctcatctccatccctcatcaattgtgcccatgctggctctcctgccgccagccttgccaaggggtcctgcagccctgacgtcaggatcaaccacaataagccagagggaaagctgcacagagccccagggcctctgctggccaggcttcccaaacctccctggactgtggctgctggtaagccagactcgacatcccaaccaagcgcagaccggccctgcacaaagtactcggattttatcatctattcccttttatcctgtctttgttcagcattgatcacagcccacccggtggattttgacatgtctcaacccagggtttgaaaaccagtgatctgtacagaagttctcacagaaagaatgatgtctggaatttgctgtaaaatacttcagtaaaacaacaacaacaaaatgctgtggggcacagggaggcgtcaccatgagagcagcgggatgctgtttactgttgagactgggagataggagagcatgacatactggtgtgtttgtttgaaaagtaatgaccagcctgggcaacatggcgaaaccccatctctacaaaaaaatacaaaatttaaccagtcatggtggtgcatgcctgtaacccaagctactcaggagactgaggtaggaggatcgcttgagcctccttgaagtggaggctacagtgagacgtgatggtgtcactgcactacctgggagacagagcaagaccctgtctcaaaaaaagaaaagaagtaataaaacagtcagaagagaaacaactgtattttaggtgacagtctggggtcaatattaagttttctgattctgattattgtactgtgttctgtaagaaatggtccttgctcggccgggcgcagtggctcatgcctgtaatcccagcacttagggaggccgaggcgggtggatcgcctgaggtcaggagttcgagaccagcctggccaacatggtgaaaccccgtctctactaaaaatacaaaaattagccaggcgtggtggcaggcacccgtaatcccagctactcgggaggctgaggcaggagaatcgcttgaacccaggaggcagaggttgtagggagccgagatcacgccattgcacccataggctgggcgacaagaacgagactttgtctcaaaaaaaaaaaaaaaaaaagaaaaagaaatggtccttgctcttagaaaatatacactgatggccaggcatggtggctcacgccttgtaatcctagcactttgggaggctgaggagggcagatcacctgaggtgaggagttcgagaccagcctggccaacatggtgaaaccccatctctctactaaaaatacaaaaaattatccaggtgtggccgggcgcggtggctcacgcctgtaatcccagcactttgggaggctgaggtgggaggatcacgaggtcaggagatcgagaccatcctggctatcacggtgaaaccccgtctctactaaaaatataaaaaattagccaggcgtggtggcgggcccagctactagagacgctgaggcagaagaatggcgtgaacccgggaggcggagcttgcagggagccgagatcgtgccactgcactccagcgtggggcacagagcgagactctgtttcaaaaaaaaaaaaaaaaaaaaaaattatccgggcttggtggcgggcatctgtaatgccagctacctgggagatggaggttttagtgagctgagattgtgccactacactccagcctgggcaagagagtgagaccctcaaaaaaaaaaaaaaaaaaagaaagaaaatatacactgacgtgtctgggctcaagagtcatcatttccgtaacttaactctcaaattgttcagcaggaacatagtgatacgcatgaatacgtgcagggagagatgaggacacgcgtgtaggtaaatgttcatttctggcgaaggatatttgcagggcctcttcatattctcacaactcttctttaactttgaaactgcttcaagaaaaaggcttaaaaaggaaagaaaggcaacatccagaagagacagggcagctcagtgagagtctgcgcaatgcctggcctccccaccatggtctcccagggcaggatgcgggcggcagcatgtgcgtcagatcgcgttttcctgctagcagcttctacagcttggtggagatgcgttcctggggccaggctctggccgagcaaaggatctgtattatgccgtgccaggcagcaccacctccctgaagaggtgtctggaactgacaggttttctctgaacagctgtcttgcaatttgaaagacccctacctcaaaacacacaggggaaggaaggaaggcagggagggaaggagggaagaagcaaaccagaggatgggggaccaggagcagctccagccaggattcaggtgacactgggggcaggatgcagtgagggtcaggcaggtgcagcatcgagggtggtcacgtccacatatggcaatttgatgtggggtgtgtggaactcccacgtggagagttttcacacagcaagttttctcatctcccacagtgtccctgaacttgccctcattgtcatcctgcttctgcctccctccaaggacagcacaaaggcggcaggcacaggactggctgaagggacaagaaagaattgggagtctagaggagctgtgccacctcaagcaggtcatttcccgagtctgaggtgctggggctcggtcccccaggttctgtgtcctcctctgccaaacaggcattgagccaccagcctccaggacagggcctgggacagagttgtcaccatcatcttcatcatcatcattgttctcatcattcttattgctatagtttggatatttgtcccttccaaacctcatgttgaaatttgattcagaacactgggcctgatgggaggtgtctgggtcatggggcaatctctcatgaacagcttgcttggtgccgtcctcacagtaatggatgagttcgctccctattggttcctgcaagagctggctgttaaaaagaagcctggtggctgggcgtggtggctcacgcctgtaatcctagcactgtgggaggctgaggtggctggatcacttgaggtcaggagtttgagaccagcctggccaacatggcaaaaccccgtctctactaaaagtacaaaaattagctggctatgatggtgcatgcctgtaatcccagttactcaggaggctgaagaatgagaatcgcttgaacctgggagccagaagttgcagtgagccgagatcatgccactgcactccatcctgggtgacagagcgagactccgtctcagaaaaaataaaagagcctggcaccttccctgcttcccacttgctgccaccctctcgccacatgatctctgtggctccccttcaccttccgccttgagtggaagcagcctgaggccctcaccatcctggcgccatgtttcttgtccagcatgcagaactgtgagccaaatgaaacttttttttttggagacacactttcactctttttgcccaggctagactgcaatggtgcgatctcggctcactgcaacctccgcctcctgggttcaagcgattctcctgacttagcctcccgagtagctgggattacaggcatgcgccaccacacccggctaattttgtatttttagtagagatggggtttttccatgttaatcaggctagtcttgaactcccaacctcaggtgatccgcctgcctcagcctcccaaagtgctgggattacaggcgtgagccacggtgcccagcatgaacctcttttctttataaattatccagccttgggtattcctttgcagcaacacaaatggactaagacaggtgtcacctcactactgttgtcatccttgtcactgtcatcattgttgctgccacctttaccatcatcatcctcatcatcgtcatcagtgtgattgccactaggtaccaccagggcacccccactacgtggccccaattccacagtgtggcctgttgtgttgggggtgaatttatgtgggagtgtggagagccctgtccactccctttgagatctggggccagcctcctgcagagaccacagatgctttcatgcgagaggccccttagatgagctgaaatgtctgagaaggaggagttacagctttgattctacatctgtctgaatagaagccatacagttgtctaaacatagggaagagccactgttaccttaaactttatcatcatcgtcatgacaatatcagctgatagatatccagctgttttcagtgtgccaaattctgggccaagtttgctataaaaacgatgccactgaaccctaacaatgccctaagagataaacattatcaccatcctgttttataaatgaggagctggggctcacagctgtccagcgactcccagcacccagggctagcaagctacagctctgggctgccagacactaaagccaagcccacatcactgcactgggttgcagtgttctattccacacgccagaattctagattgtttgagtttgttacaaacacacgtatctttgtaactagaaaataaagatttaaggccggacgcagtggctcaagcctgtaatcccagcactttgggaggctgaggcgagcagatcacctgaggtcaggagttccagaccagcctggccaacacggagaaaccctgtctctactaaaaatacaaaattgggctgggcgcggtggctcacatctgtaatcccagcactttgggaggccgaggcgggcggatcacgagatcaggagatcgagacaatcctggctaacacagtgaaaccccgtctctactaaaaatacaaaaaaattagccgggcatggtgttgggcgcctgtagtcccagctactcgggacgctgaggcaggagaacggtgagaacccaggaggcggagcttgcaatgagtcgagattgtgccactgcacaccaggctgagcgacagagcgagactccatctcaaaagaaaaaaaaaatacaaaattagccgggcatggtggtgcatgcctataatcccagctactcaggaggctgaggaaggagaattgcttgaacctgggaggcggaggtagcggtgagccgagattgcgccattgcactccagcctgggcaacaagagcaaaactccgtctcaaaaaaaaaaaaaaaaaaaaaagaaaagaaaagaaaaagaaaataaaataaagatttaatgggagaaaaaaagatttaaggcaaggatacccttagcttggcatgatggtatgggagcagttgggcccaaaagaactgctagtttaggtataaatgttctatctttttcacacatttgcaggggtgtgaaaaacttccgtttcatattgaattgggctctgtttatgttcccgttgaaatatcagattgttaattatttgcacaacagcttgaagaagaacaggttctttcttgcacccaggcataaaaatctccctgtcagcagccagatgcggtggctcatgcctgaaatcccagcactttgggaggccaaggcgggcggatcacgaggtcaggagatcgagaccatcctggctaacacggtgaaaccctgtctctactaaaaatacaaaaaattagtcaggcatggtggcaggcgcctgtagtctcagctacttgggaggctgaggcaggagaatggtgtcagcccacgaggcagagcttgcagtgagccgagatcgtgccactgcactccagcctgggcaacagagcaagactccatctcaaaaaaaaaaaaaaaaaaaaactctccgtcagccgggtgcagtggtttacgcctgtaataccatcactttgggaggccgaggtgggcggatcacctgaggttgggagttcaagaccagcctgaccaacatgcagaaagcccatctctactaaaaatacaaaattagccaggcattgtggcgcacgcctgtaatcccagctactcgggaggctgaggcaggagaatcgcttgaacctgggagctgcaggttgtggagagctgagattccaccattgcactccagcctgggcaacaagacgaaactctgtctaaaaaaaaaaaaaaaaaaaaaaaaaaaaatctccctgtcgccaaatggtcacggattctctctggtgacaaggatgggcaatgggcaattataaaaactgacttcctcggcagaggtccaccccctcctgaggggtggcaagacagacagacatcagatgtcatgcatgccacacagcttctctaaggccaagagcatctccagggacaggtcccacttccatgttggctgtgtttgtttttgcaacagccttgaaggcaggtgccacaaattaccagctcacaacagactgcttgtcagcttgccctctacagattttcagtgcaaacagaaaagcaaaatgatgtgttctttcataaagtcaaaagcaaccaagacatagcactgactgtgagggacagaaactcctgctggctggagggaccctgcttttcaaagacagagaatctcccgctggctgagggaccctgctcactgcctaccagagacagaatctcccgctggctggagggaccctgcttttcaaagacacagaatctcccgctggctggagggaccctgcttttcaaagacagagaatctcccgctgactgagggaccctgctcactgcctaccagagacagaatctcccgctggctggagggaccctgctttccaaagacacagaatctcccgctggctggagggaccctgcttttcaaagtgggctccaacgtttgccgattcccttcagttaccacttgtgtggatcacagaagttcagctctaggctatgagataaacccatcctggagaggctcatagaaatctagagctggaagtggtcagagagagatggccaggtaaaatacaggatgcccagttattgcatgggacacactcataaaaactattcattgtttatctgcagttaaacttagctggggctgggtgcggtggctcattcctgtcatcccagcactttgggaggatgaggcggcaggcagatcacttgaggctgggcgttcaagaccagcctggccaacatgatgacaccccgtctctactaaaaatacaaaaattaactgggcatggcagagggcgcctgtaatcccagctactagggaggccgaggcaggagaatcgcttgaacttgggagacagaggctgcagctagtggagatcgcgccactgcactcaagcctgggcggcaaggtgagactcgcctcaaacaaacaaacaaaaacaacaacaaaaacttagctggataacttagttatccttgtgtttatctgctgaatctgaccactctattcaaggtcatctgatttctaacgtctggctgtcccagatggggacctggagaactagacagggaaagtgaatgaactggttcctgcagagccacctcccagatgaaatcagagtaaccccatggaggtcctgagtcacggtggcaccttgccctgcttgcctaacaaagacctcctgggaggaggacccagaagagggcagggctgaagaagagtcacagctgaagaatgtgactgtttgccaggtgagtgggctccaatcccagtggggcagggtggtctctgaggcttggtaagccccttcagctctctgggcctggtcatgctgcaagcagggaagagagtgcgggcaagcggggctcccagcaggctcacgacacacatggtgcttttcttccttctttaggaaagccactttctttctgcagcaggattagaattcctacaactccagccaaaggaactgggttgggaagcgatactgcaagcattcatgtgcttccatcctggtcttcagcttagccacggtcctgcggggacagtgagtccctctctgagtggccaggacctccacctggcccacaggaagccttcaccagcaggaagcgaaacaggatggggtggaggcaggaggcccaccgaaatccccacctgcttggcctcccacggatgagccgtgtgactcacagcaaaatacttgcccattgccgactctgggccaccgtgaaataatagagctgaacacctttaggatttgagcacctttctgtacattatacatcaataaaaacatttatcaaaaaataagagggctttgagaccagccagagcaatatggtgaaatcctgtctccacagaaaaatacaaaaattagctgggtatggtggcacacacctgtggtcccaactacttggggggctgagttgggaggatcacctgagcccaggaggttgaggctgcagtgagccatgatcatgccactgcactccagcctgggcaacagagagaccccatctcaaaataaataaaaggggtctgctatttgaagtcaggttaacggctacccatagggaaaccatggctgggaggagcatgaagggatttctgggggtgtcctggggggctgaaggtctctttcttgacctggtgcacacttttgatgtacacttattacaatgggcatatcatcttgcccacaaaaagtatcaaactgtaaaatatttgaagagatttattctgagtcaaatgtgagtgaccaatggcctcaggagacccagagaatatgtgcccaaggtagttggtctacagcttggttttatacattaggaagacacaaggtatcaatcagtacatacaagatatacattggttccagctgggcgcaaggactcatgcctgtaatcccagcactttgggaggctcaggcaggtggatcacaaggtcagcagttcaagaccagcctggccaacttggtgaaaccccatctctactaaaaatacaaaaaaattagccaggtgtggcacaggtgcctgtaatcccagctactcaggaggttgaggtagagaattgcttgaacctaggaggtagaggttgcagtgagctggtattgcaccactgcactccagcctgggtgacagagcgagactccgtctcaaaaaaatatatatatatatacatatatatatatgtgtgtgtgtatatatatatgtgtgtgtatatatatatatgtgtatatatatatatatacacatacatacattggtttcatctggaaaggtgggacaactgaagggggaagtacgtgggatggggagacatggcttttgggtcataggaggattcaaaaattttctgattggcaaatggttgagagagttattatctgggctgggtgcagtggctcacgcctgtaattccagcaatttgggaggctgaggtgagtggatcacgaggtcaggagtttgaggccagcctgaccaacagggcgaaaccccatctctactaaaaatacaaaaattagccgggcatggtggcacgcacctgtaatcccagctactcaggatgctgaggcaggagaatcacttgagcctgggaggcggaggttgcagtgagccgagatcacgccactgcactccagcctgggtgacagagcaagactgtctcaagaaaaaacaacaaaaaaacccaaaagagttattatctaaagacctggaatccatagaaaggaatgtctgggttacgataaggagtttggcttgagagagaacagattgtacatgtttcttatcagacttaaagggactgtcctattagtctgaaggtctgcactgatgttaatgctggtctgcggggtctcaatttcaaaaggcaagagagtataatgaggcatgtctgaccccacttctcatcatggcctgaactagctttgcaggttaactctggaatgcccttagccaaggggagtggtccattcagatgattgggaggctttgattttttttttttttttttttttattttatttttttttagagaaaggagtctcactatgttgctcaggttggtctcaaactcctggcctcaggtgatgctcgtgcctcaccctcccaaagcactgggatcacaggtgtgagccactgtgcctgggccccatcatcacttactaatctttttaatgatgggggattatacttagcaggcccagaggcctagcctggcttccactgcaggtaagagcaattcagtaccacggctcagggttccaggcctggccttgccattttccagccatgtaaccttgtgtcagtgactttgcctttacaagcttctgtttcctcatttttattttttaatttattattatttttttaagagacagggtctccctctgttgcccaggctggaatgcagtggcgtgatcatagctcactgtagcctcaacttcttgggctcaaggaaacctcccgtctcagcctcctaagtagctgggactacaggtatgcaccacacccagctcattaaaaaatttttagtagctggggggactcactgtgttgcccaggctggtctcgaactcctggcctcaagcactcctcctgctttggcatcccaaagtattgcagccacaggcgtgagccactgtgcctggccctgtttcctcatctttaaaatggggctgacagtatttggttggagagttggtcaggggattaaaacagaaaacgcagggtctggtgcatgaggagtgctccgtaagcatgaactatcagtgcgctcttcttcagtgtccactgacggcacgctcccatttcaagtctccagaggtgacctgcaccttgggctgggaaaatacactctacgtgggtctggggtgcaccccaccggcatgggaaggcgcttccagggagacgagattaggtggtgagctttcagcctccttggggctggtgagggattaagtgtttccataaatacacggcctcctcccatccacaggaccgggtccccagcggtgggggcgcagaacccaaggagggcgtggcctgcacaggtgagggtgctttttggagttaacccagcccaggacaggggcctccccacagcgttggatgggtggggtctaggcaggaaacgccagagcctgtgactcagggtatccctctcagagcctcagtttcctaacctgtacattgaggcgttcgttccccgagaaccgcactacctcacaagtgcctttgcctcgcagccttcccttcctccctcttcctccgggctccaaagcctgtcgagcctgcacagattttcccttgattccatctgggccccgcagccggaggcggtctgagagaagtcccagccgccctcagaccccgccctccgcctatccctggggggagctgcgggtgcccctttttactgagacctcccctagttccgctcgagcgcagccagccaggagaaggagcgcgtgcgtccacacgggtcgcccttcgcggttgcaaacctgctttgatgccctgggagcgcaggggggcccctaagtgaggcagttcataaataatagatttggaaatactcgatagagtggaaatggttcctcgggaggcctcctgcccccgccccccgccgggctgccttccagctctcaggaatggcgttctggtccattcccaaggaactcgtgacggcgcggggtggcctgtggtgagtggggggccagaggcttccgcgcggggtcacacccccaccgccgtgcaagttgcagcgcggccagagccgggccaagtttcccaaagcccgtgtctccgcagcaaagtctgcaagaagttggggggacgcccgggcccgcgtgggtctcccaccgacccccgggccgcgcccctgcagcggctagagcttgcgaggcgtggacgccgcccggccggggccgcgttgctcggggaaggcgggcgtcccggggaaggggcggcgggcacgaggcgcggggcactcaccgcttccttcttggtgggctcactgcggagccgcgcccgaggcgcgcgaggcccgcccgggcgctggtggtggtggcggcggcggtcgggctcggggggccgcggcgacgagcctgcaagacagagcagcgggggtcatggcccggccggcgctcggg

SEQ ID NO: 627 - DNA, 81 bp, Homo sapiens
cttgccctcattgtcatcctgcttctgcctccctccaaggacagcacaaaggcggcaggcacaggactggctgaagggaca

SEQ ID NO: 628 - DNA, 164678 bp, Homo sapiens
tggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaagatagtaagtattaaggtttttgtttactgtctatataattaatagaaaccagctattttttctccattaaaacatgcatcacgtttaaagcactatggaatcctccaacctcagctctagtctaacaaactgcagtgttcagagaagataaaatgcccgtgattggtagagtctgcagtccagttgcaagcacctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaatttaaataacagtagccgctgccctccctgcaactagggcatgagaccctggaactgagcgaggcggtgtgtttctcatgcccttcccacccaagtcatgcgcaacgctaggcgcacactggacgtgctcaagaaatactttttcaacctcagcaatagatgggctcaggggcgagaggtttcagccaacagcatgacagagaagggctctgctgccactagcacagctgtgacaggtgaggaggcccgggacactcaccgctcggtggcctccggtagctggcaggcccgggcgcggcacagccgctgtgcgcgatggggcagtgcgagaggttgcagttgcgggcgccagccgaggcacaggtgatcacggagggccggttctgcggggaggaggggtgtcagtatgtggagaccagcttcagtaccgggcaccacccctggggccctccccagcacccttcaggctctgtcctggtgcccttcctgacccagtctgccacctcccacttcaatactggagtcctgttgctaaacacagccaatccacagagtgagcgcagctccaagggtgtgtgtagtggcccttggtcgtggctgtttggatcagtgagggtacaaaggacaaaagctcaactgttgagttggtctgtccccatctctcaaatctgttaagacaaacaccgggcatcctgtggaggacagagggttgcaggagggacctcgattctcccgttaacgtccccagagcccttcccatcatgtccactgagccgcgggtgtgcctggagccatccaggacacttcaatacacggcaattaactggaagcattttgcttgagccaaagccagctcgagttggcctcagtgatgacctacaaatcgggacagagaggaaatggaggaaatatgcctaagtgtggaacggcacacatcccaccccagcccgatctgccctgtgcacagcctcactctctccttcacccccacccccacgctgtctgcctggcaaactccccttgttccttcaagccctgttcagatctctctctgaagcctttcactggccaccgccccaccaccaccgcttttcactcctgctcccctaacccaccaagattcagcaagtgcatcggtctgtccaggtgctcccgtaagaccatgcacaccaggcagtatgtctggccccccagctttggtgtggaacctgggacagaaaatatttgtgaactaaacagaacttcctcaggttcccccaggaaaagtatcttccaatacccccgaggacaaggtggtggagtatgtgggctaagttccaggacagccagcaaggagctggttgaaatcaccccacagggaccaatggtgacagcagtgtcagccagagggacgctgggccttatcctccccagccagccctttccattaaagttagagcagtagctggtataaagacacaaaaggcttgcatgccagaccttctcatgatagacgacagtgattgggaatggtgaaagtggattctaggatgaaaatgtggatccacaaggatgaactgggattgaacacaaggacctgtgcttgggtctaacaagaagcgacacatgccagggtagggggggatgtggcttagcaacagcagaccaaccaagaattcagggtttcttagtggcccgacacttagcagcgggacagagctgcccagggttcgtacggcctccatggtgtgcacaggtggcagcgcagagagaacccgggcaggtggagctgggctgaatgtccacgttctgcctgtggacagggcctcgggtgagagacttcacaatgctgagcagacaggctcggaaagggggttggggaccgacagatgaggcctggagcagatctcacactggctgaccacaggggtcaagcagcagcaagagagcagaataccgagacctggacacgcacagagccaggaggaaggagggccctgcccctgtccagctctcagagatggccaggcccttcctgagcctggctgcacccatgaccttgggctctaggagacccccccccagggtcctcccaataaaactcccttttgtgctcagccggcttgttctttgcagcgagcgtgtcctgacccacgcaaatgtggggaactggggagacatttcgagcacagggagggggaatcaaggaagatgaagaaatgagctcactgtccagcctttatgtcagtctatccaaggcaggaaaggccacttcagaagagactctctaacaagggaccagcagggcaggctggctgactggtatcagaccaccttcagggcatctcctgacctgagctggggcgaattgccttaaccggtcacctgcagatgtgaagatgttcagtgtctgggcatcctctcctcctccccacaacccaggctgcagggtggcccgtgagccctcgtgggactggctccaccacccctcctccccagctggagtcaggcatcttgcccctgcctctgtggttgagtgcaggctgggactcgtccacctagaacgggccccaggcctccagatggtgagcgtttatgggatcccgaggctcccctcccccacacccttattttccagatggggaaaatgaaggccagaaacaccctgttggaagttacgctgcggatttgtggcagggccagtatgagccctgtcactaaccccttcacccgctgtcccacccacctgtgactgtcctcagacagaggctgccccgggggagagggctcccaccacctctcctatctgaaagcaacccccaaggctggctgcgccaaactttttttttttttttttttttttttaaagacaaagtctcactctgtcgtccaggctggagtgcagtgacgcgatcttggctcattgcaagctccgccttccgggttcaagcgattctcctgtcagcctcccgagtagctgggattacaggcacccaccaccacgcctggctaatttttgtacttttagtaaaaacagggtttcaccatgttggccaggctggtctcgaaatcctggcctcaagtgatccgccgcctcaaccccccaaagggctgggattacaggtgtgagccactgtgcccagccctcaatgtgcgaagcttaaccccatcttgcctctcctcactggctgctgcccaaggccaccctcttggtgtttgtctgtcctgagctgctatcacaaacatgaaatggggggacactttctgtagcctccccatacatgcccctctgggaactttcctgtcccagttcccagagatctgagacacattttctgccacacagaggaaggcttccaccgtgcccaccccacagggctgcagcatgcgtcctgcctgcctgtggacacagagctttgctgtcaccccaggaagccccctccccactgccatttccctggctctgagctgcaggatgacacccaacagacttccaggaagagacctcggagctgctggagcacaggcaacgtggctgcttggtgtcctcagcagggcgcccgagcccagctcggattggtgtgcatggcctcagccccgccacgctgccgcaggaaggagccccacgaatggttacgacatgaatgacatgtgctgacagcagccacggcaaggagggcaggactgaccaaccccagccgaaaatgacagctccggtcagggccactgtgcccttcccaggaaaatgggcagcttggggtaccccgtggcccctggctttgtcctcagtccaggccaggatcccataaagatatagctggggggtcgaggttcttcctcctaggaaagctgctcaggagccccaaggcacaaggaggggcccttgccacgtgtgccgtgggcagccaggcccattccaggctggggagagggagacagggtaaagagagtcaggccactctgttcagcagttcagtttttgcaaagcaactgtgaccgaaaaccaactgcaagattctcaagagccctgaagagtcaaggaaataaatcatccaagaacacactaagcccgccaagggcccaccctgaccatgtgggcagagatagcttgtaaggctcacagttatgtcccccaggtcatcaagggccagaggctggatgtgggtgctccgagattacagctgaatcctcccctccatacccgtgtccttcagggactccccaacagcagtggcaatggccagagagccaggttctgcctgcacggttcaggccatggctcatggcagcattacaatgcctgttgagcttcccaaagcagaaaggtccactgcccaccccggggagcagtgagcgggtccctgtgggtcgcactgcgcacacgcctctgttccagcccctgctgctgcccaacagcacaatcctctcttctcatgtccatttccccaattagactgggagctccctgtggccgtgacagtgtccacacacacgtctctggctgcccacagctctgctctgcagagggctgggtaaatggtgagcgctcgtaaaacgttgaaatgaacagcagtgataacttggcctcgggttccatcagacacatcagcgatctctcctccagactaaaactgagcgtgctgagaacaaaaactgcatcttgcttgactggcttctggtaccccctggcacacagcaggggtctgtgccattttgttaaatggatgaatcaaacaaacaggattaccatgtcaggctctgaggcaagatgggcaactgttctcagcttcaccaggattcccaagcaccagaaccacctctcccaactcccagggcctaccccacccacagtttcaacagaccccatcagacacggacaccaggcagtgccacttggagggaagccccggtgaggccacagggacacagaggctcttgcagctgaatgcacagagcccggaggcaccccctcggggcacggcaccatcctctctgtcagtcttagcaaatgctgactactgactaaggacctattaggtcgcagtccctggagattcggagagctcaagcagtaattttgagcctcctcaatgctgctgccttctcccatatatttccccaggaaccccatttttaaaaagatttgtttctaccaagcaagctgtgtttattaagcaatcatttaatttcctattttcctttcatagaaaaaaatccctatgtaccaatcataggcttctgaccagcatgggctcacaaccctgtgaccatcaactgtgcaggaccccagcccaaggcaaagcaacctgacatttcccttcatccgcgtgaccgtctaaaggagaaacgtaggacccccccacccgaggatgactacattcatcctaagagaatcaggcctgccacagaagactgctggaggaaacacctcagtacaccacccctgtactgggagaggaaagagatgaagccccagtgacattcaccttgcccaaggccgtgagtgctaagaggcaaggcccgggcaggtctgggcaggaagtaaaagcagaagaggactcctgttctgctgtcccttgtcccaagtgcacaacagaggcgaagggtggcatccctcaccacctccctccctcaccacctccctccctcaccaccgccctcggagtcctctgctcggggctctccatccagcccagtcccccagcccctggactccccacgccaccctcccagacagaggcccacctgctgccgctcccccggggtcagtgtgggcgagaggccggctggcctgctggcgtccaggctgttcttggtcagtgcgaggggctgctccaggccaaggctggggagggaggtgtacaggtggctgccgtgcaggctcatggtgggggccacagcgcgctcgatggggctgcggctccgctcccgggggtctctgcggcagtctccattggcagtcttgttcctgaaaaagaggaatgggcattcagggggcgttttctcaaaggcaaaggggacagtgactgtgcgccaggcactccgtgttgcttatttaattttttaccctgaagctcaggtcgtgtggctgggcagcacgatgaggagccggttgccagcccgggtcagccggacaccaaagcctctgggtgccggagaagctgctgccagcggagtccaaagtcagctccatagaagatggagcccccgactcagtggcgtcctctgcctgactctgtgttcacttctataataatctccactccctgggagcctggggagctggaggccaagctggttcgataaggacctgccatttggacaggacggggacgctgacaacgatccagagtcactggctgcgtcctacatgcagggccctattcaaagcctccacagcactgctcagcccatcttcctcacagtactgctcagcccgtcttcctaacagcactaagcaggcaatgctgccaccatcccctttccagaccagaaccccaagactcaagagtggtggaataatcagctcagactcccagctgacatgtggtggcacgtgctctggggttcccggggtgctgtagggagccggcgcgcagctctctcgtccaggacacacgagcaggagtgacctgcgtccagaaggtccatcactagccctggccatgtgctgagcacccaggcgatgccacgtggaatccaggtgagacagtcagcaccacctccatctgatgtgttagtctgaaggcagcgttacgtgttgcatctattagacaccaaccccacacaggtaagccatggccagccctggtccaccctccctgctttattccaggggtcccacagttccatctgccttgggtcttgccccttcaatccaccatattatccgctgacagagtaacctttttccgtaactcatgagctggtcatttaaagaaaaaggtggtgaattatgatttgagtgaattttaagaaatacaaattattttcagagtctacaagtagtcacctgtcttaactagcagaaaagcctaggcctgccctggtgaagcagcagccacagcccccgtcccggactggctgaatatgttacacacacaatgaatgttacacacacaatgttacgcatgcacacagaatgttacacacacactgaatgttacacacacgcacaccacacacacacacgcatgtgataggcgtacctttctaaaactgtagattaacttcagttgtaagaaacaacacacggccatcccatgcaccctttaccttgactcccgcgatggtgacatcttgtaaaactacagtacaatatcacaaccaggatatcgacaatgagacaactaccaaccttattcagatttcgtgttttgcttgtatccattccagagcaatctctttataaggcaaatccaaccacatccagcccttagtgaatgtttttagcagctcagcacgggccttggtagcctctgggcctgaccaccttcccgtcctcatctctggcttcacgcctccaaatgttgtgttccgtagttccaaccatctacttgccattcctcaaataagatgcggccactctctgcctctgtggctgtgtacacgcggtgccgctctagcctccctcctccccgtcctgcgctgccaaccacagctgcagtgtagaatcccaaggcgccccgtgcaaacctttaatacagaatccatcccccaccgtcaatgatctcttcgtctacgcacccgcccctcctcacacacggcagcctctgagggcgtcgagtccctcctgtctcattacgcttgctaccaggggtgcacagagacttaacgggtgaatgaagagaagcagcatatgggtgaccgtgtaagaaaggcaggtatcgtggagtggaactgtgggtgggcagaatcatggagagctggagggctgaggagtcaactggaggcgcattcaagcctttagatggaccctgcggcccagtcggtgagctgctaagggctgagcaggagaagcaccagagggggcctgagtgcagcctcggctgtgatgttgtgatgtcattctgcgccatctccagcaggggcacgcgctcagcttagtgacccgaggcgttccgagcctcggcgtccccatgtaaccatgtggtcacagtaagatccacccagaggactctaaatgggggacaaacagcacacaaacaaaaacaatcagagcggcgcagtgcagccctcagtgagcgccaagagaaccctgtcagccctaaaccgagtatattgattatagggtgattagctgtacaggacccagtattcgtttatggggtttttttcttcccctttattttctggctgatgatacagaatatcttaaaagcaattaaggattaaatgttcagcccattaagacaatcatggaagagaatgttctggcagagtctagatagtaggttccatccacgccacacacatcctggcgattttcaaaacgttaaaatactaaaaaccttaatactgaaaccagcctgtccataatgtcatctgtctgtggcgattcagaagacagcacaggtttctgcaatgaatgcctcaagggttatgatcccagacaccgatgtcaccagaagaccttccgcggaacggacgtcaggccaagcagtcctgagatctgctggcttctacctaaacgggacttggttcctgaatactcagttcatcagtgtcaccacacatcctcatcttcagtgtcccgctcccttctaaattcagataaagatacaattttattgttaacaacatgagtgaatggcttctctccaccccaggtgatgcttccacgggccacttcatgaagtgcatagacctgggggctcatgtcccagattcaggagagcctcagacacagtctgcctccgaatttagacgtctgtttactcaaccagcgctagttaagtccctgttctgtggaggttccagaactgcagggttacagccctgccttctcatgggcttacaatctagcagggacagaaaggcccgggaggggctgcagctcccaagtgacagctctggatccgggcaaggataaagacacccccgggtggcatggaggagcagactaaaggtcaggcgtctgcccatgtccaaagccaaagtcgtggtacataaggcactgcccacccctcgcaccttatgtcctaggggcacggcacagtcacgcagatgactcagctgcgccttaggaaatccaagcatgactatgagaccacatcacagaggaaaggggtgccagggccgccagctgccagggcagaggtaaggacggggcagccctgcacctaaatctgccatctatgctcccacagccccactgtgcgcccaccctacgcagggcagcagggagaaggggacttccaggcccactaactggaaagacagtccgtggaacacagcacagtgggcactatgggtcagacaaagacactgaaaacagcgagaaaaggcctggagaactggctggttaattttagtaaaattatacattactcacatttccagctcattttcctggttcccggagcttcaagacagacattgttttccaggccccgctcgcccggatgaatcacctcccggccactgcttcccaggcgtcatgtgctcccggggacggcagaaaaccgcacgcatcctgcccgggagatggaagtcgcctccgctcctggtcaggactgtgcccgagagagcccacggcatccccgcgaacacccaaaggactctgagtggctccgtgccaggcctatcagagccgctgaggctgcacggcacccggccccgccccgggcctcatccccatcctaggcgggcacttccactgccagctgcccacggagagaaagatggaaagaggagggagggaaagagaggcctacaacaccatcatccaggacagagctttctgagtactgaaagccacacgctctctaagctaagaaaccaagaatgtccataacatctggggaaaagtaaaccagattccaagcagtgacattgaaagaatccatcacgtgaaagaagtgcactgcgtctatttgatactcattaaaatgagtttcccaccctccaacaaacgtgctttgggatgcttagcccttagccccatcacctgacgttctgagcctgcgctgggcttcattcaccgtggactgccacaagctacactgatctgagtctgagttcctctgcctggggagggggtatgggtacaagacattttgaggatacattctggggtccccaaaggcccctgagcaccatggcatggcaggtgctcccacccagtgaaagagatgaggcccagggcagccttgggccctggcctcccaaaaaccaacatcctgaggcggcaaagcagcccgtccccatgccaggcgttgcctggcaggagtagaatgaaggctatgcagagacatcccccaagcaccagagtccaggtggagacaagagattcaaaggaggaggggccggcacagggccagtgagtgggccgggacacagccccatctccagccctttcgtcctctctctcccaccgcagcagttacaggagaatccgacatctgagaactggcaggacagccagtcgttcacacagtcttaacacatcataatgagactgctggctgggcatggtgacgtgcacctgtggtcccagctacttggaggctgaagtgggaggatcacctgggcccaggaggtggaggctacagtgagccatggtcacgccactgcactttagcctgggtgacagagcaagaccctgtctttaaataaataagattgctagcacatctttaatcttaaaaagcttcctcagaaaacagacttaatgccactgaagggtgccctgaaacctggttaaagtggtcagctgtatgctctgctaatttactacagctttttaaataataaaattttacctgaataatatagacagaacttcctcccaacctttacctgctgccccctggggtttctgatgtgcacagggcaggtcagcaccatcccagttttacagaagagatgaccaaggtggagaagatgaaggctttgcctagacatgctgcccaccacagacaccggccctgtggcatcagccgctcagggtcgtcacaccaggcccaccaagagactctccatcacctcgcagctccatcccaagctgccaggaggcctttccgacccaccagcaccatttccacccaccttcctgccccaactgcagagacacaggaaaggagcagtgcggagatgccggccaccaaggtctgtccccggacagtcctgccacgctggctttctcagtcagtaagcttctgaagcacagctcccaggggaccccggtccctggctggaccgtgcactcccgggaaggctgacactgcagcccccacgccctaatctccttggctccgcacgggtgaccacataccagatgttctaataactgtccatagagtaaataaatcattaaggtacacatagtatgtgtgagtccagttaacagcgtttgtggcaaatgacaagggagttaaggagatttcagagaaaatgactggtggcaaagacttttttctgaaaaagcaaaatttaaggaacatttaaatgttgggcataaacagtggtgagatgtcttctcccttttagtcccttcctccaacttctgttgtcctcctcacctcctccctgcttctaaatgtccccgagctcatccaaagcaccccacaacacacacacaggagtgaactcatcaccgtggcttctctccccttgtgagtgggagaattcactgcttcccagtgagcaacaaggtgcctgggtgtgtccccaagacatcctggtcaagctgcgtcactcctctgtgccaattttagacgggaagtgagggaagtggttgcaaaggaaggcctgggtgaagacgatgtttgccgaggtggcggaggctgaggcagagacaccctcctaagtacaaatggcaagaagtgtgtcgtgggcaggaaaaagctggcaaaataccggcattcggactgtcccaaagacagagatgaccctgaggctcctggcttcaatagcggggtccatcctcgctggcagggacacagggcagagactgtctctgccttctatgcgtcagcaactactgccatagcttaacattgcttaataattgaaaaaaagccaccaaaaagtcaagggaatgaaacccgagtgcgaatgccgccacagccagcatcactgccacaaccatccacccacgtaatgtttcccccattaactctccataaaggggccaggtgcagtgactcacgcctgtaatcccagcactttgggaggccaacgtaggtggactgcttaggcccaggagttcgagaccagcctgggcaacatggcaaaaccccgtctctacaaaaaatacaaaaattagctgggcatggtagcgcctgtaatcccagctactcaggaggatggctggagcccagtaagttaaggctacagtgagccatgacagagccactgcactccagcctgggcaacagggtaagaccctgtctcaggaaataaaaataaaatactccccacaaaggtagtgtccctctttttgctggttcagatttcagaaatcaactccatggacccggcaacacaggactcatttgctccatctattgcgagacagctgtggcttgcggtcccagcgtgagaagcctattggccgggcacagtggctcacacctgtaatctcatcactttgggaggccgaggccggcagatggctttagcctaggaattcaagaccagcctgggaaacatggcaaaaccctgtctctactaaaaatacaaaaattatctgggcgtggtgtcacgtacctgcagccccagctactctggaggctgaggtgggaggatcacctgagcccaggagatggaggttgcagtgagctgagatctgcaccactgtattccagcctgagtgacagagtgagaccctgtctcaaaaaaaaagttggggaatctctgagtaagtgattgacgttgagtatctttattatcatcagctctcatttattgaaggacatgcccaatcatatgctagacctcatcttagtaaattcactgccccactgcaaaataagcatcatctccattttacaaataagtaaactgagcttgagagaggctaagtaacttttctaagtttacaaaactagtacaacgattccaatatatattggactggctccaaagcctttccattttccgggagggaggaaaatacaaagactcgtgtacctaccactcagaactagcaaatgaaaatgtgctctcatatttgcttcgggccttttctttcctctggccatgatgaaagcagcagaacatgcagacgcatgaggtccctgctccaggccctcctcagtcccattcccctctcttcgtcccctggggcatcctctgttttgtatttggtgcctcctgctacctgactgtcgtcctcttgccacacgtggatgtgtccggaagcacacatccgtcgcatgcttcacactccagcatgccagcacactgtatgtcttgttgtacaaccgtgtctttccctcatgttggtcttggagctctacccatgttccaacacagagacctggcttatccatgttatttgcctgctctgtggtattcttccatacgaatacaccactgcatatgtacccgttcctttatggaccggcgcctgggcactctttggtttttccttctgaaaatgacccccgtaggccaggcgcagtggctcacacctgtaattccagcactttgggaggccgagacaggtggatcacctgaggtcaggagtttgagaccggcctgaccaacatggcgaatccccctctactaaaaatacaaaaattagctgggcttggtggtgggcgcctgtaatcccagctactccagaggctgagggaggagaatcggctgaacccgggaggcggaggttgcagtgagccaagatcgagccattgcactccaacctgggtgacagggcaagactccgtctcaagaaagaaagacagacagacagacagaaagaaagaaaagaagagagagagagaaagacagacagaaagaaaagaaatagagaaagaaagaaagaaagaaagaaagaaagaaagaaagaaagaaagaaagaaagaaagaaaggaaggaaggaagaaagaaagaaagaaagaaagaaagaaagaaagaaagaaagaaagaaagaaagaaagaaagaaagaaagaaagaaagaaaatggccccatagtgcttaagtcctcagacatgtgtcctggtgctggggacagggcttctgacattctctcaggtcagtatttgcaggtcatccaccttcgacttcaacacatgtgaccagaaaccttcccaaggcagccatccactttgctgtccctccgacggccatggctgaccactgctgctgctgtgtatcctcggtgacatctggccttggcagcctatggatttctgccattctcctggcatgaaatcactccttcttgttgttttaatttgcatttcttcagttaccagcgcagttgagcatcttttcatacacttactgaccattctactttatgctgtgaactgcctttaatttctgtaatgggttgaactgtgtccccctgaaaagacattgaagtcctaaccccctaggttctctgaatgtgagcttatctgaaatagggtctttaccgaagaccaagtaagctgtggttatgagggcgtgctctaatccaatgtgactggtgtcctattagaaaacactggaaatctggatacagtgacagacacatacggagggaagaagatgtgaagacagagagaagaccgtcatcaacaagccatggaatgccagaggccaccagcagctgagagaaaggcctgcacagacgctccccacagccctcagaagcagccagccctgctgacaccttgatctcaggcaccaggaacggtgagacaatacgtttttcttaccctaagccaccccatctgtggccctgtgttatggcagccctaggaaacgaacacaattccctaggccgtacccacccgctgccttgctttacacggctttagatatttgccacacccatgtttcttctgctttatctatgatcaacctaaaagtttttaaagcttcctctggacatttaaagagaggtcctgagatccactgggcctcggtcacctgtcctgtatgcctgtcatcctgaggcactgcacgagcaccgcacaatgacagtccaaacagagaccagagctgggcaggccaagtcagcccagacctgccagtaagaagctgagagttccagaggctgggaagggtagggagaaggtaggggctggagagatttgctaaaggatacaaaattacagccaggtaggaagagtaagttccagcactatggtcacctagaccactgtagggtgactgcagttaacaataatacactacacagtttcaaacaacatccatatattggatgttcccagcacaaagaaacgattaatgtttgatggaggctaaccaccctgagctcatcactctacatgacacatgtcgaaacttcactatgtaccccatgaatatgtacaattactgtcaattcaactatatatgtgtgtgtgtgtgtgtgtgtgtgtgtgtgtgtgtgtgtgtgtgtgtgtgtgtattttaaaagctggagggctagctgcccccaaatatggttcaggaagccaggaaaaagagccccatcttatgcgcctacatacaaaagggaagaagcttgtcggccgagttaccatccaaaacccttttggcttggtagtgtttggggaggatgaaagaataaagccgcagatcttttcattactcctgcatctcctcctctctcttcttcaacgctcgtgccaaccccccattcccactttacaccgaggaaaagtggattgagaggtggagggatctgcctggggccatgtggctggcaggtggcagagtagggacttgggtccttgctcccctgctgccaatgcccggagggtttcaaaagcagctcaggtctgtggtgcgagagggaaggcggccgcactgagtgctgtcagagcaaacgggcgtccattctgctgctctcctgtcagtgtggactctgtctctctaactgcgccaagggtttccagtcactgtgctctcaagagtgacagtcattaaatcagcatagccagcatctccacatgctccagccttcgagtttcttttgactccctccagcagctcagctggaatgtgcatcgtgtgtgagtctgcccctctctctccttgagactggaaggagctccgagggcaaagtgggtccctcctttccttgggcacaatcggtcctcagatctgtgcaagggacggaagacacttgggaaacctggcggatccggaaccacagtgtgcacttacccagcggcagccgcttaaagaaagatcccagacaccagccttaggagagaaactctaagtgattttagttagagacctgtcggaaacgctgctgctggaagtctccatctttccattctccctatggtggcccaaaaagccaggtggctggtttggctagaatgaggcgtaaagtcagagcaaacaggttctgagtgagtctggggccaacccctgcaactttcccatatccaattccagcattcagagaccctctttgcttggcaatgtgtgcaggctttccagacccgttgcctctagagaggcgggactcacggaaatgctggccagcagcgcggagcccgtccaggttgcccagatcctcaggtcacgtttctgaatagctcaactctatgtaaataaggtaccagttttctttaaccagaactgtctacatgtgttttccattattagctttagttttttaagaaaaactgatgtttgagaaacaggtcatggctgagaacatgaccggtaaagcatctcacctgcccccacgttagcaactgttgccagggaagtagttgtgagagcacagccagcagtggatgcccacctgcggccatgacccccagaacttaattcagatggggcaggaatccatgtgcatgctaagcactgtttacaggcaaaacagatgtgtcccacattagagttttcaaatgaatggagatgttgctgagattaataaaattgaaaagaatttaaaattcctactgctaatttgtagttgtttttgtcattatgtaatctctcaaggaatatgttaaaaatacaaccactatcatatttttgacattaaatagagtccttgtatcacagaagggatgaaaaacactctatctttccttcctcactgagctgcagtgtctgaggtggacaaaaccctgggagacacggcgatctctgcacagcagcagaggcatcagcatgtcggcatcctgccttgccatcctccggggactacttgagacagctgaggcgaggactagagggaggggtgaagaaaaggcatttgaccactaagaccatccagtgctagtcaacccagacgtcctgttctccctgctgcttcactccaccccacaccctcaatctgactctgagctccgctggaaaggcctttcctgtgctggaaaagtggagggcaggacccactgcctccgatgcccgcctcaggaaggcagagggtggagagagagcccatccaccaactcaagactaggagagaagacacattccctctagacacccctggagggaaacgggaacagtgtctgctcggtaggctgctcagaagtgtctgcaagtcactgtctagaacagggcctggcacacaactattttatgaatgagccaaccgaaaactaaacaaattctcaggagaaaccagcagcaacaggttagagtcagacagaggagctcatgaagctgggtgacccagggctgggccatccatggccctggggctcctggggaaacccaaggagaacagccctggccagcgccaaccccctagaaacgagtggtctgaggagaccttctgccattccctctctcgttcttgcgactggcactgtcatctttcaaaatttcaaattcttttgaaggctcactcttagtttttactccatattatgcagcaaattgctggaaaatattataaaactgtttagtggccaggtgtggtggctcacgcctgtaatctcaactttgggaggctgaggcgggcagatcacttgaggccaggagttcaagaccagcctggcatggtgaaaccccgtctttacaaaaaatacaaaaattagccaagtgtggtggtgcatgcctgtagtcccagctactcgggaggctgaggcaagagaatcgctggaacgtgggaggcagaggctgcagtgagccgagatcatgccactgcactccagtctgaacaacagagcaagaccccaccccccaaaaaaactgtacactggaaagattggatgctttgtccaactcaggagaacacttcacactaaaatggttttaacaggagagagatgtggaatcccagcctccctcaaggagcaccacacagctgctgcttaaacactatccagacagctgcctacctccttcctaaaggttctccctcctaatgaatgaactctgccttcaaatacaattctttggtcccaggtctgccctttggaaaaattcaatgaatcttatttcctcgtccaactactgaaaaggacttctatgtcaaccttgccatgcccagaattctccttcaaattactctgacacaagactccttatccaacctgtcacccacagggcacatgccacaagtgaacattcatatttaagagggtcacactccagaagcagcctaaggaaatagggcacacaggcaaggactcactcccttccatttatcgtagcacgtttctgaacgaaacaccagcgtagacagtctaataaaaactaacctaaagcatcaggattattccaagacctgcagtcaccagtactatcctttcatcaaaacaacccaagatgccagtaggcacttccacacccatgttgcacagtgtggtcacataaaagtctccaatccttttcttcccattatttcagctttgtgaccccatactggctaaagaccagacatgaatgagtgcgtgcaggcatatgagagacaaataatcagacttcctttctgcgtcacgtggtgtgtggcagtctcctcctccccacacaccggagcatggtcacaactgcctgaatgccagccgccttcccatggtccagccctaaggttggtaggaaccagttcgaaattattttgtggacttctccgtactacaggaagacctctggttcaataaatttattcagcactaaataaaaatatcaaacctgattttcctcttaaagttaccgatctaccctgactgaactcagaaactctgcaaaaaaaaaaaaagtaataataataaataaataaaccccaaaactattgagctaaattattatacacccattgaaaatttgagtattgagtatacgaagtgattaaatgctcatctagtaagagattttgaggcatctactgtatattttctttttttttttttttttttgagatggagtctcgctctgtcacccaggctggagtgcagtggcgtgatctctgctcatcgcaagctccacctcccaggttcacgccattctcctgcctcagcctcccaagtagctgggactacaagcgcccgccaccacgcccggctaatttttgtatttttagtagagacggggtttcatcgtgttagccaggatggtctcaatttcctgacctcatgatccgcccgcctcagcctcccaaagtgctgggattacaggcgtgagccactgcacctggcctctactgtatattctttaaagtactaatagaccgtaaggaccttcctcctgagagccaatcatgtagtgtgttaattctcaacatgaactgcctctgagcatccaggtagtcagggctacgctccatctttccaaaactagggggaaagggttggccaagctaactttctaaaaaaaaaaaaaaaaaccagactgctttacagaaacaagatttacattacttaaagaaaaaattattttgaggacctccaggtacttagcaaggctactgctttactgacaatggacaccctaatgacaaataaagcagagttcccacgggaaaaaaacagtactgagagcctatttcattgatctgagttataaaactgcatttcttttaaaatagtctcattttcaaattctgcaaaaacttcagaactaagctatctctggagcttcactgtaacatcactcacatctagatgcaaccccctggctataaaatcatatttcacccagaagtgttcgtctgtggagtgtgcagtgtggaagactgaaaagaacgtggggggagttcaatcattccattcaacactgaagtggcatctcttcccccaaactcgtgagttgatgattcaaataatgcctccagagaattcagaagcaccctcccccccaagtttcatgcaccccaagtttcatgcacctttcctttgtacgagggcttccaaaccagatggtaatggtgactcttcactactctttgaattaaattaaaattaccacccccggtggtcatcacgcatcacatctgtcgattattaggcaccaaatactgtattcctggagctcggtctgccctccaagctgcctgactctccttcacagcctcagtcaccccagatgagtatggaatataaaggattcacacacaatggactcattaatgtttattcagttgacctgaagttggtcatcacagtttttcatattttttttactatggtaaagtactacatacataaaattcaccacttttcagtgacaataagtacactggtatgttgtgccgccaaccgcaccatccgtctccagaactttttcctcttcccaaactctgcactcattaaacaccaacctcccatttcctccttcttgcagccgctggaactaccattctaccttctaggactttcactactctaggaacctcatgtcagtggaatcatacaacatttgtctttccatgactggcttacacaaggtgcatctgtgtggtagcatgggtccgaatctccttcctttttaaggctgagtaatattccattgtgtgtacagaccacatttggtttttccattcatccggtgatgagcacttgggttgtttccaacttttggctattgtgaataatgctgctatgaacatgggtgtgcaagtatccgttcaagtctctgctttcagttatttcgtgtgtatacctataagcagaattgctgcatcatatgataattctgtttaatgttcaacacatcattggtagtaaaggaggtgggaagtataggatgcatttttcatttaacgtttggccctctctactagagaaaaattaaaggtttccaaaaggatggatcttgtccacaacaataactgaaattgtaagcctttgtgaaaacagcccaagtggttcatgagagaaatgaatgttcatcaataatgtaaacactggacataaaagttaaatcaacaaagaatattcaccacccagctcactaaatccagcaaacttgggcacacaaggggcccactggagtcaatgatgttgtaatcaacagtgagcatttcggagacttataagctacatatttgtggttctcatttctcactgtgaacctttaaaaattgtttcaagtcatcggaggatggctaatgttaacagcaatacatattgaccatttgtataacattggtgtacagtgttacaaagtgctttgcatatacattatgttaacagatcctcttcaatctgcaactcctttttttttttttttaaaaaaaaagataactctttctctgtcgccctggctggcatgcagtggcacgatctcagctcactgcaacctctgcctcctgggttcaagtgattctcctgcctcagcctcccaagtagttaggattacaggcatgcaccaccacgcctagctaatttttatatttttagtagagacggggtttcaccatgttgatcaggctggcctcaaactcctgacctcaggtgatctgcctgcctcggcctcctgaagttctgagattacagacgtgagccaccgtgcccagccatgcaacttctctttaatggccagaaagtgcatttctcgaatgatgaaactaaaacccggagggtcctcatctgtgcaggcaggtgagcatacctagacacccggccctcaagcagtcacttactccactctccattttcaacccagcttcattcggaacaaggaggggacaaaagggtgggaggagaggctgctctgtggaatgaccgtacaagttactgagagatgaaacaaaagcattcattttctattaaatgtgaaagatctctcaatctctaattggtcctgcactctaaggcaacttagcagggactcaagtacaatttccatggagagaagtggtcaaatagctgaggtcaaaccctccagactccaactgcagccaagtgcttttatttcccttgtaattttctttaagaataaatgttaaacctaaaacatacccccttttggaggcgatcttggcagctggactgagtgggaagaaaaagcaccttgtactccccgaatcagcagccaaactatgcaccattgtctagaggcggtcacatgacagccatcacctgaaacttggttacttccaatccatgaaggaaacaatcactagtgtgccttaacccttccagctactgcaggcagccatgctgcagctgctctcagcagccctctctcccattccagtccccgcttaggagaaactgtgcatggcacaaatctgattgggacaaggtggcgtttggggagaagggagggacgagaaggaaaatcactgctgtcccttctaagcaaagactactctacctctcccagcacttgctgtctcgcagtttaaattaattacagctgaaaatacagggttgccatctggtttgaaaaagcaaggataagggaataaaatgaaagggttcttggtactaacctcactttaatcattgccaaagagcatgaagacagcccagcgtcctcccacaagaaagccttgggcctcacaaacttggcaagcagtctcaggcacaaaactggatgggcgggcgcttgtcagaataaaagtcctccctgaaaggagggttgcgaggtaaggggcctgcttgccccctgcactgcaataaaagtttcctatgggtcctggggtaggtcaggaactcctgggagggtttatttatagagggtgccttgccaaaacgctacacgcatcattacagttccatttggtgagaaaatagatttgctgtcagaattacagcacgcgatttcctctttctttgtttctccatcttccataacataaggcttttataaaacttcaaaataaggctaaagaaaacacaggagaggaaggttgctgcagaagtggagacgctccgaaggcacgatgcatgcaactccacagcagggctgcagccggcccctcagagaaggaatgccagaaatcccctattctctgctgcagccgcaactacagtctcactcctgcactgtaggaagcaacttccttctgcctcccttccaccagcagaaccctaggtgagaggcttttctcttaggactcaggctgccacagatggtgactccaggcactggagaagcaaaggtgccacagccatcctaggtttgtcttggtgaacttacaggtgggtgcaagaagttgctaagtctgcagatgtcttagccatacgccagcatcaagtagcccggagaagtgaagcagaagattttcagcccaatttaaatttccacctgcccactacctgagttcttttacacccaggtcagttttgcaaacaagaccctgatatacccaagcccagctgctttcagaaagtaacaccaattgaagcaccacggtatttatcagagtaaactctgatcaaccagatatagtattttataaaccagaggttctaattataaaagacaagataaaagcagattatgaaaatagcatttctgttctggtgaaaaacacatcttcaaccccaaaatgatgtgaaaattgtcttccaaatcctgccctgacagaatcactgtctatagcaacagtgtccataacattccaaatctcaggagtgtaactttctagtaaatggtacatctgtcaagccacaggaaacatctggtaaaatggttaaataaaagcagaatttaaacttttctgatttcagagcttactaatggtactcaacaagagactatcaaatactctaaaagctcaatgtgacagtgaaaaatatcctggaggggaccaggtgagaaaaagaggacaaaaaaagaagacaacccgggaaggagtgggctgcaatcccactctcgtcacgatgacgatgctcccattccaggcctgcctctgggagacagtggccatagccccctcagctccgccaaggatgggcacattcctgcccatcaccatggcagaaaccttctctggcctagttaagttcctctctacccagggctgactcccccaagcatactcatatctccccaacgcacccaacccaggaggccctcaggagaggtttggggggatggactgacgaagtgatgacacacaaacaataagcttccctccgctccacggcagacatgtgtattaaacacatacaatcattctaccatcaagacacacccaggccaggtgttacacaatacatttcagtcccttccagaacattttacgaggcttttccattaaataaaagatttaatgatttggccacatccaaattttaaaaatctatatttcaaaaatacagtaaataatgctgaaaagcaaataacattacttattttccccaacgcatttgacagagcatccttaatatgaagagtcgtaacatatcaagagaaagaagatgaatactctaatttacaaaaaagacaaggtataaacaacatcatggtcacagaagaagaaatgcaaacggccaataaggatatgaaaacatcattcaagttctctagtagcagaaaacaaacaaacaaacaaaaaaacacacaataacaatgtttctccccgagaaacttgcaaatattatataaatgaataaatggtagcagtcacctgtgggaagatgccgagagagagacagatgcatacagctgctggtgggaacagatcagtaaaccatatagagtgaagctggcagaacacaccagcgaaaacagacatggaagacctctgacccagaaattccacttctataaaagtgggaatatatgagatgggaggaaggatggagatattcgaagttctgcaaatgacagtaaaacaatgtaaacaacccaaatatctgtatttgttaaaaagttcttttggttacaagcaacataaaacaaacctagtttaaggaaaaaggggcaacttactggaaagatactgtgatatttcttggaaatgaaaaaatgctgaccaaccaatccttgaaaagagaaaaaaaaaaaaaatgaggtggccccagggatctgggcttcaggaggcggaaggcgcccatggtgggtccatgtgcagcatctcaccagagcctgccttctgccctctcccagcacccagggatccaccaccaccaccaccaccaccaccggctccaagtgtcacaacttggtgaccttcctaggtcctatgtacatatcatcctccaatcactgctccattaaggagttattaacatcaagtcaaaatcccaagaacactttttattatacatcaaatatgctgctaaaaactagaacatgccccaacacacacttaaatgctaccagttttcacagtcaagagacttcactgggctggacacagtggctcatgcctgttatcctagcactttgggaggccgaggcgggcagatcacttgaggtcaggagttcgacaccaccctggccaacatggtgaaacccagtctctattaaaaatacaaaaattagcctcatgtggtggcgcatgcctgtagtcccagctacttaggaggctgaggcagaactgcttgaacctaggaggcagaggttgcagtgcaccgagattgcgccactgcactccagcctgggtggcagattgagattccatcttaaaaaaaaaaaaaagagagagagagagggagagagacttcaatggagccttgaatgaattatttataagtaaaaaattgagggatctcccaagagagaaatctattatggtcttgtttcagatttgtaggtttaaggagaaaaagggacaggggaatgttccacctctgccatgaataagatactggattttttaaaaaagtaaaactgctggaattgttggctagacagagatgagcctttggggcaggaaatcaaatattatgaaaaggtgatttatcttagagcaggcatgaggtgtttaatttattccatgtatctcgccatcttgcattccaaatcttctgcctcctccaacagctctcttgcttcccttgtcctctttctgaatgcacacttcccaccacagaggaaccacacatatcctaaatccctcctttatcatatacaacgtcacccctcccagtgctgatggacaggcgaccccctgccgttggtccctgggtgtttcaaagagaggccctgaggagctgacactccagagcagtctctgggtcccctcttcccatgaaagcccccaacccttccccctgcaaagtgggacaactcctagattaaagattgctagaaaatacaatgactaagtgtagtgtgattcattactgaatcttgaattaaaaagaatgtaaaagaattttttaaaaaatcttaaagtataaagggcattactgaatatgaaaagatgatgtgagatcatatcattgtctgcacacatatgaaagaaagataaagcaaatacgggcaaatgttaacaaccgatgaatgcagggaagggtatgtgagtgttcactgtgctagtccttcagcatttctgtaggtctgaactttctccaaaataaaaagtatctatggtgaggaaacggtgcaggaaggatagaaagaggagattatcaccaaatttggctggaatatgtagaatgatgtgatttaaagcacaggtaatatggtatacactgccctccatatcctcaagttctgcatccacagattcaaccgatcatggatggaaaatggagtcaggcctctgatggtacagacttttttcttgcttaggaataataattccctaaacaatacagtataacaaccatttccacagcatttacattgtattaggtataagtaagctagaggtgacttaagtatacgagaggatttccataggttatctgcaaatattatgccattttacacgagggacttgagcatccttagatttctgtatcctcgagggtcttggaaccaatctcccaaggatatccagggacggctgtatatgacaatcgctttgtcgggagccctcaaataatcttccccaagagttggcacagggataccaggaggagcctgcgtgatggagagaggcctgacatgcatgaaaagatgccactggcaacaaatatgttagtttcaaatattagcctcaaaatgaaagtcacaagggaagttggagaatccaaactgcttgccctgaattgcacgagacctgcttctcacacagacaacaaactctgtgtagcttgccgaaagtcgagaaataatagcagggatttaaataaattattttgaaattaaaccatggctagtggccaaagagactttcaaggcaaggccaaggaggccatcttctgagtaataatactgggagagggagtttgggagcagatcacaaagtccttgatggtcatcctaaaggaactgtgtcttatttcacagtccaaagggggccagagccacaatccagtgataaactcagcaaagtcctccaatgaggttctagaggaatccctgccgatgaaggagctgcatggctcaggcgcctttcagcaatgcctcccctaccaagcgtagccatggtagacagtcagcttctaggtgacatggagtgtctgtgtttctatcactggacgtaacttgctcaaaagccaacggcctaagacaaaatgatgtggtgtcattcaaaaccaacacacagaggatgacagctattagtgatacaagcacaaatctgtcacacaaaaataaaataaacgcaacaacaatctactagaaaacagccgaaaaacactttggctttgaggactttttggaaaaatttgaaaaataccagaactggtacatacttgggccgagatgtgtttgcttttctagcagagtatgagcaaatctgcactttgggtcaatttccacccaaaagaaatgtctggtcatctctctgccctgtgagactcaacccaaatgcactgaattcctcactttcatatacctcactttatgttcacacttggactggagccagatgcataagcaagaaatacagaggagtgaaaaaaatcatttcatccacacaagaaacctggggggcttcttactgagagtcaacaccgggatgagatcacgtgccgtgaaagaagcatcacgggcagggctggtgctaccgactgaacctcgcgcatgtgtgcgttttcgttttctgttttcaagagcttagcagggaaaggagagcggtggcgctctgttctggcacatgtggaagtaaacatcaaggctctaagggagaaaatggaagtatactaagtggtgccactcagggtttatgtgggcttaaaagtgattcttaacatctgtcccaaagggaagagtgtttccacagagctctcctcgtggctcctttttcattcacacatttactcagcacctggttggtgtcaggcactgggagggtatagtgctacagacctgagcaaattcagcccctggtctggtggaacttgtagaccagggaaggggacagacagctggacacccaactgtagcagagtgtcatcgttttacacaaagtagtattcaccttgaagcaggaggaagtgccacttgccagaggaggtggctttcagaaccacactggaggatgaagtgagtgtgcaggcccccagttgggctgcagcccagggggtcctacaggcagacgcccatggagatgggccttggcagtgtcaccctgtggtggactgggagccgtggaaggattccaagcagagatgaatacttcagaaaccaccttctgacactcgagcaccagtaagaccagccaggagggcactgccgtgcaaacagggggctaaactacagccccagccagggcctactgggaagttagcaggctgatccacaggcaatgacaggaggaaggaggaggcaacgtcccagacaaatggaaagagagttgtatcagtcatgaatagggggacagaaggcaaggagtagacttggtgaagtgctggaagaacaatggagcagctgatggcaattccagtgaggcggtgctgaatttagggcacacatacaacacccagtgagagggtggatctatggggtgtgaaggcttggtctaggctagaggtaaagatgtgggactcaacctattgtggcaagtccagccacgggttcatgtgtgacttggttataagggtctgtgcaggcagaatgccagagccctggagaataccaataacaacgagtctctggaagatcctgaggagtggccacagaggtgggaggggaccacagaaagccagaaaagggccacaggaagcaggggaggagagcccttcagggaagaggaaatcaaataagacaagggactgcactctttcctgaacctggcaaccagtaggtcactcctgaatgcagggagaggattcaacagaattgttggtatggataacagcactggactagggagtggatataaaagaacaggtgatctctctagaaatagctatggaggcggggagaggtagggatggaagataagcaggcacagggtcaaaggaggacagaacctcaagtttcctcaatttctctggcctcagtgaatttctctgaaagccccaagcattaaagatggcacccagcagccccaagtcacggaattaaacaccatttcatgttcatacttaaactttacagcaccagagccttgcaagtctgaaggtttgtgataagagaattttggaaccaaataaaatgctccttttgttaggcaatatttatggggcaagtatgctccaaggaatattaaaaataggtcttatgaaaaggggatgaaggattctgtcttagcttgagctgccataacaaaatactgtggacttcgtgacttaaacagacgtttgttttctcacagtcctgaaggctggcagtctgagattcggacgccagcatggttggtgactggtgagggcgcttttcccggcctagagacagccgccttcttgctgtgtccttatgtggtggggagaaagcaagcaagatcgctgtttcttcttataagggcactaatcctaacagaccagagcctgccctcatgacctcatgaaaccctcatcacctcccaaaggcttcatctctaaagagcatcacatcgggggttgaggcttccacacgagaattttgaggggacaccactcagtccataacagattcaatggccaattccatttgagaaactcggctaaacagtgtttctgcgcataagacttctcaaagcctgaaaggtgctaacatgcaggagcagacctgggagactgagtttgggaccaccgaactttgaccagggaacacttccgtttcccttagagcatcttgagagaagagtgttttgagacagtctgagcagtggcgaggggtgtcactccagttgtcagatgcagctgaggaaatgactcctaacaagctagaaaactcataaccatccctagttgggttcaatgacatggaaatttagggatgcagcaagatttcagttctcagatgtgcttctacattgacctgacgtaataggagttggtttgtcctttctacttggccttgacccagtttctggagcttgtttctatgtagattcattagctgcattattcttaggtctcttcaagaagaaaggcaagaggtagtataagaagttggaggagagggcagtagcaacagttgcttccttctattctgcagtatgtgttgcctctgctggggctggaaggctcggatccagaactcagatcccttgtctggcacagtttctagctactgccagacccagaacattactgcaacattaagccctctaattatgttttggagacaatctgtgaagaaatttcaaaatgaagagtgtgtgtgtgtgtgtgtgtgtgtgtgtgtgtgtgtgtgtgtgtgtgttttaacccatagaaacagcaaaatggagagagagcaagacctgccatttaactaaaaactacaccagatacagaatgtggagcttgtaaaccaccttgctatgttccagctgccatgtgacacaagcaaataattgctttatcagcaagaaattagaggaaaataaaagaaccatcaatagccacacctagccaaatttgttagcatttctcttcccagtcttcaatcaaatctattaatgtagatttgggacagcacttcatatacattcaggacaaactggttttgtgtcacagtaagaggtctatgaaggtcacaggcaatgtcgaggttaatcctctagctacggataaaaagagctgctacatatgtgcccagagcagaagcatcttcgcgaagacagcattccaaaaagcacactcagaggatcaggaaaacagcagaatcctgggttgttttgtttccttacattttgaatacacttgcatcatgttaaaaggtgactctgcacagaccaatgcacattctgtcacataccccaaacgtcctctaataggcgttcctctttgagaaaaaagtcctttcaaggttttcgtcccacttttataaacttcatggcacagatcagaaccacagaggctaaagcctaagtccccagtgcagcctggaacagcctttgttctgcttctctgactcctgtccccccttggcatttcttcattctgtgtcgtcgtttggccagaaaaaatgccagcagcaagatggggaactgccttcccagctctctgcgaagactcttaaggcagaagcgaggcctgctgggagaaggctgatgtcagctcttaagagcacagctccctgctcggataaggaggcctttgttttcagctcaactgtgaaaatgagaaaatgcctctagcctgacaaacaagaaacccacacaacacaggtcaggcctgtgacctttacttaaaggtaccacactccattagcaaaacacttccagggaatctgcagatccaagagtggccctcagagaagagcagctctgcttccacctcaggaaggcaggttacaaccctgaagcaaacctcacagagaatcagttcctcggtgacgatcctccctaatgggaatggaaacacacacaactgacatacatggggcaaagtggggggatgctaaagaaactaaaaatcccgatgtaacaacaatattgcagtttccacattagtaatttaggacaactacatttatgaccataaaatatcctcttaaatccccagaatgcctttgggaatacttgtaagatacagtatgaaagtaaagaatatagaatttcagcactgaccctaccaagtttagactatgccaaggaggcgtggcagaaagaaagagcagatagtttgaaggattccattccataggctttgatttatgaaatctagagggaaaaaaaacacatgtcttcaaatacttaaagtaaattataaaatgctccagtttgaatcttttaggctaaggttactattggcttgggccactaacttaaaattgggccacagattttaaacaagaattaaaacaatctaaaaagcagcttcccaagcgtaaagaaaacccttgtttgttcctgtgggattctcacctgtacaaagactcatttcaggcctcttgggggcagctggacagcactcccccttccacaatccctgagggaaccctggtgaggctgtggggacctggagtgtgccgaactactaacgtcccggggcctccacccctttacttccctccatcctcctttgtgtgtgctaaaatgaacagtccccacctcccaaatatcctcagtagtgtgtggtttgagagtgcttaggctgcatcgtcccaaactatcaggcattagggtccagtatcgaatgattcatcgcagttggatatgtgtgctattagcataaatatcccatggtggctgacagcactggctctaggatcacacagcctgagttttgaatcctggctctggtacttaccagagtgtgtgaccctgaacaagttacagaactctcagtgttaccatctgtaaaggagggataacgatagtctccacctcatagaactgtgaggataaaacgatcgtgcccatgaagcacgcagcacagtgccagcgcacaagggctcacgagttgctgttactaacaagccctggaaaaaagccctcccaattctctggatgctgagaatcaggacctatcatcattctccatgatgaaaagttcacctctctctaaagcttgtgtagacatgaacacaataacttgttttgcctataaatacacattactgtttacgacgtcccagctgctagcagggtcaagggactaaaataacctcagcttttccatttcctctgggttcacttttaacctgaaatgaggaattgcttccttcactctcatggaatttgtgaaatagtctcttggtaactggtccatatacatccaaactaaaggctctaaagacatagaagcaacagctgccaaagagggtatgatcatgttgccaaagattttacatccagataccaaaaactacagatactgcagaacatttgaggtctcatatatataatcaactcttctgcaaaagataaagaaaatccagggaaaacccccaatcccattttagccaatcatcaatttcttcttcttactgagttcctattatatgcccagcacctgatttcaaaggcttcctccaaccttttgttaagctgaatgaattcgtggttttgagtttgtttttccctctttttctattcacccctatggtgagaaaagtgaagtgacagggccaggaaaaaacaaaacaaaacaaaacaccagatgaacaatgaaggatgaaaggacaatgcaagcaaaggaagagggagggaagaggaggaagaggagctgcaacaggaaccggagagcccaagcctggaatacacactcaagggcacaccagaatcgggacatcgggctccagcaaacacttcaaaggaagcgtcatagaagcaaagacaacaaggggcccatctcacaccaggaccgtgtttcaaaggccccccatcagcgaggggaggctgcgttttctttcactgggcccttcctcgttcattatgggttgctcagtgggtctgtggcaaacacagctggatggagcacaaggctagtgaccatggctttgatcccagtgtgagcctaggggctctgccctattctgtggccgggggcaaatacactgtaaatatatactgctgatcaaagagaggatgcctgctccaacgggaacgtgggctcaaacagcacttcccctagagacagggtccaattcaagtcaacataaaattatttagcacctaacacatgccagacattggactggtcaagtgtcatcttaaatacatgatgtgcacctctaaagctgcatgtaattccccaggtgggatgtagctatggcatcatcaaatgatcactggtgttggtgtcacacacagcagggttaatcccagctgccaacaacttagacacatcatcctctcacaaactcaatttttgcttttataaaatcaatctgatatagacaaaaagacagagatagacagatagatgtagaaatgtgcctacctagtgtaaagggtcacaattattgtgagagttaaatgagataatatatttcaagtgtccaacacacggccagtctgaagtaagcactcaataaatgttcccttcctcacaggtgacacatcccactctaagtctacacacacacaggtgacaacctcttcatttcagcacagagccctctcaaggttctacccacgaagcagcctagaatgactctcacaaccgatatgaatttaccatactgttacactgcacccactgtttgccttcaagagttttaattctattacaaatacacaagatattaaaatgcacgaggtcatccattgcagcactgttagtattgtaaagcacctgaaattgccaaaatgtccaaacacaggggactggttggatgagctttgatgcatgcaggtaatagagtgccacgcagctgaaatccagagtgaggagctggtaggaaaagatttccatgatgtgtcattgaaaaacacgaaggcggccaggcacggtggctcacgccagtaatcccagcactttgggaggccgaggcgggcggatcacctgagatcgggagttcaagaccagcctgaccaacatggagaaaccccatctctactaaaaatacaaaattagccgggcatggtggcgcatgcctataatcctagctactcgggaggctgaggcaggagaatcgctggaacccaggaggtggaggttgtggtgagccgagattgcctcattgcactccagcctgggcaacaagagtgaaactccatctcaaacaaacaaacaaacaaacaaaataagaaaacaccaaggctgaagtgagtacacacagtaggctatcgcacatgtaagaaagaaggggaaatgcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacatcatggaatactatgcagccataaaaaatgatgagtttatgtcctttgtagggacatggatgaaattggaaatcatcattcccagtaaactatcacaaggacaaaaaaccaaacaccgcatgttctcactcataggtgggaattgaacaatgagaacacatggacacaggaaggggaacatcacactctggggactgttgtggtgtggggggggcggggaatagcattaggagatatacctaatgctaaatgacaagttaatgggtgcagcacaccatcatggcacatgtatacacatgtaactaacctgcacattgtgcacatgtaccctaaaacttaaagtataataataataaaataagataaaataaaaaaaaagaaagaaggggaaatgataaaacattcacatatttgcttgatttaccaaaacagaaacacaagaaggatgctttgcttccagggaagggagtaaaaggtgtgaacaagacagggtagggagtaacattaaaagcacactttttagtacagttttaactttggggagcatgttcatatcttacatactcaaaaaataaaatttgaaaggatggaaaaagtctaaaactgaatgcaaacagaaatgaatgaacctaacaatatatttcaaataatacaacaatactgaggagaaaagggaaagtaactcttcaaattcatcctgtgactattataccctcagcatgggagaaggaaaaaccataaacaaatcctgaactctttttagtttgtttttcaaagtggtattggcaccatgcttctgaaactacctgaagtgcactgcaggagtggaccatgagtacatgtgtggatgtagttcttactggtgaaccagggagatagagtatggaacggggagggcgaggaggagctcgggagagttgggttagccctggagcatcgccaggaactcattatctcctagctctttccatggaaaggatctagaaacagcactgttcaatagaacttcttgtgatgatagaaatgttctgtatctgtgctgtccgatatggtagcgaacggccacatgtggctactaagcttgaaatgtgactcctgcagctgaggaactagatttttaattttaatttaaaatcaacacctgtggctggtgtctgctgtactattagacaaatcaagtctagaagcaatgtgatcatagtaacaataagttaccatgaaaaactatgtaatccatagtaacgataacacctagcacctggatctgggcttctaaatcctattccccactaaaaggatctggagtcccctggaaaaacggctaattccatggctggagcaggtaggctacaagatgagcctagaacaacttgtaggccagaaaataagaaagtgctcaacaaccacaaggaaataatggaggttatgacaaggacataggaccagtggacagggttcttgtttgtcaactctgggacagctacaattcattcagtaagacaggaaccccggagtccatatggataataagtagataaataggcaggcaggcaggagaaaggggaagagctctttcttaccagattgcacttgaatatcaagggccattaaaaaaaaaacttactgatttttccacaagatgaatcccactccacctcttcccatcctttaatccactctttccaaacacagagtacttttcaacttccaaacagacattcatcttcttaagacttttcttaagaaataaacagaaataatgtatttctcagggtcaccgtattggaaccaacccaacagtgtcatggataggttaatggataaatgcagaaattgacctttctagtcttaaaacttaaaacttacatttgttttatctgaggtctttaagaaaagaccttcagtcctctcaaaaacaaaaaacaagtgtcaaagaactgaagcccaccaggtaactacatccagacaaagagatgtgggaccgtccttcatcatgattgtgtccttgctcctcccaagttcctatttgttaaatcttgtttcatttcttccctgctatataaaccccagctttagtccatcagggagatggatttgccccatctcctggactgtagcacccaatgaaagccttcttccttggcaatactcctcatcccagtcattggctttctgtgtggtgagcagcaggacccagaccaaacccctggtggttcggtaacaatatcaacaaaaaaattaataatgagttcaaatacaccaggtcctaagaggctggaataaaatcccaggaattctaattttcaaaattctgaagaaatcactaaggaaacctctctttttttccccttcccctaaatcaaactggatagaactcagtcttactctctgttgccttttttttttataagacatcatctcgctctgttgcccaggctagtgcaacggcatgatctcggctcactgcaacctctgccacctggattcaggcaattctcctgtcacagcctcctgagtagctgggactacaggcgcacaccaccacacccagctaattttttttgtatttttagtacagacagggtttcaccatattgatcagtctggtctcaaactcctgacctcatgtgatccgcccaccctggcctcccaaagtgctaggattacaggcacgagccacctcgcccggcctctgctgcttcttactctggctcagagccacctgatctctccatctttctactagaaaatgtctccatatgatgcttataataaaatgcagccaaaccgtgcacctttcaggccttgttagctagctaccgaaactattttttctttcttcctctctctctctcccttccttccttttttagaggcagggtctcccttttgtaccctggctggagtgcagtggtgtgatcacacctcactgcagtcttaaactcctgggctaaagctatcctcccacctcagcctcccaagtagctgggagcaaaggaacactccaccaggccaagctaatttttaaaattttttgtagagatgggggtcttgctatattgcccaggctggtctcaaactcctaggctcaagcaatctgcctgcctcagcctcctaaagtgctggaattacaggcatgagctagcacacccagccaaaactcttttccaataacactcctttccccagaattattatgactgctttagtgataaaatacatcacattttcattacatgttattaacaaactctaagaagataaagcacaaaaaccattttgtaatctccttaaagagatacactaggctattccttttcaaataattatgaatctgtcatttattgcagataacttcttaggcattaaatataaaggagggagcatgctatagcccaaataggaaacatttcatcaaacagcagcactaaataccctacaacacgaagaagtaagacaggcagcatctttccaatctgcctgtgaaatctgtcattaggctcttagaaaacacagtacaaacaatggtaatgttactaaaataactatcacacagtaaacaagtaacactcagaaggacctaaccacacgccaatcgcctttcctccttacactgtacacttaagaaaatacattttataatatatatattttttaccacaataaaagaaaaatgaggggggagtcacctggctggtgtaagggagtctgagagaggaggttactcctgtttctattttcctaaaactttgcataataatgtcaattgtgatttgcacataaaatttggcgattctattatttacacttaaaattatttatagtgtcatcacagacccgtacctcaaagtcttatttttagccaccaagagagctacaaaattattttcttttttttttttgagacagagtctcgctctgtcacccaggctgagtgcagtggcgcgatctcggctcactgcaagctctgcctccaaggttcaagtgattctcatgcctcagcctcccgagtagctgggatgacaggcatgcaccaccacacccagctagttttttgtaattttagtagagacagggttttgccatgttgcctaggctggtctcgaactcctggcctcaggtgatccacccaccttggcctcccaaagtgccaggattacaggtgtgtgagccactgcgcctagccacaaaattattttctgaacattttaatattctaataataatattaacaatgactaaagctgagtacttactatctgccaggcaccattcttaagtccttacaataatcctatgaggaaggaattaatattatctgtgatgaaagataaagaaagtgggaattgaacccaggcattttgattaaaaggcacatactatcaaacattaaatccaccatatatacatatgtatattttcttactctctatcatcataaccagtatctgaacaatggaataaaaataacaacccccatcaacaaagtgctataccatgccaagctctttgcatattttaactctagtcctcgtaatagctctatacattaactattatcattgtcattgtcattgtccaatgacaaggatatcactgtcaaggatactgggcccagctaaattaagtgacttgtccaaagcctcacagctgttgtgtggcagaatcaggatttaaattaaggcatgtttgtctgcaggctgccttcccctttcttacttatgaaaagaaaaagaaaaaaaaaaaaagaccaaatgttcttatttgggtttgggaaaagcagatgggaaagtataagaaattcgtgggaataaaagaatgaactgcaagagctgagcacccaggagttaagctagccctgcctgcggagtgcactgtttgcagggccttcctgctggattcctgatggtagcaaattccagggctccagactgcaggctcagcctctgactaacactgcagtgatttatttgaggataaatacctctgtcagtgtcttatgactgaacacaacagtccaagctgactggaacgagcggaatgcgaggacgctggagctgaggcagtagaggcgggagctgggccacctctctgcggaaactctgcctccaaggaggagccctcacaggaaggtattcctgtggggaaaaagcagtgccctcaggaattggagcatcttgaataatgaggaaacactgactcatgctagagtgagcgcttgggaagggggaaggaggaggacctctgtacctgcacacacaaagctactccctccaatactcagtgcaaccttgccaggattggcaagataactccaagaacaccaaccgccctcaccactgtacccgtagactctctgggcagctggtggggcgtctccaagtcctgaaaactggggagaagcctctccctctgcgaggagggtgtgtgccgagaggagagtgcaaaggggagaagccgggtgcacggaagcgggaggcttttccagtggaaacatggtgacgttgcacagattcagggatctgtggtttcagcccgtgtttcacaaataacaaaactgaggcccaaagagttgaagcaattcatgtcaagaaggtagacagtgtcagtggcagatcaaggactggctggatgtggtgagtggcaccttgtcatgagcataggaagctggcttccctttatgggaaggtcccaagtttgtaccaggggcacataaggtgggatgaacacttcttcgtgtgtacaatcctagactcctgagtaagaactttacagacgtctgcttggtcaaaaaggtgctgagcttcccttctatttgtctggtgcacagtgacattcactaaatgttgattctcctaaaaacaatcaatatgtatgggcaaaaaaaagcgaagcttagcagatgactactcgactgctcgcagaagctctaaggggacattaacttctatggagtttaacatgcggaaggtcctacaagtaggctggagggaagccagacttccacctcaccgcgagttatcaaaatgagtttactaccttctttttggcagatgaatactatttttcttttgtaaataatatccttttcaaataaagtatgcaaatgataacatcagaattagcacaaagttgcaaaacaaataaggccccagcacggagcacccttaagccaaaataagaacagaggaactcacagatgggggttgaagatgcgactcattttggagacgtggtcgttgtcacagtctaggtcctcgtcacctggctccatgctgaacttcctcttgctggggctgattgggggagggccggtgcggtgactgctgagggcagaggccaccggcagggtctgtattctgggttctcccctgagagcagcttcgcctacgcagagagagatgatgtagtcactaagcaggagaaaggcccccatctcagtcccccaggctccccgcccgcccagccagccccttacaaaactactcccagtggaaagtttttggcaatgggacggggccgcctgccatcctctgaacatggtttgagtgtggttagctgccaaccatgagacattttacatcaacgtggttttctagcacagtcactctttagggtagagtttaaaataaaaagttgcaataaaatagcaggggggaggcaaaaagcattttctgtaaacaatttcaaaagttaatttaaaacaccaaaggtcttttcacgtgtgggtattccactcgatacagataggagaatgacctcactgcattcatgaaaccactatgcccaactcacttttcctgcttgttctgttttttttttctaatatagtcttggtatttaatttcttttaaaagaatgaggaaagtgtgtgggctaacagttcacacatttgtaccgaaagttaaaagaaatataaatacatcgtttaatgggaaataaatgtttaattcttacagtacgctaaatattgcacattaaaatattatcagcacaaagcttcggcatataacttatcgcaagcataatacgtgggtaggtgcagttctgaaacatgtttcgaagttaggcaatcaaattagggtccacatttccatttgatttgacatcttggcgtttttcattattattttaaaaggttttgtactaggcaatcactttgtgcctcgctgtgaattaaaataagcatagcctttcatagtaataaagcttgtgtaccttctaaactttataaagacgaatgattactttaagagaaaacttcaaactttctaagtcacatggggggagcacctaaatttttcacaaataataacccttttgttgtgctgtacattttggtctctcggacctgaccaattttctttccatttggtcacaatttgagagtaatacgaggataaagtcaacttcatccgaggccttgtggtacctaagaaaaggaatctttgtttgccaccactaattttcatatcatcacagatgtgtggacagtgttaacagtcatttacttcatacacatatgacaaatatgattttgttggagaaaggagtgaggaaaaaccctctgaatatttaccaggaaaaataaaaacttggccaatttactcagcaagatataaactagcaaatatacagtgacccataatacacctccagccaggatttcttttaaggattctggccccaaagcaaactggaactttccattttaaatgagatacctaaaacacaggcctcacgctggcctgccacactcagaaattcagtatgatcttggttggcctatactccctatttagtaattttcattttaaaaaacaaaaaaagcagtgctcatctttataccttcataaattagaaaaatatcctttctaattatctccgttatttgtgatacttcctcctccacaaagagagaagagggtgtttccaagggaaagcttcagaagcccaagcccagctaactttctgggaagccctgatgatacccccaggaacgcagcaactgcaaatcaaacctcatcaaaatggcaccagctgaccctcctctccacccagggtttctcaacacccctggcaggatgcgaggggatgaggagtcctcgggcttggacccccgaactgtggtcatcatttcatcagatgccagctgtgtagcaacaagagttgctatggaaaacaaccactacagcaacagactgaaatcactccaaaaaaggagccgtcactcattccaccagcatacactgtgacgcggaaagcaaaacccttgggttaagaacaacattcccactcccctccccagtttccatcctagtaaaaattctcgtgcttgtttgcatttttaagttcatccaacggatgcagtgcttatctttaagactgaatcactgatgtctaacatcgaaaaaaattccacaagaatcctcagaaaacactggagatttctaacccacgggtgggggtgggaccagggctggggctacaggccccatgaaggcactccaggtgtccttcaccagggactgtgacagacgcctccaccaggtcccggggagacggtggtaaatgcgtgctgtagtacttcagcatctcagcttgccggcgccggaaggagcccaggaagcacggtttgcctcatttgatggatgacgaagctgtgccccaaaacatagcgtgacttacccaagatcctccagttaacaggttagctggaggcaagaacccatggcctctgcaatcagacaacgcctcatcctaagactgtgcagcctcacacaaggcttacagcaaaggaaaagaatccgcacataaggtcagggacaggtccgttcagttatgtgcctttatgcatctttggggcccctccctagatggccttaacccaacacttgtatgttagacaagagtggtaactgttgtatgtgtggtggggttaaaattatttttgtaaaactgaagcagacatttgttctgggagataagacacttgcattgcaatcttgactcctcctttatttaggatggggtgaatttgggcacgtgcttcccctctctgggcctccctccatacaacaaggggctggactagctaatgtgtcatgttctttccagctcttagaattactgatgcaattctatgatcaacaagtgaccaaccaactaaccaacatttacaaagaaattgctacttgtgtaatggtgaactaagacagcaaaactcaaggtatgtacctcagatgttattcatcgaaaaaaacaagggtgaccctggggtcaaataaatttggaaaccgtgagattgaacaacttttacaggagtttaactacaggcctttctgtcttctaatgcatctcagtctctgagatggaaaccccgcagggctgctttccatcgcccgccacgcccccgcccacccccaatcctccacagctctgtgaattccatcttccaaagcgcccccacgcccaccccccacccccaatcctccacagctctgtgaattccatcttccaaagcgccccacgcccccgcccacccccaatcctccacagctctgtgaattccatcttccaaagcgcccccacgcccaccccccacccccaatcctccacagctctgtgaattccatcttccaaagcgcccccacgcccaccccccacccccaatcctccacagctctgtgaattccatcttccaaagcgccattctcagcatgttggcccatcctcaccccagatatccagtgactgcagacttcttctgcattcgaaaccccaactgcctttctcatttttattcctagtattcctctttatgagccctgaaaatttcagcccagtaagttaaactagactcatcaccattccacagagaacttgttcttcccccaatcttctcatttaagttcatacatcctgcaaaaccacttaaaatgcctcctccatcaggctgtcctccttgattcctccagctgaaggtcatctcctcttcctctgaacatctatagaaacttatcactctggtgcttccctccctactttattttgtgctcctggaagcaggtggcatttaattcatttaataaacctgacagtgcagagcacaactgacctactgaatcaatgaggcaaggtgacagggtgggcagtttacagagctttaggatatgttaaagatcaaagatgttatagaataaggagtgtttaaagatctatttaaaaatataagaactcttacaacaattaaaaagataacaaaaaatagaaaaggatctaaataggcatttccgaagagaagatatgaaaatagccaataagcacatggaaagatgttgtattagtctgttctcacgttgctgataaagacatacccgagactgggtaatttataaagagaaagaggcttgatggattcatagttccacatgcctggggaggcctcacaatcacggaggaagccgaaaggcatgtcttacatgatgacagacgagagaatgagaatgagagaaaggggtgttcccttataaaaccatcagatcttgtgagacttactaccacgggtacagtatggggggaaaccgcccccacgattcagttatctcccaccaggtccctcccacaacacgtgggaattatgggagctacaattcaagatgagattgggtggggacactgccaaaccatatcagatgtccaacatcgtcagccatcaaggaaatgcgaatcaataccacaaagagataccactaacacctgttaggatggctatgatcaaaagacaatacaaaagtgttagcaaggatgtggagaagctggaacacgtgtacgctgctggtagaattgtaaagtggcattgagaggtgaggccagctggacttgtaggttgggtgaggacttagagaacttttctgtcttacaagaggattgtaaaatgcaccatcagcaccctgtagctaggattgtaaaatgcacccaatcagtgctctgtggctagctagaagtttgtaaaatgtgccaatcaacactctgtaaaaacacatcaatcagctctctgtgggtagctaaaggtttgtaaaatggaccaatcagcactctgtaaaatggaccaatgagcaggacataggcagggacaaataagggaataaaagctggccactccagccagcagcagcaacccactcaagtccccttccacgctgtggaagctttgttcctttgctcttcacaataaatcttgctgctgctcactctttgtgtccgtgccacctttaagagctgtaacactcaccgcgaaggtccccagcttcattcttgaagtcagcgagaccaagaacccaccagaaggaaccaactccggacacagcatggccatggtggaaaacagtctgacagctcctcaactgatgaaacacagagttaccacataacctagcaattctagtcctgggtacataaccaagagaaatgaaaacaatgtccacacaaaagcttgtacatgcatgttcatagcagcattattaaaatagctaaatagtggaaacaaccaaaatgtccatcaactaacagatgtaaaaaatgaaatatccatgatgtaatattatgcagctataaaaaggagtaagatactgattcatgccatgacacagatgaacctacaaaacagtatgctgagtgaaggaaagcagacacaaaaggccacctactgtctgattccacttctatgaaatgtcagaagagggaggctcacaggcagaaagcaggtgagtcggtgctgggggctgggagaagggggaatgggaggtgacagttcacgggtggcaggtttctttgggggaatgacaaaaaccttctaaaattgattgtgataaaagttgcataactctaaatatgctaaaaaccactgaagtgtattgtagactttaaatgggtgaattgtatagtatgtgaattatgtctcagtagaaatgttacctcttcctcctccaaaataagaatatatttataagcagtataaggctccaatatcattagattcttttttctctcaggcttttcacactaaactattaaacaattaagaacaggcatttgtgaatttccccagaaataaaaacaaaccttttgttattacagttacatctccctagaatattaaagtcagataatttttaaaacattatttattaagctaaaaaaagtcaaatcagtgaaacacttgaggtgacttaggctcttggattcatcagatcctataaagctgcagctcagcttttaatcagtgtgtcgagtgcctgtgacacactgaaggctgtgcaaagtactgtcacaaaaatacatgatgaaatgtatacagaccctgaccacaagggtgggaggcaaaagcacatacaccaaaaggaacttatcttgggagtgcaagaggcttttccctcttgttctaacatgtattcgaaatttcacaatggtctggcaattgaaaaaggagaaaagattatctttctttttcaagaataaacagaaggaagatttgagctgagtaaccccgtattttaagctttacaagttggcttaactacaactgtcagttttacttctttcaaattcccaatgacaactaaagaagttttattttttaaatgtatttggccttttacatgaagataattttatctaggcacacgttagaaaaatgcctagataaaatgaagaaaaatgccgaatatatacaaaattaactcctgtggttttttggcatggtggcaattctaacacatggatcaataatattccttcaaatttccccaaagaagataagcaaagattttggcctaagatttcacaagaatcagcatgtttatttcaatggcagagaagtttaacagagagaaatgaaaagagagaatcacctcgctttatgctgtgctataatatgattttgacaaaatatcacaagaaaattctgctttcaaagtcaaaatagaaagaggggaggagaacagggaggaaccgtggaaaatgtaaccccactgtaatcctgtcattaccatatctcaaagattctaagactatttcctacattttaatattgctaagactgaagtttatcttacaaataattggcatatattaacagccaagattgcttctttttcagtggtacataaaataatgattcacacagaacctaactccagaggcttcaaaacagcactggtctcttcaacctccatttttttttggagacggagtctcactctgtcgcccagactggagtgcagtggcgagatcttggctcactgcaacctctgcctcctgggttcaagtgattctcctgcgtcagcctcccgagtgtagccgggactacaagtgctcgccaccatgcctggctaatttttctcaaattttttagtagagatggggttttaccatgttggccagggtagtctagaactcctgatctcaagttatctacccaccttggcctcccaaagtgctgggattacaggcctgagccaccgagcctggcctaacctctgtttctttactcacaaaattaagtggtttgattagatcatcttgacagcctccttttggctctaatggactacatcttccataagagatacatcttctaaagttaagtttccttttactgctcatcaagaaatactttccaaacttttacagaacacactttacatagtggtagaaaaagcagattcaacaaagcaatcaactaacaaaattttttgagattagctaattattagcatctcatgattaagggagatttcattaaaaaacaaggactcttctagttctcaaagttccagcaacattcatttattcgaatactacaagaaagttgtagccagctgaaacctggacaaatagaatctggttcaccaaatgcagattcgattttcatagaacagaacaatcaaggccatgaccttcaacacagagatggggcgagtgattgggtttcagggggattaatggactctcccagggataaggcggcgttagcaatgggaacccgggtctcggccacatggcccctcaccaactgtgcaggcccatcgccagactggggtgtgggctgcatgggaggcgatggcatggctctgagcaattaaccaaaataatggtatttatgggcattttctggagattagaccaacagcacagggtgaaatgagaatgtctttatggagaaggagagggtaaactacagtcaaatgtatcttgctgtaacttttaaggatagatttttgacaaagatctctatgccgtgccgaacagagagtttaagtccacaacttaaatctccgctgtgtctaaggctttacgttcagcccccctcccagcccctttatcatgtttgaacctaaatcaaagaagcaaaaccatagctcggtcggccaagccagccgcgctgcactgatgtgtctccttcaggctgaccacagcccatggcaaccgactgacatcatgtcctggcgagagggcaccctggtaagaggaccctgctcccagattccacgcccctctcacatctcaccctctcatcactgtgcagggcagaagcccccggcagccagggcttactcactttctttcaaataatacttctttgtctcacggtcgagcagctggggagaagacaccgtgaagtcaatctccttcaaattgttcaacttgtggctagccccattctggctcacttttttctttttttataggacgcccattgcaatgcgagccggcagataaaagccgtgacgtgctgtctgcccaagcgcaaggatcgcctgcaatcccccagcccttgggtggcaacacaaagcacctctcatactataatgctctgggcggccccaggctcagctctaatcgtgcagagcctgacctcgcctcgggggagccggctggactgggaagggctgtgcagggtccacaccctggactgggcttggtttgagcagctctactctttttgtttaagagcaaagatgagattgtgttgagagagtacagcctctatcttggactgctaataatatagataaggataacaacagcacaataaaactggtagaagtgaagcatatgccatcttcactagaatttcaaggaatctaaatcatttcatacacactatactttgtagaagccttcctgtatcttctatgagtgtgttttattttataagcgtattacaacatgatctattgttctgacttttcttaatgcagccctgtgagggaggcggggaagaagagctcccgccttgcagccggggaaactagtgtttcaagaattaagtgaatttctcaaggtcgcaaagctgattaatggaagcactggaagtagaaacctgggatttagactccccaacttccatcatctttctaggtgtgcaagatgcttcactggttgaggaaaataaatgggaggaagacagttgaggagggaggaaggcggagaagagagggggagggggcgggaggaaggggagcttattggctgaaccatgcccacccctggaattaacacgttaaagtcccaaaccccagtactgcagagaacatggctgtatttgaagacagagactttaaagaggtaattaaggtgaaatgaggtcattaatccaatctgactgttgtccctataacaagagattagggcaaagacacattgcagaaaggccaccatgcgaggatatgggagaagagaaggcggccatctgcaagccaaggagagagcctgccggagaaataagcccgctgagtctttgatctcagacttccagcctccaggaccaatgagttaatacatttctgttgtttaaaccacccagtctgcggaattttcttctggcagccccaggaaactaatccagagaggaaagaagagaggacgggactgaaacctggttctgacaccaaagatgaacagctgcaactgtcccatctgtctgacctaacatagtgggactgagatgaaagcaactgaacgtacagatgccgcttccagaccagaaccacctgagcacaggaggaaacaaacacatggactggcaagggaggagaatgggtttcctggctgggcactgggcaagtggacagctgcggcctgcccctctgacttggtgatcatctgccctgcactagccagaggaacctcgacctcccaggaattcttctgcttgcctgtaagagaggaggactaggtttgtgttcacaaaccaggctggggcctcctttggatggggaggcagtgggtctgaggtgggacctgctcccagacatgtcgtactgatgatactggtgcaggagggatggtgtctgctggcgcctctggttttaagtattaatagctataattttacaggggctgaagggaaaaagataaaagaatgccaaagaaattatgtctataattctcaacatctattgtgaatatacactagttttttaatgaactgcagttactctgaataccaaaaagcactaaaaatactttaaattaaaacttgttatcacatccacacattgttattcatttaattaggaagttctatactgcttaaaatcattttattatcttcagggctaatagaagtccctgctgtctcatttaccctgttggatttagtttacaactgaactgtatcttgatagactatgtaacactgcaacctccgtggaattgagtaagtggggtcaaactaatgtcttactatacatatcattttggcttgaagaaaactcaggtatgtaacacaacacaaacagcctgaagatcatcagatctaggtttgaggttgggttttagctttgtaaatcataagattcaaaaagatcaaacacaaaacaaacaaaaaagaatgaacactcatccacttccctggtttcccgatgcagatttagtaacgacacctaccttctattcttggtcctccattccctagactctggctctcaggtagcctcagaggcctctgagtaaactaggaaagtgcagtccccgcttagagtgcgagctccgctgtggctgtgctcgtgcaggctaaggactggcatctgcctattagaacagtggtccaaagggtcacatgcactgacatggccctgacacatcaccggtgaaccccaaggagacaaagccagctcagaacctttaacaccaagtgcacagtcctccttaatggaaaaggctcttaaagcctggcagaaattctgcactatatttacttgcaaatctacttttgtaacattttactgttaatgaggaggaggagagttatgaaagtaaattgttagcagatggtattggaatcaggcactttgctgggggctcaatttcctccctggtagagcttataaatgtttagaaggagtagctggatgagggtaagcaaaaaaaaaaagaggcttgttcaaacctcttcagcagttgagccaagcctccggagggaccctggttgccacgaaacagagggattaagctggtaatggtatgatctcttcaaaatgtaagtgttttggtaaaaatactcaaaaaacttctgtctgcaagccctgtaccatgtgacaggttaagcaccgaaggtcatatgctaccatctgcattttcaagacattctttaattggagggagttccagagggtacgactgccacaggccctgagatggttgagtcctggaatcaggcactgatcactagagggggaaaaaagagacacagtcttgcaagtgcagagagagaacagaaaactaaactttccctcttctgatctcccgtaacactccgagcctctagaatggccctgcccacaggctgcctaatggaagaattcaccacgtgctgctcttctctgtaatacctcgcacgtggtcccgggtactgttctgggaggcacggagcagctcattcatttctgtatccctggccactctaccagtgacagagaaacatagtagaaagtgggctgtggagtcagaaaaatgtatgatcttagcagtctcttcatctctcttgagcctctatccaactaccgtgagggatttctatgcgaatcaatgagaattcatataaaggtcccagcccagaacaggcaatttatttattacactgtttgttggattccatctgttggtgcaattcccatttgaaggataagatggctgaacaaagggaacctctaactgtccttctcgctactcatgacaggcccccgcctcgaatacagtcagccactagccgatggaaggggtcaggagacacagtacccaagagcctgggtgagtgggtgctccgaatctgctccaccaggagccggcgacgtcatctcagagcagctgcctgactttctatgactgtttccacatgtgtgaaaatggtagtgtgaacccacacacaggctcagagcgatacccggcacggtgccgcctcctccccacacacactctggacttacaggctttcttccatgcacgtttctccctccctagaatgtgttcagaagccctctctgccaatgcatactcatctgcactttcaaaacccgacttgagtgcctcttgtcagcctcagccccaagagcaccccttttggtgccatctacctgggctgagctgcctggcagcgtcccttgtgacgtgctgctggctccaactcaaaaactactcatttctcagcaacaccattgtgtgctaccgccaaacaggcgatcttgctctctgcagtaggttccagtccagaccctgaggagtaagatggtggtcccggaaaccagttcaaatttctcactggcatacagagtgctgaaggaaggctgtgtataggccccccgattctgatcgtgaaatctcattatcagttccaagccccccacggagctgcagtgggcaggtagctgggacgagacacattcccaagtcagatatctcagccagccatccaggtttcccacggaaattcattaactcactgtattccttactattgctaaatatgctggtttcagaagccacagagtgaattttccaaggattaaaataggacacgaagttcaaagatgtctcagtcctgacacagtggaagcagcattagggacttgggcacgcacaccattcgagagcctgacaaccctgaagacaagtaaagcgagtaacttaaagtcagcttcagtcaaccttactgctgaaacagctacatgcccaagtaaatcattttaatttttccaacttttaatttcaaaaaattttaaagctacccaaaaagttgaatgagaacaagaacatcccattctctttaccttgattcacctatcataagcatttttgtcagtttgttttagctacatgcatacacgttttcttgctgtgatttttgaaagtattaataagtgggagacatcttatttcacccataaatacttaagaacagggacattctccttcagagccacaataccattatcatacccaacaaagttaaagttgacgtattgtcattatctaatatccagttcacattccaacttcccgaactgacctgtctcttttttggtggcagggagggttgggggaggacttcattaattaagggtcatatgctgctcagtgaagttgtcatgtttctttaatctcctttcatctaaaggaattcttttctctttcgtgacactgatgtttttaaataatgcagaccaatgagctgtccctacaaattttggtggcctaatcatttctttatgattagatctgagttaaatctttttggcaagaatactacccaggtgatactgtgtgctcccaccgcactgcaccacaccggaaggacctggcgccagcccatcccatcactggggaagcagagcctgcagtacacacagattgctccttgctctgttagaaacaagtaagctcctcccttttgtagtaatagtttgggggtgtgaatcctgtcattgtcactcaatcacatactcatttttttgtttgggttctgtttttctattatttttatttcccatactcatttattacacacctttaatttgcagtttgagagtgcagagctaagctggattaaagacagggtccccagatacaattcagcacaagtccaactggggacacattttcatacaaaacacattgaaagaaagacagacaatacaatcaggagtagcttatactctgcctggaataaagcaggtgcttagcaaatatttgttgaataagggacctgtatggttcaggcaaataaaagctattaggccaatctgcatcctttccattcttccttctcacatcacctcacccctggggctgaaaggaagtcttcgaacgtggccaccctgcctcccaccacgagagatcaggatccctgactgattggattgccggagtaaaggctcaactgcctcaacctgatcagcccatctcaccctctctctccagccttacccatctctctttctcttccctcccccgcccctcagactccactgctcctgaggtgtggtctgcacacgcaggggatgcctcccacctcccctcccacctgcctggaacagtccctcactttcaggtctggtctagagtgcaagcctcaccttcttcaagctcttcctcagcaagtaagtgttccttggtcttcagtgtctgaaaacatttacaagcatcctgcgttatggctcttaatcctatcgcctaacggtggtactatttacaaacattttcacatggctaggaagccttcaggccacttcctagacccagctcattccctagggcctcctttcctttcctagagcaggctccagggataagccctgtccttgtcctttgctatgtcctttcataaaagctgccacccatgctctcttattgagacagtcctcatcccaaaacgatagtgaagtgggacttgtgtccctgccacatcaccccaaaaactgacacatggacatggaacctttatttaaaaggctaattgttgaatccagtcctgtctaaagaatgtatacaatttaggactggcagaaaaaaaatcagaggatgtggttcagtgaaaggcattgttgtgcctgggatgtttgtaggactactccaggaactaaggaaaacacacagatgtttgagatctggtctttgcctcgaaaattttagttctagtgggagtgataagttatggagataaagaactgtaaggatggaacattataaatgccaaaataaatcagatgctcttgaaatgggtgaattgcatggtatattagttatatctcaataaagctgttacccccaaagagcttctggttatgtaggttaatctactgacatttatcatagtaggaattaaaatggggaagttttaaaatattaattaatttgaaataaaaaataaaaagagatgcactttttatttttttaaaaaaagagagcgatgccacacacattttatatgagggagacaataattctaactctaacaggagtgggatttgaaaaacaggcaggatttggacacttagaaatgatgggtatgagcattccaggcaggtacaagagtatgaggcaaggcagagagcaggaatgatgccatctttgtgcgagagcaatgggactagaacaacgggtttgtttccttagacttaaggctggatacagagaggtgggtcagataataaagggctctgaacacaggtgaacggctgagacctgacgaggcgggtcactgacagggagccactgtaagcactgacacagctacagggaggcttccgtgaggggtgctccaacacaccatgccagatgggtgcacacacctgagtcagggaacagggcagggacgcaagcgttacgtgaggaagcttcaacaatgttcctatcagtgaggatggagaagaggcaggttgaagacacattttaaggaaagatcagagagctggtattccagctagtattatacattgacctgatctttccgaaacaggccaccctcagcttcttcctaataactctctcaatgttgacccttccttcgtataaattgagaaactatgagatgaacaagccaggaagctacacttgttccctagcttatcaatatgtaacaaggaagagtgagttagtgctagaactccatattttaagttccacaggttgatctaacaaagtctaattaacctctcatatttacatttcaatcactgtcaggtgacgtttttatgtactaataagattccatttttattcttgaagaaaactgtcagtatactcattttctttaaacaatttagatgtccactgtttgatggcaggggttgtgctaagagcttccatttatccatgattaatcaacatttattcaacagacatttcctaaaatctgagttgtgaagaacatcaaacaaatcaaataataatgcatacttatagagggaaaaatctgaataccgatgtttaaaaactgactccaatgaaatctacctatattaaaataaaccaattctaaaaaatcatcatccttcattagattggtgtcaggctaatatacagatatgttgggtttttcacagtatatggtatattctggagtgcttttacagataaattttactcaataattatagtttatgtaagctattattacaagatgtctgtattatccaataaaaaaactaagaggctattagaactgaagtcaaaagtatgtgactagcttgagaaagtattaaaatatttattggagagttactggagagtcaaacagctaatttcatacatgggtaagtaattaaataccaaaatgtatttatttcttaagaaaaatggcttaataatggtgttcagcataaccaaagaataggtaaatctgtaaagctgctttttaaaggtgcaattgcagacttattccacagattttaatgttaatgggaaatcgtaagatccttatgcaaaaattatacacaatcaaggacttttgtttccttaccaagctccaagaaaagagactattaaataataaagtaaaaaagtcatagaatttaacctgaaaacaaatattccattagcatgtaaaatttaatgtgtttcctaaacaaaatcatccccatgatgccaagaagttttctactggagtgtgaaggtgaaggaggtttccccaaattaatcaacctaaaatattgggggatggggatgttgcttacttttcatttctatttctttctatcctcccacctctctctctttttacatttacattacccagtgagcaaattttatcaatgagaagccaggaagggctgactccctttggtatatttacttaagatataaaggccaatcaaccattgtgctcagaaaagttgtggccgtttctgggcctacttcagatctctccttagctccaagtgacttattatgaagccaaagaaagaggaaaactgagctgatcaaaggccaggctgtcattaagtgaaaatgatggaagatgaaaggcttgccctgcacttcaaaggtacagctgagctcgggtgagctgacagcaagcgatcagggatcagagaggcaggcggtagcttaatggactagatgacattcctagagccattcatctttataccaatcacgaaaaatagaaacataacgacaaacatgcatttaaatgctttcctactggatataaagaagagtgggtaacccaaaaatataaagtgacatacatcacatctacacttacagaatataaaataatgaggtccaagaactgttgaagaagttggcatctctaagcagtgcagaattacatgttaacagtttttccttatgccctagggtgtgtaatgcaatgaagcttaattttgagagaccatggatgcagcagtctcacttccctggtgggctaacgcagaacacttggtgtgttgacgcggaagggcggtcaaacttgcttaagattttggggttagagctggtctagagccaccatagggctggggaaggaaggttggaaaaatcaggccgattgatgattacacaatattccccttattccaccccattcacccctgtacagtgccctcccacccatacacagaacctcagcagacagaggcccctctaggcagcaaagatgttacattgtaagaggcctcaaggcattaactcgagtctcctttcttttctttttcctctgtaggaaccaacatgcatctaatcttctaagactccctagaatgactttaatacaatggaacaatattatctgtacttctggtcacactggagacttttcagggaattgactgggtttctcctccctatagtttattgttagtggtggcagcacctgcaaagagcagagaaaaagaggagagagtgccaccccccggcaaattagtaatcaggatgttgggtactgagaagagatgctctagaagctttatatatgtgaattcatttcgtactcctatttacctgtgaagtaggcactatcattagtttcattttcaggaggaaatggtcaccaaaagtggctcagcaacttgcccaaggtcacagctagaaataggaaagactggatttacacccaaaggtctggccccagggactatgtttccaactcctataccactcggagaggtttcacagagcagatggtgaagggtcagcaggagtggcccagtgaacaaaatcctgcaaggtcggcacagcctgagggggcaacagcacagcacccctgagccagcagggtgagggcaagggtgaagagcagcaaaaggtgccggagggcagggtgagccttggtcatccaaaggcgttagcaccccagggccgctaaagtaaacattgatcatacgtaaaacctttgcttgcacctcttccaatcagacctgccactaccaaaactctccttctctatggaaattccagagctaccttttctactgagccacgctaaataaagagctgggacttacttcgcggaaaatttgggagccaatgacaacattcaggctggacaacaataaattcacaactccccttggccatctctgtcctgggcccttgctgaccggctccacctggaattccatcccctccttccctctcacccccaggacccgaccgtcccaccctgtgtgcacatatcatgctctgtaaagatcatctgaatgtacacgtaggatgtcagtttgcttcttgtaagatagctagtactgattataaagaaaacaacaattccagattgtcagctcctcaagaagggccctgggtggggtgtccagagagcagcagtgaatgccccttaccaccagacacaaagcctggcactcaggtgttctctgaatgaccgataggtgccattagtaagatttataattgagctaatactttgcacaatattttaatgtaagcaaatgcacacacacaaagaactttgcaaagaatggaatgaatggagcaacaatattctccacattaagtctccaacttttataatagctttattgacatataattcacatgccatataattcacccattaaagtgtctgactcaatgtgtttataattgtggggctgtgcaacaatcaccatgatctaattttaggacatttcttcaccccgaaaagaaacccatacccattagcagtcactccccatattctcctctctccaatgcctagcaaccactaacctactttctgtctctatagacttgccgattccagacatctcatataaactcaatcatataatgatttggtgtcttttgtgtctggttctttcactcataatgttttaaaagttcatccatgttgtaacgtatgtcagtactatatttcttcatattgccaaataatatttcatcgtatggagaaaccgcattttatccattcatcagctgatgggtatttggattgcttctactttttggctattataaataatacttctatggacatttgtggacagatttttacagggatgttttcaattctccagtatgtacctaggagtagaattgctgggtcaaatggtaactctatgtttaacatttcgagcaactgcaaaactgtttccaaaacagctacaccattttacattcccaccagcaacgtatgaggcattccaatttctccacatcctcaccaacacttgttattgtcttttttatttcaaccatccatagtaggcagacctcactgtggttttgattttcattttcctaatgatgttgagcatatttttctgcaattcttggccatttatcttctttggagaattgtctattcaaatcctttgcccatttttaaataagattatctgcctttgtactgttgagatgtaagagttctatacatctcaatacaggtcccttctcagacacatgatttataaaaatattttcccattctatgagttgtcttttccttcaaatctattattatagttacctacagccttcagaggtaccaacaagaaacctttacaaaaacctaaccttcatcttacatcttttacaaagcttacgaatttgattacaaatgttcttctaaatgccattatcttcccatccggtttcttgataagccagcctatgctgaagccccagccattgctagatacccaccaccgatagctgggtagcaaactcctggataataaataacagtgatatttaccactgacattctggcatttcagaaattcaatctgtcttcccaatgccttattttaatggtttttacaaaaaaaaaaaaatcatactattactagatggcagaacctaatgtgtgtttggccagcctattttctttaaagccatgctgacaatgattgttaaaactgctcccatgctagaatgctcctcaattgtttccgtcttgacacaaggtcaatggggactagagtaatgaagaaataaagcaaaactgaaacattttaatttggggtctacaagactatattaacttctagcaaattaaatggatgagtggtttgcagccactgacatttatatttcacgattagttctctaggccccttattctctctgcgccattaacctttagggtgtagctctttgtcagtctcacttcaattatgctttcgagggattatagaattagcaattccagttttgatggcacgagctctgtcaaatcagagagacagatgtgagctcatgtaactgagaggcttccatctgttggactgagaactgaaacctggaaaggctcttgtatttcctttcttacgcttccttgggctgttccagcttggaattacccatttacttacatacttggtatttgagcaaatatcttaaatagctgaggtagcaacctttcttgccaaaggtggatggctactcaccatccaccttttagttatggattccaatgctggtgacagaggagaaagtgatgtcacctcatacatatccaaatcctagcatccacaggaacccacacagaatcaaagcccctcactaagttaacaggtcatccactgggatcacatcaaggctctgtcgactggctggaaggaacagaaggaagagcccatggaacagaagcagcaaaggattttattttcagcagagtgaaaattaggtgttgtatactaaagagaaattagtcatcctttggtatatatactcaggggattggttccaggaatcccaccaatggcaaaatccacacatacccaagtctcaaagtccactctgcagagcccgcttataggagaagctgggcctctacacacatgggtttcacatcctgcaatattttctgtctgcaattggttgaaaaaaaatcctgagtcgaagtggaccctcgaagttcagatggtattgttcaagggtcagctgtgtattctttctgtcagggttttctgtaagttgggaatgctgaaaatttctacaactgtctaggtctaactgtctgcaggtgacaaatgtatttctgaaaattagatagtaaattaaacctgatcgtgatttaaaggctctgctgagctcatatgtaaagcaaaagtggttctcagtttaatttcaccaatctgtgaaaattttctttttttttttttgagtcaggatctctgtcacctaggttggagtgcagtggtgccatcataattcattgcagcctcaacctcccaggctcaagtgatcctcccacctcaacctcccgagcagctgggactacaagtgccctccaccacgcttggttaattttttgtattttttgtagagatggggttttaccatgttgcccaggctggtctcgaactcctgggctcaagtgatcctcccacctctgtctcccaaagtgctgggattacaggcatgagccacagcaccggggcaaattttccttattgtttttcatccagccactcctatttcatgtctagtacaatgctttccaaagtgagttcctggatgacctacgtcagaatcacctaaaagacttatttaaaacacatattcctaggtctggctccagtcctaataaaaagttgtccagggacccccacgatatgtcattttagcgtgccccaagaggtgtctcttctcatgcctcttccactttcacaactgatcaataccaagatcagccaacaccacatcagacatttctaaggacgtgtcagcagtgacgtggcacatgggagaactgatgatgtatctcagtactcacatccactcaggaaatgcctgatgaacgagtttcagaaagcaagatttaggccgtcctggttacctcctgccagcactaacacgtgaaacagctcaagaccagctttaggagggctcacctctattttcaaataatgacgtctttctctaattttttttttaatgtttgcctcttgagagatcagggacttcattaagtaaccctcccatgcctcagtttccccatatggaaaatagctatactatctgctgccttctattcctataaggcatacagtcatatacttcctatttgtcttttgcacaacaaaacaactcattccccaaaagctttgaattaggcttgcaaacatagtccttaactaccaaactgtaaatttctcaaagtctagaaaaatgagaggggcaaggaaagaaacaaaaagaaacttaggcttaactgtaccagctagtctcaacttgatccgaaggaacactgctagcattctctcagctagcttctcacgattacatttaaaaccaccacaaagccaccacgatcacgctctgagaggccgccgcaggtaaacagagggatagggtaggaacagcccagcataactgacaatgctctttaggggatctgcagatctgccttctcaaacatctcatttcacttcatgaatatttacaaaatatttgcaaaagaagaactaaggcaatgaacatgtccagaaagaaccacatgctaacttctaaaggtttctctctccaaaaattcagtagtgccagaggcctgttcttttgtcccaggttgtttttcaagtgctacctcatgacagaatggatcactcataataactagatgttagcatctgtgtcacataattcatctctggcagtccacttcttttaaatcctaatagtaggcctcctaaataggattgctagcatttggcatctcatttgcctctatgacaacaaaactctagaagacgtagtttataatacattatggtttcagctgaatgacatttggttctaaggtctttgaaagtacaagtttgaaaatgccaaattttatctatatccatatctatagctccatctgaaattagacagattaccaaacagaaaatgtcactcagattctaaaaataaaccatgctattgctccagacaggttacaccagagggttaggaccatgacattttgctggggttcaagtgcaaatcagcaaacaaaatggcatgtttttctcttcctttttcacagctaaagattagtgaaggcagcattgtagtctgtgtaactgctcaacccaacctttatccaggagctagtattgcttctttaaaaacattttttttttttgtaaataaaatgtggtacagccatacaaggaactactactcagcaataaaaaggaatgaagtaacaaaagaccaaatattgtattattccatttatatgaaatgcccagaataagcagatctatatagacagaaagtagatctgtggctgccagggaccagcaggacgggggaatggagagtgaaacgggtcaaggtttcttccgggagtgatgaaaatgttctaaactttgatcccagtgataactgtacaactctgtgaatatattaaataccattaaattgtataatttaaacgaatgaatggcatggtgtacgaattatatctcagcaaagctgttaaaaatcttaacttaaagaaactatcatcttttaaaagctatagcagaaagagagccagcactggagagagtaaatatggtggcttttcacctttccaagaatctcaatgagccctgggcattgcaaaaattagtcaagcaactgtcacaactgcagtggtaaccaaatacggaagctgaatcaaatacggaaaggaaattcttttgaactcaaagacacaacctttccaaaaaaatacactgcaagcacacaaacagaccacacaaagtcaaaacaaaacaagtacctgtgtgggtggaaatgtatccaagtgccactcttttcttcaagtctttcattctcctcttattacttcaaagataagccctggatgggcaggaactaagttgttttggttttttctcatgacacaaaagatctggcagagctggagatttcattaccttgaaaggcagtaatatttgaaggtaccatgactattccctgaacagtgctctaaacacattgtggtggctaagagctatggttatcccacctcttcaatgagaatggggcattcattctacagaaagccacttacagacaaaatgggtatcacatcatccataaaatgaagtaaagaacagttggctgaaacttcccaaacagcccgttactccatgtgatataaatgggtttgcaaagctcaacaaaggaagacaagcactaggaaggcaaagccagtcttcctagcatgataaccaaaagtgtctcagccctctaaagagctctaggatctcaaatcatgtgcacaatacagagaagtgctaatggtggaagggatgcacaagagatggtagatgtcttgccctcaaggaattcatattttagatagggtggctgggggtgggggtggggggcagtgaaactggattattttttggcaaacatgcaaacgagtgttatcacttaaatgtagtcatactagaatgacttgaccctattccaaataaaattgccactgattaaaagacacttgcaaactccacttgtggaactggcttcagaatgacagagaaaaaactagctcttcactttataggcatacttatgtataagtatggcaaggagtaagcactgtgtttgttttatacacacacacacacacacacacacacacactctctctctctctctctctgtcggtttttaaattactggccactggtgagaaaaccatcaatgtgtccaggcgcagtggctcacatctgtaatcccagcactttgggaggccgaggcagttggatcatctaaggtcaggagttcgagaccagcctggccaacatggtgaaaccccgtctctactaaaaaaaaagaaaaattagctgggcgtgggttagccgggcgtggtggcaggcgcctgtaatcccagctacccaggaggctgagggaagtgaatcgcttgaacccaggaggcagaggttccagtgagccaagatcgtgccattgcactccagcctgagtgacaagagtgaaacttcatctcaaaaaaaaaaaaaaaaaaaaaaatcaatgttctgagaataagatcatcgcagtattacgttaaatgtgtaattttccaaggtaactattacttatttagatgtgtaggttgttacatttgtttgcttttcatcagtcacatttacattaaagacaataaaatacaaagtgatataactgccaaatgtatattacagactataaactcaacagaaattcaaaagaggatgatataaacatatcacacattgaaagaggacaaagcatcttgctaggcactgacattttaaaaggttaaagtacaaaagttactttagataggaggaataaattctgctgctctagtgcataggaggattactatggttaacagtaaaagattgcatattctaaaatagctacatgagaggcttctgaaggccctcacaacaaataaatgataaggtaatgaatacaagaactacactgactggatcattatacaacataaatatgtattaaaacatcaaattggcccagcatggtggctcatgcctataatcccagcactttgggaggccaaggtgggcagatcacctgagttcgggaattcgagaccagcctgaccaacatggagaaaccccatctctactaaaaatacaaaattagccaagcatggtggtgcatgcctgtgattccagctacttgggaggctgaagcaggagaatggcttgaacccgggaggcagaggttgcggtaaaccgagatcgtgccattgcaagccagcctgggcaacaagagtgaaactccgtctcaaaaaacaaaaaaaaaaaagaaaagaaacatcgaattgtaccctaaaaatagatacaatgtgttgactaaaaaataaaatttatcaaaaaaagtttaaatgttttcccaaatatgaaaaattaataagcatttaaaaattaatcaatctcggccgggcgcggtggctcacgcctgtaatcccagcactttgggaggccaaggcgggcggatcacgaggtcaggagattgagaccatcctagctaacacggtgaaaccccgtctctactaaaaatacaaacatttagccgggcgtggtggcgggcgcctgtaatcccagctattctggaggctgaggcagaagaatggtgtgaacacgggaggcagagcttgcagtgagcagagatcgcaccacttcactccagcctgagtgacagagcgagactctgtctcaaacaaaaacaaaaacaaaaaaatcaatctcactgctaataactttaaatttaaatatgagatactactttggaccaaacaattgccaaagattttggggaaagcatgctgattagcatgcagtaaaataggcacttccataatctattaagacctttcaaatataggaaatatccttaatgaccaactacagagaggtgtttgcataaatgatgccatagctataggaaaaataagtagacattaatgattttttgtagaatttcaaaaccaaagccaattttcacaatactgaatgaaataaaattcagaatataaaattttaaacacactatgattttggttgtgttaaattatatacactcaggagaaaagactgaaatcaatagtgcaatatggttgtttctggggtgtagccaatcttttcctattctttatacatgcctgtgtttttaaaagattctacaattctctatatttctttggtattcaaaaataaaagcagacaataagaagaaatattcttcccaaaacatgtagattgaaaaaaaaaaaaggttaaggtccaattcctgcctataagatcttccaggtaaaatttcataaaacgaggttgggccacaccttgaaagatacatagaatccacatagctggggctggaactgggggctcacacctgtaatcccagcactttgggaggcagaggcaggtggatcacctgaggtcaggagttcaagaccagcctggccaacacagtgaaactaaaaacacataaaattagccagttgtggtggcaagcgcctgtaatcccacctactcgggaggctgaggtaggagaatcacttgaacccgggaggcagaggcggaggttgcagtgagatgagatcgctgcactccagcctgggctacagagcgagacgggtctcaaaaaaaaaaaaaaaaaaaaagaatccacgtagctggaaaggagtagaaagggcattccaaatgggagaaaaaactcaaagaatctaaagagggaatagttggcaaaccagaagataaatcaaattggagttacgagagcttaatccttgagctttattttaacaggccagtggttggatgaatcactaccaaataagaaataaagcaaagctatactaagctaaaggaaagtgttctcaaaaaagagtcttctgtgccacgttggtgttttttcacatccctctatctggctgcctgctggtttccatggcttagatttacccatttggaaaaacaacccctcccctgacaataccaaaatcactacctctgccatgaaattaggcaagaaatatacatactccagcctctaatttagacaataaacttgccaaaagtacggaatatatctttttttcacatagtaccaatcaacagtgtcataataggcattccaataagtaatgaattacaagttaacaatgagcaacaccttaatattgtccataaatccccaccagaactgaaattttacaagttggcaatatcaattattggtaaagatttagagttcctggccgggcgtggtggctcacacctgtaaccccagcactttgggaggccgaggcaggtggatcacctgaggtcaggacttcgaaaccagcctgtccaacatggtgtgaccctggctctactaaacacacaaaaaattagatgggcgtggtggcgggcgcctgtaatcccagctactggggagggtgagagaggagaatcacttgaacccaggaggcggaggttgcagtgagccaagatcacgccactacactccagcctggacaacaagagtgaaactccgtctcaaaaataaaaaataaaaaaataaataaagatgtagagttcctgaaatgcttatacactgctggtagaagagtaagatgctataaccactttggaaaacagttgtgcagttgcttaaaaagttaaacgtacccaataatccggcaattctactaagtatttacccaaaagaaatgaccacatatgtccacaaaaagcttgcataaaaatgttcgaacactgtacaacaaagtgtacctcttaaaatggttaaaataatacgttttatgttatatatatacttggccacagaataaacaattctgagcaagttcattcattatagttgaaaaccggaaacttaaaacatcatccatcaagtttagaagagatgagcaaattgtggtatacgcataagacgacaatgccaaagaacaaactactccaggagcatgcatgaatctcagaaacactacgttaggcacaagaagctggatccaaattactttatacgacgttcaagaccaggccaacctaatatataactgcagaagccaaaacagtggttctctttgggggatgtgcgtactgactggtaaggaagctcgaggaggctcaggggcgatgagaatgctctccctcttgatctgggtagtcagccccaatcaaaaagactattaacaataaatacagaataatggaggccaaagtttagacagcccaaggccaaccactcataaccaaaacttaagtcatcctgatttccccaaacactaaacctaaatataaaagaaacacaaatctgagttttttgtccttatcagcagataaggacaaaaataaggtttgataaggatcaaacccatcaactaacaacaaatcagcttaaacagctgtctgccttaaggatctatacatgacagccattcatgaaaaaggtcaggtcattcctcctttatgctctaaactgcaccgtaactgctataaagtaagactgtgacatttttgggtttgaggtctcccagtccatgaactctcctcttgtatgtatgagaaacacttaaaattctaacttgatctaattttatgtttgacaaaacatggggggaaaaatttacaaagctatacccttaggagttcatcataattaattatgcctcaataaaaataaaggaagaaagaaaacagaacaagtggaaaatcccagtccattatcccaattaagccccaggtttgcattttatctagccctcacgaagtactccactatcatgaggtcagagctcatcatcagaaatccccctcggagtgctgtagtgtctgtcctattcaaggcagcgttaggtctgaccacagtattttcagaacatacaactaatccatcaatttcttaagccttttaaaattcactgaacttggccgtgcgcagtggctcacacctgtcatcccagcactttgggcaggcagatcgcctgaggtcaggagttcaattccagcccagacaacacagtaaaaccctgccttactaaaaatacaaaaattagccgtgtgtaatggcacgcacctgtagtcccagctacttgggaggctgaggcgggagaatggcttgaacccaggaggcagaggttgcaatgagctgagatcgtgccactgcactccagcctgggtgacagagcaacactctgtctcaaaaataaaaaaaaaataaaataaaattcactgaatttaaaagttctacatatatttcattcctattaagacccaagacgaaccatttcatctttctttttaaaaaaggctaataatgcttcaataaatgctagttcccagtatagtgacagatacaatggagtgaggcagtctgactctggccatagttaacagatcaaggaaaaaaatcccacactcctaagattccaaagaaattttctgcaagtttccttaatgtactttaaaatccttcagaagaccatggggaaaataaatcatcctctcaaattcatattctgaagtttgaaaataaaagcagttccttttcatgtttggatatagtcactctgaacagtaaatcagctaacagacatcaacctggcataagactcttcataacctgtaattatcttctttatttccctgttgctcatctgtctcccctgctagaacatacactccataaagtcagggatcttgctgtctgttttgctagcagccatatccccagcacataaaacagttcctggcacataatgggtattaaatattttcccatcagtgatcagttcgtttagcagactgtccaaagtcaagtaactagaaagcaagacgaacaagggcagctatctgtaatcaagcagccaacttcaaatgttttcctacagaagctaagtcctaaagagtttttcttctctctcttcccctcttattaatattcctccttttcccagctatctttcctgcctctaagaacagtattctaagaattaagaaactcacttgtatcaccaactcgctgagtatccttgggctagtcaggcaatttcaatgcttatctttagtcaaaagacactggagtcattcataaggagacaacacttgcctggtgtgaagaacgagtagctgcaagacaaaatcctagccctcccagaaattagagtaagccagacagaggagggaggtaacacagcgagataaattccatggcagaagtatgcacagcatgccatgaaaatacaaacacctaatccctccaagaaggcagaggagggccaggagcggtggctcacacctgtaatcccagcactttgggaggccaaggcgggcaagatcacgaggtcaagagatcaagaccatcctggccaacactgtgaaaccccgtctctactaaaaatacaaaaaaattagctgggtgtggtggcacgcacctgtagtcccagctactcaggaggctgaggcagaagaatcgcttgaacctggaaggcggaggttgcagtgagccgagatcgcaccactgcactccagcctggcgacagagcaagacaccgtctcaaaaaaacaaaaaaaagatgaagaaaagaaggcagaggagaggagggtcactttccagaagaagcccttgcccttgagggactaataggagccacgagaaaggaacagggagatttcagatagaggcaaaagggcttactcacaggaagcagtttcacgttatgtggactgcagggtgtgagcgaacatggaaagtaaggctgaagaggtaagccggaatgatattctggtaatattacagatgtaaacctagaagaagatgagattagaggcagggagcagtttagagattattttagcaattaacaggaaaattaatggagacctcgtaagagaggagttcccaggacctcttcaacctattccaccctttgccccaggtgaccacgctcactcaaagcttcaagtattctctatccaagtatctccagcagcagcctctcctgagctctagaaccatatacccaactttctattatttatctcttcttcgaaatctcagagcctttaaactcaacgcagccgaagctaagcctatgagctcaccccagaacctagtcctcttcctgtgtttcctgtctctgcagatggcagcaccacccatccgcttgtaggagctggaaacctgggaggcacccttagtgtctcctacgtcctctccctcatccgctgttcaatccatcaccaatccctgccaggctcctcccctaaggatctcatacgtctatccactgctttcctctgtggccaccgtcagaatttgccttacccctatctcttgcctaagccagtgcaccaggttcacatcctctcctattactatttcatctcttattcccttccagtccattctcaaactgtgacaaaagtttgtttttagtgctcatcagcctgcgtcacccttttatgcccgcctactcaccccgaggagctccatcaagcccctcttcactggtgttgctcaccatatgtgcaccagcaccttatttctgaaggaatgaggactcaggttttttttttttcttttgagaccgagtctcactctgttgcccaggccagagtgcggtgggatgatattggctcactgcaaccgccgcctcccaggttcaagtgattctcctgcctcaccctcccgagtatctgggatcgcgcaccagcatgcctggctaatttttatatttttagtagaggcggcgtttcaccacattggccaggcaggtctcaaactcctgagctcaagcaatctgcctgcctcagtctcccaaagtgctgggattacaggcgtgagcaaccgcccctggccaggactcagtatttgagcaaagggaggcaagaattttaagaatttgtaaaaagtcagtattgcatggcataaagagactaaggtaaagactaaaaaagactgaacttgccactaggatatcatttagtgaccgtgtctggaacaaattcaacagagttgtgggagcagaaatcagaggacagcagattaagagggaaagggcagaaagggagtagaggtgagctggccttcttccaataacgtggatggcaaggacgatacagtctaatggctggaacaaacacaagatttagggaagggtttgtttttgttttaaagttgggagagacttgtataggagcacatgatgaagggaaagaagcaggagaggaagaggagggtatcagaacagaaagagatctgtgagcaccaacagaacaatctgccttcatttcccctgaaggaaggaacatgaatggtgatgaattcagaagagcttgcaggcagggaagcaacatgtggttcttttattttctctaagatatagagcagattcttccagctccacaagaaggtcctctcccactcactctctctttattggacaaaatatagaaccaaatactgtatgcactgtatcaaacaccaagagcgcaatgcttgatgtccactgtgagttctggaactttaccttgttccctaccagtatcagccctcttttattggtatgaagcctctaatagaaaaaagcctcccagcctggtctccagaaactggtgttaactgctccgaattttgaattcagcagagctgtgctagaaaactgcacataaggtttatactgagaatgacagctattttccattccctttactttctagtcggtagaacttaaagcctggcacagctgctattacatattccttaaacagcgaaccagatcattctcgtgggtgattttaagcattagagaagaggtcataacttttcagcaggaaaataaaacaaaggttctttctggggtcagccaatagtttatcagtggctcatcagaaaaacaatagtttaaaaggacttgcgtagttaagaatggaagaacatgggtaaagaaaaaaactgctgacattaaaatagaattttaaattaatctcttgtcgcgttaatagtactgccatataatggaagatgcatttattttctaaggggaaaatgtccagaaacttgcactcatcactcccttaactgttatcagggaagaagtgtagagtctcccagctggattatgggtagtgtaaacatctttgctaaattgcttggcagagtacatctgcatcaaaccattagagtctggaattcactctattaaaatcaaatcattagccaagaagaattaacaggaaactattttcatgcaaaacagatataaaataaaaatcaagagcaatacatgagtaattctttttcattcacaattttagatggtgcataatgcagagtattgttttagaaacgtgctgctctctaacagccatctctatacaatatagggtattgtttggatactggagcaatttaagctttttctatgtatccaaaagtccctggattaagatccaaagaaacctggcacagcaacaaagttgacttgtaacacatctcagcctttaagcaaattgtttattaatgcagcaggaaagtcgctgttcaggccctaagtaagctatgtatctccggaagtgtcccccatgttgcattctccaaaactgtgcagaattttctcctagttttccattacaccaaggatggtgggagggcttcaacaggtgatgaagaatgtgaacaaaatactaactgaaaaaaaagttcttcccaaagtatcaccaactctgtttaataaacagtggagctacagatgaatgagaagggaagctgggacatatattatctgtatataatgtctgtatatcccacagccaagagttctcacactcaaagagacgctggcttcacatggagaaaacaacctctcaggatgtgtgcactactttaaaagatctcacaaaaaagatacaaaagaaggcatacaggcatctccctatacagggtaaaaaaaaaaaaaaagctagaatttgtttagaattagacacatggtagtaaaggtataaagaaaagcaagttacaactgtggtgaactcttggggctgggagggatctgatcaaaagataatacctggaaggggcgatttactatttcttgacctggccatagtcaccgggttgttcatttctctaaccataaaatacacatttttatacacttttctgtatgtatatttcattataaaacatgttgagagatcgatccctaatacatttcttagtagagtataggcattccataaatgtttaataacagaatggataacaaaatggtactagtactaagttttctctaatcacttactagatatatttcagtttgtcatgtttacagacttctttgcaaacaaaagagtgaaatattaagagtttggaacgatcctatgcatagcaacacattaaagaggacttttaagaatagattctctatttcatttagagtaaataaacattctttcaactagtcatgattcacattgataggattaaaacattctatacataataccttgaaattaaaacaatcaacagaattaaacaacaatgcagaaaaggcaagacagcaaagcaaagtgacaaaaataattccttcgaacttacagaacatgtaacattcagaaaggaaaggagagcaaatgaagaaagcaaaatcattttcaggtcctgcttttaaaaataagcaaccacggttaggattttgttgtggagttggggggtgggaaatgacacatgagttcattaaaaaataaaagacggagagaaaactgttttggaatacaatgcagagcaagtcttaaaaaacagttgccatgagcttcaatgtgcaataataaataccactaaatagaaaccgccactgaataaacgtcagatactttgagatgacaaagatcgccagaaacattccctggtccgactgtttttatatatttgtgtacatgcgtaagtgctaaatctggatctaatttcttcctgaaaaaatccagttttctgcaacatcctcacagtcagggagaactaagctatattgagaagtttggaatctcctcacgtgccaaggaggattgctttctatctttaccgcatgttttaaaaaatcttcacagcaacacatccaggcaccctaggaatacaaggccacgcagacaatagggaacggaggaaggagggaggaagacaaacctggcctccagaaggagccaagtgtaggctccaagagataaacagccaagtacaataatctttcgagaagcgggctgagaaacaagggtgggagctggaaggaagggtataatcacaccttccttcacaaactgtaattaggagaaagacaccagccaggccagctctctcgcagagctcctgggctcacctgggcatgttttactaaccaagctcctcctagtttctttctctctctctctgtctcccccttcctccctaacccccactggcccccactccctatcctttcctgcaagtaaaaagctaaagtaaaatgactttccacagcaaaacagttacagatgttctacctcggaatacatcccagatcaagagctcgtcacttgatatgcagggctggggaccaggagagggtacgaaatggccctgcgctgtggccttttcacctacccaagcctcctaagtttcctgaaggttctgagctcattagacaaagaacaatgaagccaggactccactcaaccgctggtggttagactggtggaaaacaaaagatcacagggtctcactgaactcagcaactctccagtgtgcgtcttcccttccattccagaaaattaatttaaaagttgcccgtgatgaaacaagggataactgtgcctaaaacaatgaaccgttctaaagcttgaagtcggaataattcgctcttaagctttgagaggatcacactatgcaatgtattcctactttctcccaatataaatcacgctattaaattaaaaggagagaattcttccaccaaattacacactaatggctcttaacccataattaaagtatcgctaccagcagtgtaaagccccagccagccagggctcagacccaggtctcagccccagggatgatgtcagtgcagcgacagcgatcttgaggaaagcccgtggtctaacctgtccctgtccctgctccctggggactggctctggagctggcatccacgcaggcctcctcctctgcacaggcagacaaaaggaaagcaagcccagtgccagagcagcacgaagagcaccttccagcgaggccggtcactcagaggtgtctcacctaccctttccccaacatcacaacagcctcggaatttggaccagcaactggcttcagagcaaggagaagtgggagaggctccactgtgtgctgtaatccagggtgttatccccgtgctaggccgtgagggcacccaggacggggcatgaccctaacatcacggagctaatgaggagataagacatgaaataagcccggcgcggtggctcacacctgtaatcccagcactttggaaggccaaggcgggcggattacctgagatcaggagtttgagaccagcctggccaacatggtgaaaccctacctctaccaaaaatacaaaaattagctggtcatggtgcagggcacctactgtaatcccagctactagtgaggctgaggcaggaaaatcacttgaacccgggaggcagaggttgcagtgagtggagatggcgccactgcactctagtctgggcgacagagcaagactccgtctcaaaagaaaaaaaaaagacatgaaataattctggagaggcagcacggcatagaagattcatagaagagtcaaaactcaattcaatcctgccacaaactttctaaataaactaaatcaactctctgaaaaacagagtttccctctctgagcctcactttccttggtgaaaacaaggcaaaggtattagatgatgtctgaggccctggatagctctgcaataattagatagagaatacaaggcagtatataatcaagtattaaattatacaggagcaactacagctgccattgagagcttgcactgatttttttttgagtcagccttcattctaaaccacttcctgaaagcccactcagaccctgtgctaggattcagggatgcagcggtcaccaagacagaatgctctgccttcacgaggctttcgccagtctagtaaggtattctcaggtgttcagaggagggaaaaaatgagggctggggttggcctatgacctttgcatggagacagaggcaaaactgggcttcaagtgggtatcatctgagcattcagtggggtgatggacgcagtggttaattgctgagtacggtagtaataagccatgaggttctgaacacatagcacaagcccagttctactaatccgctcatcattagtgaagggaattagttagcttccagaagtcagccagacttcgattcttccggccctctccctaacgtctccttctcccaccccaaacctgctaattgtggttaactttttccctttattcttttcagttattcttgcagacaactatggtggagggcaggagccaggaagcagttaccaaggagggagtccacatctaagcaatatggagtcagtcaggaaggaagaccttgtatgctacaaggtaaacggctaaaaagatcgatttgcgtattaagtcacaagagaggtttaagaaagacagtacaggctgagtgcggtggctcatgcctgtaatcccagcactttgggaggctgaggtgggtggatcacctgaggtcaggagtttgaaaccagcctgcccaacatggtgaaacccatctctattaaaaatacaaaaatgggccgggcatggtggcaggcacctgtaatcccagctactcaggaggctgtggcaggagaatggcttgaacccgggaggcagaggttgcagtgagccaagatcgcgccattgcactccagcctgggggacaagagcgagacttcatcaccaaaaaaaaaaaaaaaaaaaagaccagacacatggtttattttagagtagagctatgtctcatacaactaaggaatatggtataatttagctggtaagaataattaaccatccgcatcttaatttttaaaactaaaatgtcataaaattaatttgtcccttattcttaaggggcatgaaacttgactgtgccctaaatgaaatcaaatgttgcctaccaacagtacattccattttccaaacaacttccctggaatgctggggagctgatatgtttaaaacgaatattctccaagtccaagtgttggattttaaagaaccataacctttccaacttttcctacaaaaaaatcccgtgtgtgatttatgcccatcttcaaaacaccctctggagttcagaccagatgtgtgcagtgtttacactgagaaaaccactaggacatcaacaattcactataaacaccactcaaattttgctgtgctttccttcatttcctctgtatttattctggtgttaaaataatgttaactctcataataaggaaaataggagcagatgtttaaaccaaacagacttcagcccattatcccatatagctactcaatcttcaaaatcaaagtttcttcctcccaaataccgagagagaagagcagagcagagcactctagtttcctgggtgttgcatgctacacaacaactcgacctgggctcgctgtccgtaagttggtcctcaccaatcggagacaggaaaaactaatctggtatcaatttcctaacaatcttatatttctctcttaggccattatgttttgtttttaaaatatcgtattacttgttggcaaagacaatacaacagaaattgcctcagaagtttttctttcttgttgggggaagcggggatggttaaaaaaaaaaaaaacaagaaaaacaaaaccctgactacaatgtgtgaatgtcacgggaaacaagcccagcaatggctgcttacggctttctaaagtcggctgccttttttaagtgagttcagaagcaagatgttacttaacacatcagatgcaaagaaagaaattcacgaaaattctcatagcaggaactagtaggagtaaagaaaaacaaatactctttttaaaaaacgttaaatatgagatcctcatccatagagttttaaaaaacaacgtgaatgagggttgttgttgttttttttccttgaaggggaaaaatactcttgaaagggtgagttttcaactgattaggaaacaggcctgaagtttttagattaaaaaaatacaagtgaatcaccctcccaagtttttgtaactgttttctttttcaagagaaatgtcccgtgtattattggagaaaaaatggaaactgctcctgctgaatgagaaagagaagagtcccggatgtgtgtgtggttacaacagaaaacactcttcctgccaggccgaactcccccggagatgccctcggcggcagacccagggccattgccactttttcaaatcgcacgtagaggatgtccgagggcttaagaaatagatttttctctgactgctaccagagacagttggaaatacaagacagtgggggaagcacctcgcgggcagtaggaggtaataaataacagttcggcgcggctctctctttttcagggcaggctgggggtcggggtgttgtgtaatcgctcccacagggagcggagcgcgaggaacaccccccagtgtcagcgctccccgggctgcacaggaagcgccagcgagacaaagagcccgcctgtgctcgctgacacggtgcccttccggccccacgcgggagagggacattctccgctgtttgggacgctcactcgcgagcacaaaaactcgctgtaactttggctccccctccgtgagctgcagggcgccgtggcccacagcagggtacagtagacggtgcaatccttaccagcccctcccccaaagaggctcaacttttaccggcgtcctacaagtccttcccctaaagacaatattaacggaaatcaaaaatacatacattttaaagagttaaaaatgtgaggcgcgagtacgttgcaagcaacgagcaaactttgaagggtttctacttcactgcctccccgtccagccccctccaccgccccccgcagcctgagatccgaacacactcggtgccgaaccgaacctaagaaacgccggcctttcaagtgccctacaccccggaggaggacagcgggcgcttagaaggcaggcacccagcacactgaggaggagtggccgggacgagcaacgggcagtaattctacaacgggacatctaccttcgtagcacagaatgccgatattgttgttcatcttgtccaagtactgatagttcaacaggtccatcttcataaatagcatttattgggctagcaaagaaaaccagctctttgcttttgccccaaaagagttaagtttcaaaaatcaattgttgctgagtagctcctggctcttcaacttcacaaaggcagaggcccagcctcagactatcaaaacaaagtatgcaaaagttaaaaaaaaaaaaatcaggcacaaaaaaatcgagctcacacgaaacccttcaagggcttactggtagacggtgtatgtactgtatccccgatcgagtatgaaaacagcgtttcagaagtccttacaagtccttcctggaaatggaaaagagtgaaaaagagaaacgcgcagcccgtttcctaggacaaagcggcgccggcccctctcacagcccgctgcaagccggcagcgctgacatgagggctatgcttggcatgactcctatgccgccgcttcctcttcccgcaggaggccgagcatgctcactgcgccgcgctgccgaggcagggagggcttctgcacaggatcagcctctcaatgtagcaagtgttggaaagaaagagaaaggggagggggagagactctagagacggggccttggcagagtggctcttgacaggaagcagccaagccgctgcaaaaccgtaggaggaaaaaagaaaacccaggaagtttctttttcaggagctaagtacaaagtaaaaaatccatcatggaagcaaactcccatggaatgcaactttcgtgaaacttcatgttggggtttcggaaacccaaagtgctagtgatgcataagccatatatatatatatagtgtctttgtttcttttaaagattgttttataatatccatttacactttaactggatatttaaatttctgatgttaatgttacatatagcttcttccataatccccataacaactgagatggacagggcaaggagggtatcaccctttcacagcagaggaaacaggttcagatggattaaatgactggcccacagcccccaaaatagttgacagaactacttttaaagtgttttttcccacctaatgttataattttatttaaaaaaacgagggggccgggtgtagtggctcacacctgtaatcctagtcgaagcaggcggatcacttgaggtcaagagttcaagaccagcctggccagcatggtgaaaccccatctctactaaaaatacataaattagcctggtgtggtagcgcacgcctgtagtcccagctactcaggaggctgaggtgggagaattgcttgaacctgagaggaggaggatgcagtgagccaagatcgtgacactgcactccagcctgggcaacagagtgagactttgtctcaaaaaaaaaaaaaaaaaagaaaagaaaaaaaggagacaaggagaggagaagagatggaagagtgtttaagcaaatagggctataatatcaaaaattaaaagtgtacttgaaattatagagggaaagggtaaaattattttcatttggcatgtatgtcacccacctgtgtgtaagaagctagtggcatgcagctgtactatttgctattggaagaacttggggcttaaactttgattacccagtgcctagcacaaccaagttcaggtgcccaaaaactgtttactgaacgagtgaaccactgaatgttcagttttcagcacatcaagaacgtgttaacaaaatagaaaaaaaaaaaacaaaaactaaacatttgaattactattctaaaaatatatttttaatattccaaaataatatttgaataaataatttgaaggagttgtatgttaaaaatccagcaataggccaggcgcggtggctcacgcctgtaatcccagcactttgggaggccgaggcgggtggatcatgaggtcaggagatcgagaccatcctggctaacacggtgaaaccccgtctctactaaaaatacagaaaattagccgggcgcggtggcgggcgcctgtagtcccagctactcgggaggctgaggcaggagaatggcgtgaacccgggaagcggagcttgcagtgagccaagattgcgccactgcagtctgcagtccgcagtccggcctgggcgacagagcgagactccgtctcaaaaaaaaaaaaaaatccagcaatagttgcattgggtttattaggcacactcatggcaaggtgttctaatgaaatcttacttgggagtccggatgcggtggctcacgcgtgtaatcccagcactctgggagactgagacgggcggatcacttgaggtcaggagtttgagaacagtctggccaacatggtgaaaccctgtctctactaaaaatacaaaaattagccgggcatagtggcatgtgtctgtaatcccagctactagggaggctgaggcaggagaattgtttgaacacgggaggcagaggctgcagtgagccaagattgtgccactgcactccagcctgggtgacagaacaagactccgtctcaaaaaacaaaacaaaacaaaaaaactatatgacatctaaatactaaatactgttgccgtcattgctgcaacagtaatcactggggtgacatcaggggaagtaagtaataggggaatcaagatttcacaagctttcatttataagaatatttattgacactatattacatgtaataagctatagtgaaagatatgtatcctatcaattgtaattaaaatacttaatggtatttggtggggagggttgaagaaaactcaaaactcgtaacatccagtatacatgagatcattgcactgaaaacaaacaatatcaggtatcagatttaaatttaactgatagttttggagtactcttactgtgctacgtttttacataaattctcaatcagaaaactttatccatcattgtcccacatggaagagaggtggctgcacattagaaccaggggggagcttttaaaaatcttgctgctgaggttgcatccccaactcatctgaggtgggaaccagcagcagtagcttctaaagtcccaggtgattccaatatgcagtcaaggttgagaaccattgctttcatctagggaggaaaaaaaaaaaaaccctgccttaagatatttcattttattcacttattttgacatgaagaatttttttaatagtaatttaagcaaatgattcaaacaataccattgtagaaaatgaataaaatatttggtaacgtcccttaagggactcagcatcacttagaacagcagttctcagcctccgggtggcaaccattttcgtggacaccgtctcacaggtctaccttgactattgtaacattcccagccacagccaccacgtctttcccgctgatccgggaggctagcacggtgctacccaagtgtgatccagaggggttcgagcaccaggtgttcctagtccccaaaagctagatacagaaacggagaatgaacatttaaaacttttatagcaattcgatagactaattttatgtctctcaaatcttaatattaaagaaatttgagggctgtagttttcgtatttctagttatagggctgcattacattttataaactatcagtctgcaacaaagtcttggggaaaaatgaaacaaacctggtttcacagagaagcttgtgctccagaggggccagctacaacagcccgcctctgcaggctgggagcgcctcctggaccggctctaggcctttccatcccagctcctgacaactttcaccttagtttcaagcacactggatgacctgcagtgagttattccacaaagcacatcagtatgcttctcggtgtgcaggacgtctcttctttcccaacctgtctactcagcaaacatccactcttccttgagacttgtcagaaagcccctcttgtcctgtgaaatctccctacgatcccatcctaccatctcctcacaccctacgccaagctatccttttacagggtaagtagtccttatccaaaatacttggaccagaagtgttttggatttcggaccttcttggattttggaatagttgcattatacttaccagttgagcatctctaattttaaagtctgaaatctgaaatgctccaatatgagcattttcacctgaatgttgtgtcagcactcaacactgttcagattttggagcatttttcatttcagatttttggattaggacgctcaacccataccttatatgtgcttctttcctagcctagatcttcggagcaaggactatgccttcctcaccttttcgaggtcagtctggcagaagtctggcagaagcctggcgcatggtaggccatcaataaataccagctgaataaaatcagtaaacatctaaacggcagattcttcatttccccatccctacttccagcacactctggattatcttactcgatgtcattaggtggctgtcaacatctcttggagaccacaggtccttgcctttaagaaacaccatgtagattctgattgtacttcagggtacaatcagctcatccataaaaaaaaaaaaatactagaaaatatcaatccttctcagattcattcataggataatatattcataattaaagtagcaacaggatagttttgtagggaattggaaagatgggtctaaattttatccacacacacaaatgagatgggaaaagctagttctttttctacgaatgaataagtttgatctatcaaatatttaaaacataaagcaaagaatatattttggagtgttactgggtagagactaggtaggaccagacagatactgtggatataggaatcagaaatccaggccaatggggaagaagtggattacaaaacaaacattactgagaaaagaatccagatagcactttgccttatactgtacatcaaaataaatcccaaatgttttaaagattatttagatgcttttaaagtaaggtttttgctgcaaaaacttacaaaactataaggatatgttcagactatctgatgtggaataggaaaacatttgctaagccagaaataaaatttttaatcaaagacagaagccaccaaggaagatgtagaatttgattgagaatacagattttatgcttttatacatctaaaaacaccaaaaccaagtaaaggcaaaatacaaaactgaagaatatatttgtgtcatatattacagtgaaggataaatgttcttggtattcaaagaacatttaaaaatagaaagaacaaaggaaaaaattgaaaaaccacttgatctgaataacattttttaagagcatgagaaacaaatggccaacacatttttgaaaaactattcaaccttactaataatcaaagaaatataaattttaagtgattttccagctaccaatttaacaaaaagactttttcaatcttatttcttgctggtgaaacaggatgccattggaatctttgctcactgctaatgcagtataaacagataacgcctgtgtataaagcaggttggcacacactagactgttttatgaaaaatgtccatgcctttgtccttgccttggactctacttctagacttctgtcttaagaaaataagatttgaagagtttcataaagatgcttatcatacagctatgtgtaaaatgaaaacctgaaaacctaaagtccaaataaaaggatgcattaaaaccgtggcttatcgatgacagactattacgcagccattacaacaccttcaataatctataatgacatgaggaaatgctatgctatatactgtgtgacagtactacatttgttaactgaaaacaataaaaatcggatataaaactaaaacacacattattcaccaactgtgctaatgtatttatgaaaacatacatatatatataggaaaaagtatacattaaaaagactggaaagtattccaaaatgttaatagtgcccatctttgaatggtgggcattttttccattttcctgaatttctaactagcctacaaatagtttattcttcctataatgaagatgcggataaggaaagttcttgatttttaaaaagcagcaacacaatgaaataatattccctggtgagacataagcaatggatatgtatatcttattatagcttacatatctcatgatatctccttttgatttgggtttaacaacttaaaaataataagaatccaaacatttctttagaactttggaacattcaaagatgtttaagatggggtatctgtctcaaagagcaaaattgacagagacagctctacacttgcagagcttatagacatgtgtacgtgctttttatcttctactgcttactaattatgtcatatgtcagtaccaattcccccaaactagaccataagcttctagagggaaggaaagctaagcctcagtccttagagtaaaactcccccacagcacacaagtgctctatttggtttggtttggtttggtttggtttggtttggtttggtttggtttggtttggtttttttgaaacagggtctccctctattgcccaggctagagtgcagtggctcaatcacagctcactgcagccttgacttcccaggctcaagtgatccttccaactcagcaggaccacaggtgcatgccaccgtgtctggctaacttttttttttaatcattttttgtagagacaggttctcactgtgttacccaggctggtcttgaactcctggccttaagccatccacccgcctcggtctcccaaagtgctgggattactggcatgagccaccacgcctggcccaataagtgctttataaatgttaattatggttgtgcctcagcatctttgtggaataatggcaatatgacgatagaagaaagcccaggctaattactaggctgatctgtttaattagctagaggtttgactaccactttagaatagatcaccaaaactgcgagctgtgtaataaaagccaaatactcttctatttaatatcagcctgtggaaagaaaagccaaatgatcaaaatcactccccagacatttatttaaaataaaatgctttcatttgagcacttgaagagaggggaaagttttaatgttaagtctaacataacatctccaaataccacattagaaaatatgagtaaccctactgcgctatctgtttcccctactgggttccgctgtgctcttcctcccagggtttcaagtaagctggatatttagttaatactttcattttaaagtgctttttttctcttcttgctacacatagaaaacacacacacacacacacacacacacagacacacactttaacctgatgtaaataatattcaaaacagaccttactaataacaagaaaataagtttgactattccttgagctaaagcatcagttaaacaataagttggaggtgcaaaactgtcatgtttcagaggatctctaggtccgtcgcaatttaccagcacattcctcagtgtactaagaacagtaccaatgatgatgatgatggtggtgtttgtaaaacactacactggtcaacacatttttgcttcgtaatctacttaatttaattactaagacaaggttgtaagaaggaaagcatagaaaagggtttaagggaccaggcgcggtggctcacgcctgtaatcccagcactttgggagggcgggtggatcacctgaggtcaggagttcgggaccagcctgactaacatattgaaaacccatctctcctaaatacaaaaaaattagccaagtgtggtggcaggtgcctataatcccagctacttgggaggctgaggcaggagaactgcttgaacccaggaggcggaggttgtattgagccaagattgtaccattgcactccagcctaagcgatagagtgagactcaaaaaaaaaaaaagaaagaaagaaaaagaaagaaaagggtttaaggtaaaacctagcattgagtaataaaaaaggaagacttaagaaaccaaactttcttttcttttaaacattgtttagaatgcaaattccttaaaggcctagctgaattaccaaccccccgcccccaccaagaaccattagctaggattaatctcttcatcctgcattattttaggtttattctatacttcattctaaaacaaagcagactataagatagtttctgtgtctgtcccctaccatattataaagactgctttgtacacggtaggtcaacaactaagctgctgagttaaaggagaaaccaaaacaaaacaaacttcaaatgccttaaatatcaatgacgtacagtaagtaccagggagtagctgatttaaaaaaaaaaaaaatcagcgacataaaccaaatatctaataagctccctttgttgttactttcttttaagaattcctaaatatatcataaaatagtgattatttatacaacttggggctgctcaaggatgatttttttaaaaggacagtattttgtggaatttttcacaaaagcaaatatcattaaactatgtcttagattttattatttacaaaatactaccatttgtaagttaaaacacactcaacttctattaagtagcgactgatcattctctgtaatataagattttaacacaaatctatggacttttcaaaaactttaaatgggtcttcagatcatatttaaattttcaatacaacaccaccctctaggggtgaactttaaattacaaagaccattttgaaaaagcaaactgcagaattcgtgctattcttgcctgatgtgcattatatttcaaatacaaaaataaaccttattttatttaatattaaaattcatagaaaatatcttttaacaaatagtttaattcttactaaactctgcaaaagttaaaacaaaatacaaaatcaattaaattgatgccaagtgattaaataggaaatgtgctttcacataaatttaaccttaataatcctaaaaagtgcagactgggaatggtgttttttgtttttttgtttttttgacatggagtctaactctgttgcccaggctggagtgcagtggcgcgatgtctgctcactggcaacttctgccccccgggttcaagcgattctcctgcctcagcctccaaagtagctgggataacaggcacgtgccaccacgcccgggtaatttttgtatttttattagagatggggtttcaccatgttggacaggttggtctcgaactcctgacctcaagtgatccgcccatctcagcctcccaaagtactgggactacaggctaaggaatggtgttttaaataaatcagaataaatcagtgcgagggaagggaatttaattagattagcatccccaagaaaagagaaatctcttgcaaaacactttaacttgttagttttacaactactgtcttacatgtttgacaatacaaatattttcttgcatgtttacatacatgattattttagtgattttcgctactacaaccaatttaggttcagtaagtcccattcaaagaacattcacaattaaaacgctattctgatattcactttgtaccaagtcataattactcatagatgtattcctgcaagattgactagaactgacttccatggtaaaaatagaagaactggagaaaatgtcccaaatattcaacaactgaagggctaagttcgctgctagccccaatgtgtgacccaacttcatttcacaggtcagtctgcctgcacagtgcttcattcattatgcagcacgctaagcacctccacagtcatccttccaaccagttagggtgccgtccaggaaagagaaatcatggctgttatttatatagggagaattttaatgtatcccacctccacctattccttcttccagtaactacccccatagggtaacttactatcctaacctttaagaacgtagatcagttgtataacactttatagaaagagaatcgtatgatgctagctactcttgtggctggattccttcactccacatattttatgagtggtagcattatttttatgtgcagttgcatagcattcatttgcattgctgtctagtactccattactccaatatatcgcagatccttcattctaccactgatgggcatttaggtagtttctacctgggggttattataaatagtgctgctatgaatattctagtgtgtgtctcttatcagcctcggaatgcatttctgtcgcacatgtactcagaagcagatacgcagaaagtgtatgttcagcttaagtaaatattgccaaatagttttccacagcagttgtacccgtttatactcctaccagcagggtatgagatttcaagttgctccccatccttgccaacagttttccaactctttcattcctgttattctggtaggtctggagcagccacactacgactttacttcgcacttctctgatggacagtaagaactctgtgacacttgtagcaggcagagggatagaattcacccgagacaacacagagggaagggccccggccagaggctctcaaccaaggagattctgccctcctcaggagacatctggcaatgtctggttatttcaaatttgggggtgttgttaacatctagtggttaggagccagggatgctgccaaacatcctacaatgcataggacaccccccaccaccaccaccacaacaaagcattatttggcaaaagtgacaataatgccacaaatcaagaaacccaaatcaagcaaatcattattgggcattttctccttagccaaatcatcattctctgatacagcacaagaggtcaatgtcctattgtcttaaaatgttatttttcctagagttgaggggatagaaagacaacaaaggatactaagtgccacactccatggcacagtgcatatcttctgcatatcctgtttctttctcagttctcgcgacaatgcggagatgaggaaacagataccaagcaggctccttggctcctctaaactcacgcaaagagcagcagagctgggaccagaagctgtgattttccactgcacccagggtcttacttttaactaaaaataaggggagtttttagagtccacaattcctgttaacttgcaaggcatgaattttaccttattagctttgcaaaaggcaggcaaataaaacgaggtatgagaaaaagatcatttgcaatgttaagattattaacctgcacctgtaagtatcttaaaatatttcaacaaatccaccttcctcatcacacggtgatctctttgaaatgaaacccataccatatttttctttgtctatgcccaatacctgtaagagcaggcattcaacagttaacatgtcctggattaattactggcctgaaaccccagtgagagaagacagaatctttataaaacaagcaggtggtttagattttatttcatcaccaacacaactatatttagtaacattaactagaataaacggtttttgttgaaaaatattcaattaagtcaaataatggccaataccacaaaattctttttgaaatgcaaacaattcaatttttccaaggatgagtttgccagcattaccttatcctcctgtggatcttctatttgaggcttctatttgtgaggccattggcattattagggccaacagaaatccacccactattagagcagttttgaaccgtggccatacattacaatcacccaggaggttttgaaagccatgggtgtccaggaggataatttggtaaatctgcagtagatgaattttgaatttacacccaggaaataactacacttagcagtatcgtttgaaaatagctacccacgtaatttttgcaagctcccctccccttaggggtcaggaccactaccctggagattctgaactgaactgaggagggcacctggctgcttttcatacccaccagagttcaacatcccaatgagttagttgctcgtgggcaggactagggggcgacgtgagcccacctaacaaacagcctggcttccttcccacagggatggcaccacctggtcatttgtatttaaacaattcccatctgctttacacagaaggggcaaaccaaacccaccacccccattctcagcctatcttcttaaattatcaacacccagtagctggaataggacttgaaatggataaacctaccaacacttgactgcagtgagcccagaaatggacaaggcaggatttcctgtttaccccacatagggtggggagtgcggggactaaggggtcctaagaagagacagcatttgccggaggaaacagtggggtttccagtttgtgtctggttccggctggtggcggggggtttctagtgactcgtctcactgcataggagcctgccctcagaggacgcaggcaggtgtcatttcaggcctgtgtactcctctgatgaacggccatctccctcccattcacatccgtgctgttttgccttatcattgtttccccagcacctaacacaaagcctgacactggtgggtgaccactaaacatttcttgaaagaacaaatgggaagggagagctccagaatctaagctgggaacagaggaaagcgagaagcctaaaagaaggagcgaactgaagaatgaaggaagtcaggagggagcgcaggtgcacagctttgtgatgctctgcgtggttacaataaagagatgatcaaagtatgatttcctgaagcacatggtctattgccatacaaaggctcatgatccctaaggaggggagaataatgagaacaggcctaccagggagcacacacgacagacgaggtccattcaccacacagggagtgcttcccaaatattaaagtccagttgctcacttaggatggaagcaggcctctgtggaaagtgacatctgattaagtttgaggtgtgccttttatatgagtggttctctccagagatggtgtccaacacagggagggatccacggtgacatataaggcccccggaggctagaggagttcccaggggtgctggtgttggcagggcctttaggctggaaggctaacaggctaggagcacctgagctggggatctttgcagaaggggctggcagagctcagcctgctgtggctaagccctcaacgtatctgtcaaactctagagctgagatgtccactggggtgcagtagctgaggtcagtaactcctatagggtctgacagtgtgtggtgtcgcattctcgaggggagggagagcacaccccaagttctcaccacagcaaagcaggccactcgcatagcaagccaggtaagcactgggagtcacttcaaagctccataccatgtgagaaccagggatggctttgagaaagaactaggtttctagccaggctctgaggactagccacaatccaggctctcagagaagcaagatgactgtgaccccagcaacaacgaagcacggccctggtcaggcattcagatgccaggaaagagaagagggggtctggaaaggaaggactgacccgaggaggagaggactgtcctaagagcgtctgcagggaggctgggagtaggcagcaaggaggtaaggaaggccagcctggagctgagagcagtgacgggcctcccaagctgagccctctgtactcttcacactgctttctagcaaaaagagcactggatacagagtcagaaaaatccagttcccaggccataacctttgctagccatgcaatcttcatcaagtgattccacctctctaagcttggatgtccatctcggcagcctctgtgttgtctgcccgagccctaaaatccaaggactccgatcattcctcttttccctctccactcttccccacccaaccacaggccgccattcactgcaatctcaagacagaatgtcatgttttatagaatacacgacggtaactggtatttctaggagggttggctcctgggtttatgctgtttttcttacaaatgtggcaagcaaatgagagcttcacctcccaagacaaaaaaataaaaaagagacattttaatcttaacaatgggcatgaagaatactgtttggctcattttcctgctggtatgaattaacaataacaattacagggaacaatggtgagaggatcttaactaacccaaagttctctgtgtctctggagagaacactgaggcaaaacagctgctaactaggaggaatctggctttctcttccgtaaaatgaagagatctaaaactcctggctgtcactagttctaggtgagtctggctactagagggttaaggagactaaccctttcacccataaaagtttcaggtgtaatcctattactttggaatggctagcagtgttctacgaaactattcaaggattaaggttagagaatgcctgtgccctatggtacaggctgccataaagaaaattatgatcctagatgcagtgatgccaatttacatggtatctacataaatgattcttccagctccctcttctccattttctcagtaaaacaagttttttgttagtttttcttcttgagacagggtcttgctctgttgcccaggctgtagtgcagtggtatgaacccagctcactgcagcctcaacctccgggactttaaaaaaggcgatcctccaacctctcagtctccggagcagctgatactacaaatgtgcaccaccacacctggctaatttttgtatttttttgtagagattgtgtctggccacgttgcccaggctggactggaactcctgggctcaagcgacccacctgccttggcctcccaaagtgctgggattacagacgtgagccaccatgcccggctaaaacaagtttttaagagggagagaaatgagcaaatacagcattgcacctgcacgttcaggactgtctactccccaaagcaataatcaaactaccatattttatttatagctgctctcaaggcacaactgcttccaaagtacaagctagaacatttctagtttggtctggaaccacaaaggaaaggtacaccaacatgctgtaccttggaaagctgacctgtaaaacggaagccttcttcgtaatatttaaccaaacacagggcctgacaccttccagtcctcttctgacagatcactgcaatatgtttgctgttttaatatcatgattaattaaagagccagctgacaattttacaaactaggaaggacacagaggaaacagaatacgcgaactattcctggatctttccttttatccagccggcatgtggcacgctattcttcatgagtgagaaaatccatgccctaaattctcactcataaatgcatatttagttaatattgaacaaaaagaaaatagtccaaataatttgtcagatatgcacttataaaacgcactgagtcaatgaatgcaaaaatattttgaagagccaaaaagtgctatcagctgctaatagaagacactagacaaagtacagcatctagaattgtttttattgagagaagaattttgctgagcccagaagcagaaacatccaacataggtacctaacaccacacacatacagcacctccaggcgtcaggcacaactatcctgcccagagtcatgatacaggtgaacacctagaagttaaacccaatatatatacaatttccatgcctctaagaattatttacttgtgtctgggaccctagacatacagcaagcaaggcattcaaacaacatgaatagagtgccacgttaacgaagatctcactccactggcccagaagggattgggatccaaagatgagtaagacacagtccctgtccttgaagagtatatcacagagggcagaacataagacctacaaacaaacaatagaaggcagagggaggacaaatcctattttctttttttttttctgttttcttttctttttctttttcttttttttttttttttttttttgagacagagttttgctcttattgcccaggctggagtgcaatggtgtgatctcggctcaccgcaacctccacctcccgggttcaagcaattctcctgcctcagcctcccgagtagctgggattagaggcatgcaccaccacgcccagctaattttgtatttttcagtagagacggggtttctccatgttggtcaggctggttcttgaactcctgaccttgggtgatcccccccggctcggcctcccaaagtgctggaactacaggcgtgagccaccacgcccagcttcaaatcctattttgaagggacttggggatttcataaaaaaagtggcattggcatgggcccttaaaagaacaagatctcaaagcaggtttgaggaatgcggcattctaaacacagtacttcagtagacacaaacaaagtatttgctataacccattgattattgcatgagcagattaagtgaattttaactgattactaagaacaagagttccgtaaactgtaaaactatttaaaatttcccatcttggccgggcgcggtggctcacgcctataatcccagcactttgggaggccgagactagtggatcatgaggtcaggagattgagacatcctggctaacacggtgaaaccctgtctctactaaaaaatataaagaattagccgggcgtggtggtgggcacctgtagtcccagctactcaggaggctgaggcaggagaatggtgtgaacccgggaggcggagcttgcagtgagtggagatcgcgccactgcactccagcctgggcgacagagcgagactccatctcaaaaaaaaaaaaaaaatttcccatcctgccagccagcagttagctagaagcaggttctgatcttggttcggccacagactggctgcgtgagtttaggcgtgttacagaatctctctgatctacttctgcatctttgaaaaatttggataatgatacagcctgaccattctcctttgatcataccacttttctcatggcatttaatatggcctactataattacacatggctttatctcccctgtagaccaaaccaagagctcctgagggcaaaggcctttgcttatttactctgaaacgcagcccagtgctagctgtgctagcagacacattgtcaatgccagcttctaccctttctgttggattcccacttgctatgaaaatcctttcctttgttctacaaagtacactgttcttcaaatcatgaagtaacccagtttcaaaattttagttttactttgtaagtttcagcatatctctatcccagtatggtggggtttcttgttgttgttgtttttgttttgttttgtttttaatattgtaaatgttataggtttcaaagattatctatttgggaacttgggcataaactcaacatatatacttctcatgcttccaagtactggaagcatgtggaatctgagtggaaaaatcatttaaatttagctttaaaaattaaaaaattaaataacgttgggatccaaaggaaagactcttaaactttatgttaactgaactttcatttcggccttgtttccaatagattgagaaaaagattgaataccaaacagcaacaaaagcagcccatgatgcatttcagtgtcatcagggtggctgtggggctgaattgtaggattatgatagccaaaattctttacaaaactgaacactaccctgctagttgatcgattcaaacacaaagtgtgagcagcagtcaaaattccttctgtcctagagagaagaaatgccctcaggatggagggctggaaagaaagctctctgaggcggctgactgcaatgaaggttgccagtgccccccgactccaccccagctcctcccagtcacaaccactcagcaggctggtaacgcagaaagaacgatccacattgaaaactgagtcatcatgagaaaggctccatcacagacaatgcaaataaggtacaggacaaaggaaggaaaggaatattgccaagaaaaggtcaatgaagacacaccagacagccagagagattatgctggaaagaattggaaagttatgaaccaacatttttccttttatttatttatttatttatttatttatctatttatttatttatttatttttgagaggaagtcttattctattgcccaggctggagtgcagtggcatgatcctggctcactgcaacctttgcctcctgggttcaagcgattctcctgcctcagcctcctggagtagctgggactacaggtgtccaccaccacgcccagctaatttttgtgtttttagtagagatggggttttgccgtgttggccatgctggtctccaatccctgacctcaggtgatctgcccgcctcggcttcccaaagtgctgagattacaggtgtgagccactgcgcccagcctgaaccaatatttctctatgagactttaaaaaataggcatagcctccctgaaacaggaactcaaataagaaacaggacaacaaggggagattaaaagatagcaaagttcagggaagaaatgaagttcaagaagagtgaggcaatcccggaaacggatgccgcactaaacagcaataaaggaagtggagacactgatggaaacacaaccaaatatatggaggacacattccagaaaatcccagtgattggctcaagaaggagcacatgactcacagacattagctgcagactttctggaacaaagcccaagaaagctatcagaagaaacattctccctggctaacattatgtcgccagctgctaccacggtggaagtcagcccaaagacagggccacataacaagaaaaccccaagagaaatgaaggcagaacctgagaacaccatgatcctctgagtcaaactgcacccgaagcccaccagaccttcagacttttcagctatgtgaatcactaaattccttttattttaaaaaattcattagaataagttttccattactggcaattgaaagcttcttgatacacttaagaacagctgaaatgaaaaaagcaaaatgttcgtaattctaaaacaatacattgggaaggcaaacaactgaaaaattattcaaaacaggagaatgtagtaaggtggcttattataaaatggatttatcaaaatccaatatgaaaacaacattttatgtgcagtaggcacaatccaatggccaactcaaaatatactcccaattcccttctcccactgcctccactagagggactgagaaagctgaatgctctctattccacaatttctcctaactaggagtgccatgtaatacggatctggccaatgagacaggaacagaagtctgctttgagcttctgggaaagtttttgcttttcttaattaaaaaaggccagatatggctcatgatatctcattttctctctccttgtcttactgcctggaatgcaaatgtgatgcctggagataaggcagccattttgtgactgtgacatgaaaagcaggagaaggctacaaaataaacaacagtgattacctcagaaaaactaggaacttgagatgggagggactttcttcacaaaccgagttttctttttttaaaaaacacattttataacataaactaggaaataaaattattttggaaatataaaggaaagattattagggtttgcttgcagtagttaggaggtttctgagaggggaagagtaaaagttgggaaagcgaggcagcagagtaaaaggtgatcaagctatgaaaacaacatgagccaggagtttactgaagcagagtttttcaaagtagaaagcagtagaatatacgagtgaaaagataaagggggctggaggatgaggataagccagacagaaatcagacctgactctacagtgatggacactcctgaatagtccctagaggttcctttttagcagggccggggaagtggtacaataaaaacaaagtttgaagtccaggatacagaataagttggcgtttaaagctaaagaaaacagaagtgaaaatcagaacaaattcatccaattcagttctcaagatttcaagattaaaactgcaacatttaactgtaagaatcctaggcaaggcgcggtggctcacgcctgcgataccagcacttagggaggccgaggcaggcaaatcacctgaggtcaggagtttgaaccagcctggccaacatggcaaaaccttgtctctactaaaaatacaaaaattagccaggcgtggtggtgggcacctgtaatcccagctacttgggaggctgaggcgggagaatagcttgaacctggaacacagtggttgcagtaagccgagatcatgccactgcactccagcctgggtgacagagcaaggctccacctcaaaataaaaaagtaaaataaaataaagaaagaattttattgctgtacacactgaagggtttggacggttctgttattacatactttctttacatatccttgtttctgaagtaagcaaaacaatggaatttaatttctctatgctgtaagaaaacacatttgtcatttctttttacatttcattaaaagtaatggcaaaaaacacaattactgttgcaccaacctaatacaatgtaatgtaaaaagaaatgtaggctgggcgcagtggctcacagctgtaaccccagcattttgggagtccaaggcgggaggatcacctgaggtaaggagttccagaccagcctggccaaatctctactaaaaacacaaaaattagccgggcatgctggtgcacacctataattccagctacttgggaggctgaggcaggagaatagcttgaacccgggaggcggaggttgcagtgagcccagatcgcaccactgcactccagcctgggcgacagatcaagagtccgtctcaaaaagagaaaaataaaaaagaaatgcagctgcaaatagaacagaagctggacacagactggtccctggaaggaaggcaaccagagtccagtgcactacttttggatagggaggtaatcaagagagcactctatggggagtccaaagacctggactctggtttcaagtctacctctagctcccatgtggccctgggcaatcacctctgctttctgaagctcagcatgctcgtctgtaaaataagggaattggaccaaaaattcgctacagtccttttcaattctaaattctgtgaatagtttacttcagccttggagctggcagggacggtggctgagagaagaatctggggaccagggctggagaatcagggctgaataacgtgggactgtgcagtaaggggtcacccatgaaacctggagtgtgtatccatctaataacaccatttacattcttgaatattccggaagtcctacacttaggaagaggtactaccaaattccctatttgccctgaatatggggacacataagagctatagtaactataaaacatgttttatagatcttttttaaaattgtgtaattagtgccttaatatgtatgacaaagagtaaaaattcatccagcacgccatgatcttcagccaattcataccagtaactagtgatcaggcatcccaattttcttttctctatttttttttttgagataaggtctggctctatcacccaggctggagtgcagcagcaactactagagattgtcttaaatgtctctagttaatttctaaatcattttgattaattccaaaataaagttccaaatgctgttcaccaaaatgaaagcaatttgaatatttttcttttttttttttttttttttttttttttttgagacggagtctcgctctgtcacccaggctgcagtgcagtggcgccatctcggctcactgcaagctccgcctcctgggttcacgccattctcctgcctcagcctcccgagtagctgggactacaggcgcctgccaccacgcctggctaattttttgtatttttagtagagacggggtttcaccgtgttagccaggatggtctcgatctcctgacctcgtgatccgccagcctcggcctcccaaagtgctgggattacaggcctgagccaccgcgcccggccaaacatcttaatccactctaaaaagtcccccatattgaaatcccaacatgccttcatacacctgcagcttcaccaaagcaacttcacactgtgctgccagccacagcctgaggctgagtgactccggagtggcagaaagagcctgctgagcagctgtgggggaagagggcatccagcattgctccctgcaaaggaagccaagtcctgaccatgcctgaaggcgcctgacaaagtctccacagaacaccacggccaggagaggctgtgacagcactcattcattcagcatatatttactgatcacctcccaggtgccaggcactgtgctaggcactggagattccacagtcaacaaaatgagacaaaactccctcttttcgtgagctgcacattctagtgtatgtgaaagacaaatgagagaaatcaaaataaagcaggaaagtgcaagcaaggcacaggtaggggcaagagacaaggaaggctgctctgagaaggtgcctctgagtgacgacaggaagggaggacacaatccccgaggattagaaagttcattctgggccgggcgcggtggctcacgcctgtaatcccaacactttgggaggccgaggcgggcggatcacgaggtcaggagatcgagaccatcctggctaacacagtgaaaccccgtctctactaaaaatacaaaaaaaattagccaggcatggtagtgggcgcctgtagtcccagctacttgggaggctgaggcaggagagtggcgtgaacccgggaggcggagcttgcagtgagccgagatgtgccgctgcactccagcctgggtgagagcgagactgcgcctcaaaaaaaaaaaaaaaaagaaagttcattctgtgctgcgggaaagcacatgcaaaggccccgaggcaggaggaggccagcgtgacttacaggtcatggaagagccacagttcttatctctgcatgagatgggaagctcctggagggcttccgaacagagcatggccagaatctgagttcccattttaaaggcccactccagcaccagcgtggagaacagagagaaaggagatggagttagaaacgggaaagcagctatctgtggactagggtgctagtcacagtgatggcaaaaagtgatcagatgtgagatatatctgaaggcagaacaaacagaatttgctagcagacagtttgagatgtgagagaaacagaatcgaggatgactgtaaactttctgggctccataaaagacaaatgcatatctggacataattactactcacactggacacaggcttggaaatccagagccaaagacattctgtaaacaccaaaagggcatctctaaggacctgaaaacctacaggcttctaaggctccttaaaactccaaccttacaaagaaattcactgtaataagtagttacttacaaaacatgaatgctacaaccctcctctgtgctcccctccactccggtgtgcatgcgctctcctatctgcggcgcctgctctcaggttccccctctccagcctccttcctgactccgcttcctcattccacacaccttgatgcagatcttctccaaagatctagcctcatttgccctttcttctatctctacagtctttcactcagcaatctcaatcacttccagcaaccatctcttcaaagaaaaagaccccataaatttctatctctggcctctttgcaccacaggttgagaattcaaattacatccttgatgctagtagtgcagatgcctgccgcatctcaaactcacaaagccctacactgagactccaatcttcccatctctttggctaaagccaggggcttatgactgagtgacaggttacagagcttgggcttcattccataggttaacatggtgcaaaatacgattgctgagctttgcaatgatctgtccttatctttccttctgaacgttcatacatgttatctgtttaacctctttagcatgtcaccttctacctttatattacgtacctttatattaggtaaattgtgacatatactatttacatattgacatatagtatatgctatgatcatttatcatataccatttatctgcatgttttatcttacctattaggctatatcaccatttaggacctattggatttacctttacataacttctgtgtactaccagtgtacaggtgctgcccatagaaaggcctcaataaacatttgtttgatacaaaacacatgtgtagaagaccatggaaagcgaccaaacatcaaagccatctcattacaaatttcttcaaaaggtgcttcctttaaaactcccccagtatcattatcccttgggttacattttctttgttctacaattaacaaacgttccttacaaatagagaacctttctgactcatttcatgagggtctcaaatttctatcttcttctttttttttttttttttttttttttttttgagatggtgtctcactctgctgcccaggctagagtgaagtggcgtgatctcagctcactgtaacctccgcctcccgggttcaagcatttctcctgcctcagcctcccaagtaggtgggattacaggcacacaccaccacgcctggctaatttttgtatttttttgtagagaccgggtttcaccatgttgcccaggctggtcttgaactcctagcctcaagtgatctgcctgccttggcctcccaaagtgctgggattacagatgtgagccacaaatccagcctcaaattcctatcttcaagccacaggaaacaactcatttcttcaagatataaataaataaataaataaagagcaaacaaaccccaagactagtattttggagggagacagaatttcaaatgtcaaaacaactttgctctcatcttctgagatgccctttagggtaaccattttttctaaatgcatcatgcttactattgcttgtggaaatttgcttattcaaatgatccaatcccttctccttgctactaaaagtgcagccacctaccagcagcatcagtggcagctgggagcttgtcacaaatgcaaactaacgagccctatcccagacatactgagtcagactctttggggcccaggaatcttaatttaacaagatctctgggtaaacgtttgagaaggacaggcctatcccatggccagagttacctttcgaaaacccatctcaacgtgtcatcagaaaccttcaatggccacagtataaagtccaagcctctgcagaaagtgaaggatcttatcatttaattgccacaatcttcccattaagtcaatcagcatgtgttgaccacctgctcacacgccaggctctcttgcacgtttggagaagatagcagtgaacttggctgacagccctgctctcatggaacttaccttctcagagggaaactgacctcagaactcatctcccaactaaccatcccattacctgtgttctactcacactgctgtcttcacccttctccaagtacatccacacattttacatttcatgccagggttcgtgctgtttcaaactcaataccaaccaggctgaaatcatcctccttactctgggcttctgctcgtcctctaacacagcaaaggctgcatccctagactgtgattcatatttaaatgtctttttctcctctgctgggcagtgtgagcctcaggggcagaaccatagatccttcatccttgtatacgtggcacctagccacatggcttagaataaatagcatttaattaaatattcttaaaaatacaactcagggatagaattttggcagtgttcaaaatgcttcctttggaaatctttaaattttcctctaaagccggtgtggtggtgagagcctgtactcccagctcaggagaaagccaggaggatccttgagcccaggagttcaaggttgtgatgagctgtgacgccactgcactccagcctgtgcgacagagtaagaccccgcctctaaaaaaagaagaaagttttcctctaaagtctaagaccttcttttttaatgatattcatttaaatagtggaaaatatcctttgacagtataattacaattttggcaatggtctaataaatggtgtaagagggtgatgaagatgggcaatgcaactgctattctaaaacgaactttaaatattaatagaactcattattttggtacattttatgactgaaggcaactccaaaaatgtcttgcacagtgacagcctcactgtaatatttttattctagagtaaggaattagaataacttttttttttttcattttatagacacagggtatcgctctatagcccaggctggagaacaatggtgtgatcacagctcattatagcctcgacctcctggtcccaagaaatcctcccatctcagcctcctgaatagctgggactacagggcacacaccaccatgtactgctaattttttaattttttgtagagatagggcaagattcctggcctcgagtgatcttcttgccttggcctcccaaagtgctaagattacaggcttgagccaccacacccagctagaatatcactcttttcaatgtttcaattctgccatgctttggtaaaactaaacagaatccctcttccagcaggtaaatcttctgttaagacaatcattcatgttttcaagaatgcattatgtatgggaggagggtgcggggaacatgtctgtttctaaaacaaaaaaaaaaaaagcaagaatattcagatgcggatgggctaccgtaagtcttccctatcatcctccctttttctacgcccctcccacaacttggcacttgaggcacctccagtgttccctggaagacattcaaaagcaaaataaataatggaaagaaaactgaagtctacgttggaaaacctttgtcctaatcccaaacgttatgacctcaggaaagtacttctactgtctgcacctcagtttcttaaaaggaaagctgaggttccttccagtttaaaatgctagcactttcgaatgttttcgtctctagagatgagagaacatgccaattcacctgcgtcccaacagcccttttgggaggtatgcacgcagctctacttaagatttgattgaatgaagtcacacaccattaaacattttcaacattcctatcctaaatatgccttcatttttgcattacatataagtaatataaccaatagctatagtaaacattactgaggctttcttttttttaagacaaaaataagtaaatgtctatactgacttcccatactgtctttggaacccactgattgagagaccagtatcctgcctggatattaatgggcacctgccacataaaagagagagtggtgggccaggcacagtgactcacgcctgcaatcccagcactttgggaggctgaggctggcggatcacctgaggtcaggagtttgagaccagcctggccaacatgatgaaaccccacctctactaaaaatacaaaattagcaaggtgtggtggcgcatgcctgtaattgcagctactcgggaggctgaggcagaagaattgcttgaacccaggaggcagaggttgcagtgagctgagatcgtgccattgcactccagcctggacgacagagattccgtctcaaaaataaattttaaaaaggagagggtggtgcattaaggagagtcgacagcagctgcccccgtccttaagaccacagtcaggactcaagcacaaaaagtgttttcatgaagtaatgaggctttagataaacataccacacttttctttgcaatactattttgcaaattaattaatttcaattaagaaatgtcaattaagaaaatgtgaaaatcaaaagaacatttttaccatggtgcagacctggatgtctccaacttttgagtgcacaggactcagggattttgtcaaaatgcgtattctcagtcatcagttccgcagcgaggactacgattctgcatttctaacaagttcccaggtgacgctgtgggccacatgtaagtaacaaagaggtagaaaacacagttgtccctcagtattcgccggggattggtcccaggacccccaggtgtacaaaaatccatgcatactcaagtttcgcagtctgccctgcagagcccacctgtatgaaaagtcaagggttccacatcccacaaatactctattcttgatctgctttgaaaaacattcccatatggggtggtggaccctcacagatcaaacatgttgctcaagggtcaactgtatatgccaggcagcaatatgcttcctaaagggactcattctgaagatatgtgatctaaaaattcactttttttttttaaataacttcaactgggaaaattccacgaagccagaccctgggctcaaagcccaggatcccagccacacatctcttaaaaataggttttcaaaatgccttgcattttttaaaaaagaatagcatatttgcctaaaattctagccaaaatgcttgatattcaccactctattattattttttgactaacttcttccttgttcagttctcacttcctcctcgcctgtcactaagctgagtcacaaagctgtcaacgctctgctgcttgccaggtagatgcaactcctttctccatttgtttatctcctgcaaagcggaataatttttctaaattcactcagattcccagtggcacacagtatcatgcagaacagttgtggaattaggaaaccaacaagaaattttgtacttcctgaaattttgtggttacttcaaatcatcatcctgtaaagataacaaggatgagtccctttgcaaagcaaaaatgctagttaactacaaaactggaatttaagtacggaaggtcaatttcaaatgaattcacaatgcaaaaatctttcagacacctgagaagtaacttgactattgaacactgtactcgtagagttaaaatagctcaagaagaacgcatatgcttctatttagtgtttttttttaatcctgttgcaaattctactattctagtattttcttatgtttaaaaatatcttaattctcatttactatccctggagcaatatccctggcaaattcttcataattccccatgagtcttccagcacagatgcagctttccaagtcaaaatttgtacaaacatcatctgtcaaacttctgcaaggtaatgacatactcatcctgagctgtcacctccccttgcagagactttgctaaaattcttagcatagcaaggactttcaaacagctttctccagcccattcactgtacaggtgaggacacggagaaccggtaacttgctttacttctacaaaaatgctacaatgcaaatttataatgctacggaaaagattatcctggcttcttcacttatgcattttctaataatctacagaaggcagagacagccaatgatgagaaataaaagctctctatttataaacacgtacctaagaagctactaataaaaaattctataaaaggaaaacgagaacactgaactctctatcatatttgaaaaagaaagggcagacatcgcacaattcaaacccagcttccagacttcagggagctctagaaacctgaccagcccacaacaaaagacccagccaccggactgggggttccacaaacagtcagccctcagagatcacccaacattggggctcagaatataagttttgcacatccccttttttgaattcaggaatgtcttccctgcccttaatcacaagcagacaaccagatatctgaggaaagctactaacgtggaagatagagaccaagttaaaccagaaaagcaaatcagaggacacagagactatacaagaagaaaattaaaatatatatatataccaagtacctcagaattacagtatccataaaacagggtgtgattttttaaatagttctagaaaacaaaaaacacaatagcagaagttttgaaaatactgacagaaggattagaaaataaagttgagaaaaatcttccaaaaagcagaacgagtccggaagggagaaagggggaaagggggggaagtagactagtccgggaggtccaaaaactgaaaagtacaattgccagaagaagaaaagaaaggaagctgagatatgaaaatatatcagtggaatctaagaaatatcccccaggaatgagtttctagattgaaggggtttactgagtgcccaatataatagttgctttttcttctaaacccccaagtcatggcatttgaaatttcagaacactagggacaaacagaagatcccaacagtttccagagagaaaaaactggtcacacaccagcagatacaaaatcagaatggccagatgtggtggctcacgcatgtaatcctagcactttgggaggccaaggtgggtggatcacttgaggtcaggggttcgaaaccagcctgggcaacatggtgaaatcctgtctctactaaaaatacaaaattagctgggcgtggtagcggcgcctataatcccagcaactcaggaggctgaggcaggagaatcacttgaacccaggaggtggaggttgcagtgagctgagatcgcgccactgcactccagcctgggtgacagagcgagactttgtctcaaaaaaaaaaaaaaaaaaaaaaaaaagaaatcagaatggtttcacatttcccattggtaacacaaagccagaaggcaatggagctcgcctccaaaaccctgaagaaaaatctacaactgggaatgctacactcaatctatcaatccaatgagaatggagaataaagatgttttctgcaatatctcaaaatttatctcccacacactctttgtcaggataagctcttccagcatggaagagtgaccccggaaagaggaccacatgagacacagcacatgggagaaaagtgaaggattccccagaacgaacgcgaagagggatcccagcatggcacttgtgtgtcccagacacggaactgcggctagagagccaagacacaatccccgagagttactctgtgcagtcactgtgctaagcagtgcacagacagcatctcatttaaattctacaataagcctggagatcagcaattattagctgctattatgggaattttaaagatggggaaagagtcagctaggttaatctccccactgtcacacagctttacatggcagagatgaaaattcaaacccaggcctgccacccttttacacctacacacgtgtccactgcaggattctgtgagataaaacagaaacctggaaatgtgaaggaaagaaaggaaacacggattaaaaaggcaaagaggacagacacaagaaacgggacacccaggaagagatgagcgatgggtgttatgctgttctgtatttatttcctattttaatgatttttccaaattgaaaaaggaaggggagaaatataagtgaacaggaggagaagaaagtaataagggggggaaatggaaagacataggaaaaagacatgagactaaggaatacaactggaatgacactctttggcattcagaaagtgtagtcttaaatagcatattctccctcgatgatgtgaagtgatacatctcattcattactaaatgttcaaatccaagggattcccaaattccttccaaccatcttttcggttttaaccaaaatgcaacataggctgggcgcagtggctcacgcccgtaatcccaacactctgggaggccgaggtgggtggatcacctgaggtcaggagttcgagaccagcctggccaacatggcgaaaacctgtctctactaaaaatacaaaaattagccagtcgtagtggcaggcgcctgtaatcccagctactcaggaggctgaggcatgagaatcacttgaacctggggagcagagggcgcagtgagccgagactatgccactcactgcactccagcctgggggacagagcaaggcactgtctcaaaaaataaaaaataaaaaaataaaaaaatgtaacataggccagaacaggcatgaactatgcgtgatgtgcttactacattcaggggttctagggcagtatggggcttgtctaactccatggactcctccacccataaaccaactcagatgtgtttgttcatatgcttttaaacaaataaaatgttttacacaaatgtaaaaccccacggagaaagaaaaaatataaaagtgtaatatataagttatccattccatagacctttacagaagctcaccttaacaatgctgttacttagatatggaaaactcatttgcctaacatctgcaaaactgctcagagataacaaacttaattctttttagatacctttcttaagagattaggcaataaacatcatttagttaataattttcaactaaagcaaatacattatataagttatacccaatagagttgaaatatccaattcagtaaaacaaactgttcagttaactagattaatggtagcctcattaacagatgttctgacttgatttgcgtgtttttcttacattttactctcatacaaaaatgtctgcttgccttacataaagatatacattgccttcaacagaacctaatttactttatcatgttttattctttactctcactttatcttagttacacaccatatgtgaccttcaaaaaccacagagagccaaggactatgagcagttcagaaatcccacggatttgtataattaaaaataatttttggccgggtgcagtggctcacgcctgtaatcccagcactttgggaggctgaggcgtgtggatcacgaggtcaggatatcgagaccatcctggctaacacggtgaaaccccgtctctactaaaaatacaaaaaattagccgggtgtggtggtgggtgcctgtagtcccagctactcgggaggctgaggcagaagaatggcgtgaacccaggaggcggagcttgcagtgagccgagattgcaccactgcattccagcattccagcctgggtgacagagcgagactctgtctcaaaaaaaaaaaaaaaataaaataataataataataataataataataattttacaacacctataggctattgatctgagttaataattaaagaaatataaaagaacatggtgctgaagtataatatttcatctactgaatcacaaatcttgaaaagaaaggccaatatccaatacaggtgaaattaatacaactgtaactattttgtggcatgataaatttattacaaaccatttagaacagtttgaatatatttggatataaatataaaaggtttgcatataaatataaaaaacatctaagaagtgttgttattttattcagcaatcttcctagaattaggaaaaaactgaaaagaaaaagaatattaaaaaatagtccctacaataattattataagcagcctacttaataaaaagggtaacggattaataagtaaattatattacatcaactccacatattatgctgccacagtagcactgtaaaatggtttaaagcatttgatcactttgtatttaatctattcattaaatttttttgatataaaaaaatttaaaaaataaaagtcatgcgtaattctaccattaagagataactacagctaaaactgttacactttttttactgtgcaacacatgcatttatggcagagttactatcatcctatatatgtagttttattgttaaatattttggttgttttcagtattttacaacactacaataaatatcactgtgcaaatctcagatgattttcttagcatacattcctaaaaggagaactattgagttaatggtatgagtagtgtgccaactggtactcccataagtgagtgagtgtgggtataatttgtaatattttttaaaagaacagactgcaattttttttttttttgacagggtctcacgctgtcgtccaggctggagagcaatggtgtgatcatggttcaccatagcctcaacctcccagacaagtgatcctcccacttcagcctcctgagtagatggaactacaggcaagtgccaccacacccagctaattttttttgtattttttgggaaaacatgaggtctcgctatgttgcccatggtggtctcaaactcctgggcccaagtgatccacccaccttggcctcccgaagtcctgagaccacagacatgagccaccgcacccagcccagattgcaaatttttagaagtgctatagcgcgtatgaacaaaaactagaatatacaagtaaccaagttttaaaatttcagttaggccaggcacagtggctcacacctgtaatcccagcactttgggaagctgaggtgggtggatcatggtaaaacctagtctctactaaaaaacaaaaaattagccaggcgtggtggcatgcacctgtagtcccagctacttgagaggttgaggcaggggaatcgcttgaacccgggaggcggaggttgcagtgagctgagatcgtgccactgtactccatccagcctggcgacagagcaagacttcgtctttcaaaaaaaaaaaaaaaaggaaaagaaaaaacatcagttaatgtgtagccatattgctttacagtctaaatgaataacttctgggctagcttcaacggacgccatcattctcagattttagccctcaagaatagaggctccctagtttgctttttgtttttgaggcaatagagtctcactctgtcgcccaggctagagtgcagtagcgccatctcagctcaatgcaacctcccacctcctgggttcaagtgattctggtgcctcagcctcccaagtagctgggactacaggcgtgcgccaccacatctggctaattttttgtatttttagtagagatgaggtttcactatgttggccaggctggtctcaaactcctgacctaaaatgatgcatccgcctcagcctcccaaagtgctgggattacaggcgtgagcctctgcacccagcccaaggctccctagtttgattcacaccacataaaatgcctctctgacccacagctaaattcttagtgtcatggtattttccctccagaacacagagtagtaattctgacttaatgacctttctgcaggaacgccactcgtggcagcaacattcctttcctttaaagtggcttttgcttagctgtgaccttagcatttcatcctaacccaggtgaggaatataaagtcattcattataatattctccctcaatcacttgagtccaggaggtcgaggctgcagtgagccatgatcgcaccacggcactacagcctgggcaacagagtgagacccttaatatacatacattctccctctttgtttatgttggaaattttttataataaaaaaaatttaagtacattaagttttaaaacaactcatagcaaaggaatgttcctaagaagtgccatctaattttgtaagtacagtcatgccctgcataatgacgtttcagtcaatgacagatggcatatgccacggtggttccataaggctataaagagctaaaaaattcctactgcctactgacatcatagccgtcataatgttgtgcaacgccttacgtgtttgaggtgatgctggtgtaaacacacctgcgctgccagtcatataaaagtttggcagatacaattacgtgcagtatataataataatgagaataaatgaccctgttattggtttatgtatttactgtactttttatcactcctttagggtacactccttctacttacatgtattttttaaagttaactgtaaaacaaccccaggcaggtccctcaggaggtgtccagaagaaggcattgttatcacaggaggtaacagcttcatgcagttactgcccctgaagaccttccagtgggacaaaatgtggaggtgcaagacagtgatattgagaatcctgacccttgtctaggataatgcgtgtgtttgtgcctgagtttttaacaaaaaagttttaaaagtaaaaattgaaaaaaaaaaatttagtagaaaaatgtttacagagctgggcgcggtagctcacgcctgtaattccagcactttgggaggccgaggcgggcggatcatgaggtcaggagatcgagacgagcctggccagcatggtgaaaccccgtctctactaaaaatacaaaacttagccaggcgtggtagcatgtgcctgtaatccctgctactcgggaggctgaggcaggagaactgcttgaacctgggaggcggagcttgcagtgagccgagattgcaccactgtacttcagcctgggcgacagagcaacactctggctcaaaaaaaagaagaaacatgtttatagaatgagaatataaagaaagaaagtatttttgttcagctgtacaatgtgtttggttttaagctaagtattattatgagtcaaaaagtttttttaaaaaaagtttatcaagttaaaggtacagtaacctaaggttagtaatttactgaagagagaaatatattttaaaaataaagttagtgtagccttcatgtacagtgtttgcagagtcgtaggacacacgactgtccttggccctcccattcactcaccactcactactcacccagtgcaacttccagtcatggtaagtgccctatacaggtatttcaatgcttatcttttattctgtatttttactgtaacttttctatgtttagatacacaaatactcatcactgtgttcaaactgcccacagtatcctgtgcagttgcgtgccacaggggtttgtagcccagatgcaacaggtgatcccacacagcctaggtgtgcagtgggctgagtgcagtgggctgtgagcctgggttcatcaagcacgctctgcgatgttcgcagatgacacaattgcctaaggacgcattctcaggagtatccctgctatgcaaagcctgactgtactccctgttataaccatgagctgttttccacagcagcatggtcatcactatccccagacaccaccaaatttacatctactcagagaaataattatattcaatttaaaattttaaataagtactacacaaagatactctggaaggtcaaaagccgcatcatccttggcctgaggaaatcaagatgatcacagggctgtgcgggagaccagtagtgccaaaacacaaggtccagtaacacactaagacgaatcccaggaagacagcgggaggacatcgcacaacgtctcagtgcacaccattcagccactcttttctcacccacacactgatgccaacttcctgagtaacattccgagtaaaacgtgcacgactcactccagacagtccacttagtgtccacccacactcacgtggcataatggaaaggacgcctgctaggaagtcagccaggcctggtttcccatcccatctctgccaccgacttgctgtgagaccacaggcaagctgcgagccctgcaaagcagagatgacgcttctcacctcagcacttagtatggcacctggtgtggcacaggcacgcgatgagtatctgttgagtgaatgggagggtggcggaatccccgccgtgaagctgcctacacgatttcaatgggagcctcccactcccccgcccccacgcctcccttcccttctctttctatgggtctctgccttccctccctcagaaacgtgctagtcccatggcgttcataattgttctttctaaatacattccaaatcatatttctttttttgtttgttttgttttgttttgagacggagtctcgctctgccgcccaggctggagtgcagtggcgcgatctccgctcactgcaagctccgcctcctgggttcacaccattctcctgcctcagcctcccgagtagctgggactacaggtgcccgccaccacgcccggctaattttttgtatttttagtagagacggggtttcaccatgttcggcaagatggtctcaaactcctgaccttgtgatccacctgccccagcctcccaaagtgctgggattacaatacccagtgtgcctttcttcattcattcattcaggagcctggctgtgctctagacactgcgaacacagcattaagtaggctcggcgttgggagcccgctgtgatacagcccgtcggctcatggaggagctgaccttccaccgggcaccatgggcacagggccttgggcccacagcacttttggggcccatgaaaattgtttgtttccacaatctcagaagaaaaaacatgaactattaggatgaaaaaaatgttttactatatagtattaatatttcatttgcataccaatgcagttgtaaaatataatttgtaatatctttttaatgaaggaaggggcctacagaggcacagatgcctcaggctcatgagtgtcagatgcagcccaaggaaacacatgctaaggatggaatgcaaaggagccagcgagtaagattcgagaagggcgtttcaggcagggagcatagctgctgcacaggtcctgaaacagggcgacggccataacagtgcgagggaaacaggtgacatgacaaaggccgggtgtggccacatctccaaggcataaagacaaagtgggacacagttaaaaatgatacgggatttaggccgggcacagtggctcacacctgtaatcccagcactttgggaggccaagtgggtggatcacttgaggtcaggagttcgagaccagtctggccaacaaggcgaaatgctgtctctaataaaattacaaaaattagccaggtgtggccgggtgcagtggctcacgcctgtaatcctagcactttgggaggctgaggcaggtggatcacttgaggtcaggagtttgagatcagcctggccaacatggtgaaaccccatctctactacaaatacaaaaaattatctgggcgtggtggtgggcacctgtaatcccagctacttgggaggctgaggcaggagaatagcttgaacccgggaggtggaggttgcagtgagctgagatcgcaccactgcactccagcccgggtgacagtacaagaccctgtctcaaaaaaaaaaaaaaaaaaaaaaaaataggcaggtgtggtggtgggcacctgtaatcccagctactcaggaggctgtgacacaagaatcactcgagcccaggaggtggaagctgcaatgagccaagatctcacaattgcactccagcttgtgtgacagagtgagactttctccgatgaagaatataactttctctgatgctattgaaatgcctcctttcaatagcgatggaaagtggaagagtaccaggagtagttacaaggtgtagatttccacataattgaacttgtccaactcctaaaactgtttaataacggacagtttagtgaagtaacaaactttccatctcttacatccaagcagaggatagaagccaaatgtcaggaatcttgcaaagggaaccctgcataaaaaggaagattgaacaagaggacaatcaaggtcctatccattcctacaggcctaaattagcatcttctgcatggaagtcttcaaagggaagcagaggtttcctgcaagtggggcaaattaaactacacgagaggccaggcgcggtggttcacacctgtaatcccagaactttgggaggccgaggtgggcagatcacctgaggtcaggagttcaagaccaaatggccaacatggtgaaatgctgtctctactaaaaatacaaaaaccagccgagcgtggtggtgggcacctgtaatcccagctactcgggaggctgaggcaggagaattgcttgaacctgggaagcggaggttgcagtgagccgagatcacaacagagcgagactctgtctcaaaaaaataaaaacaaaccacatgagatatgaccttaccccaatcagaatggccatttattaaaaagtcaggaaacaatagatgttggcatagacatggtgaaaagggaacacttaaatactactggtgggataataaattagtacaacctctatggaaagcagtatagagatttctcaaagaactaaaagtagatctgccattcaatccagcaatcccactactgggtatctaccaaaaggaaaagaagtccttatattaaaaagacacctgcatgtgtacatttgttgcaacacaattcacaattgcaaagatactgaatcaacttcagtgctcatcaatcgatgagtggataaagaaaatgcgatgtgataacctgaggtcaaaagttcgagaccagcctagccaacgaaaccctgtgtcaaccaaaaatacaaaaattagccaggcatggtagtgcatgcctgtaatcccagctactccggaggctgagacaggagaattgcttcaacccaggaggcagagtttgcagtgagccaagattagacgactgcactccagcctgggtgacagaggaaaaaaaaaaccaaaaaactcaaccttgtaaaaataactcaactcttacctttgattatggcatcctgtaatgaaaattttaaatcctatatattctaaaggttttactttttaacttctggatattagtcttacttaaggacttcccagacaggtgtgatggatcacacctgtaatcccagaactttaggaggccaaggcgggtggatcacttgaggttaggagttcgaggccagcctggccaacatggtaaaaccccgtctctactaaaaatgcaaaaattagctgggcctgatggcacttacctgtagtcccagctacttgggaggctgagacaggacaattgcttaaacctaggaggtggaggttgcagtgagctgaaatcacaccactgcactccagtcagggtgagagtgagaccctgtcacaaagaaaaaggaaggacttccctaccacaagtttgttattataatatatatgaagaatataaacttttaaatatatggttaagttctttaatccatatgaaatttattttggatagattttgggatggaaatttatgctaacaaatttagcatgaggtaaaaaactttccctttttttttctttaaaaaaaagacagggtcttactttgtcacccaggctggaatgcaatggcatgatcatggctcactgcagccttgaactcccaggctcaagtgatcctcccacctcagcctcacaagtagctaggaccacaggcatgcaccaccatgcccagctaatttttttattttttgcagagacagggttttgctattttgcccagactaggctcgaactcctgagctcaagctattggaccacctcagcctctcaaagtgctgggattacagatgtgagccaccacgcctggtccctaacataactttcttccaaataactggccaactgtttcaacctttttctgtgtgtgtgtgtgtgtgtgtgtgtgtaaacagaaaagtaaaatttctattttcatttgcaattccttttggttttcttttccgtttgtttgctttttgagttttttgtgatttttttaagttcagaaataaatgtgcagttttgttttataggtaaacttgtgtcacagggtttgtagtacagattattttgtcactcaggtactaagccaagtactcaatggttattttttctgatcctctccctccacctgccttccatcctcaagtaggccccagtatctgttattcccctctttgtgtcatgagttctcatcatttagctcccacttataagtgagaatgtgaggtatttggttttttgttcctgcgttagtttactaaggatgataacctccagctccatctatgttcctgcaaaagacatgatctcgtgcttttttgtagctgcatagtattccatggtgttgttttttttttttttttgagatggagtctcgctctattgcccaggctggagtgcagtggtgcgatctcagcttactgcaacctctgcctcccaggttcaggcaattctcatgcctcagcctcctgagtagctgggaatacaggcgcgtgcccccacagctggctaatttttgtatttttagtggagacggggtttcatcatgttggtcaggctggtcttgaactcctgaccttgtgatctgcctgccttggcctcccaaagtgctgggattacaggtgtgagccaccaggcctggccacattttctttatgtaatctgtcactgatgcacagttaggctgattccaagtctttgttattgtgaacagagctgtaatcaacattcacatgtgtctttatggtaaaatgatttatattcctttgggtatatacccagaaatgtgaaaagataatctacaaaatgggagaaaatatttgcaaatcattcatctgatgagagtctagtagccagaatagataaagaattgttacaactcaacaacagaaagacaacaactcaactcaaaaatgggcaaagcaagaggtcaaggcggtggtgagctatgatcacactgctgcactctagcttgggtgacagagcgagactccatctcaaaaaaaaagcttttttaaatgggcaaagcacttaaacagtcatttttccaaatcagctatacaaatagccaaccggcacatgcaaacatgctcaacatcactaatcattaggcaaatacaaatcaaaacaacgagataccacctcacgcttactaggatagctactatttaaaaaacaaaataacaaatgttggtgaggatgtggagaaattggaacccttgtgtatgggaatgtaaaatggtccagtctctatggaaaacagtagggcagttcctcaaaaaatttttaaaaaatttccatatgatccagcagctctgcttctgggtatataccgaaaagaactgaaagcaggctctcagaaaaaatatttgcacactcatgttcatagcagcattattcacttgggtctgttgatctgtccatccacagataaatgaacagtggcctatacatacaatggaatattatttcgtcctaaaaatgaaggaaatcctgatacatgctacaatatggatgaaccttgaggatattatggtaaatgaagtcagtcagtcacaaaaagtcaaatatcgtatgattccacatatatgaagtacccagaatagtcaaattcctagagacagtggagcggtggttgccaggggctggtaaatggggaaatggggagttacgtgttcaaaggatgtagactttcagttttacacaatgaaaagagttatggatgggtggtggtgatggttgcccatcacatgtatttaataccactgaactgtacacttaaaatggttaagatggtaaatttcatgttatgtgtatttcatcacaataaaaaacaattttttaatcattcttcctccatggattttaaattttgtccctatgacatataaattcctatacctcacgtgtatacatgtttctgagctccattctgtttcgtttattctatctcggcatttttcaaacaataaggcacaatccattggtggttcctaaaataggttgaatagattataaccaccattattgttgttatcttctaatgaagtagaataggatagaaaacagaatacgtctaacatagtaaagtattaacccatgaaatttgtttatatacatacatatgtataggtggtgttggctgaattgtaaaatacatttgttactatggatttgtagctcaaagtttaagaaacactgctgtaattatccctatgtcagtattatcccattccaactacttcatagcaataaaatttataaagtgttttaatgtctgatattaaaataagcaagcaactcccttccctccccacctcttatctttcaaaatttttcaggtaaacttaagaatcagcttatcaattaaaaataatacttttgatattccaattaggatgtatttaatgtacagattaatttgaatgtaactgacatctttgactgaattttcctatgtagaaatatagtatttccttttattcagaaaaggaaatacatgccatatttctatttcagtagttttatgatttattcacaaaggtcttaacatgtatcttgttagatatgtccctaaataattgaagtctatggttgatatgggaatgagttttgtttttgtttttgtttttttgtttaagagatatggctcttgctatgttacccaggctggtgtcaaactcctggcttcaagcaatcctcccacttcagcctcccacagtgctgggattacaggtgtgaggcactgtacccggccctgagacttttgagataatttctaactggttatttcaagagaacaaagataatattgatttttacatatcactcttataaccagctgccttaattaagtctctaatcagtcctaggaggttttcccccatttattgttacgattttctggtaggctattatgacatctgaaaattatagtttttcctatatcttttcagtttttatatatcccttttttaagaaaaatcactagctagaacgtcaagttcaatgctacttgagttgtgtcttgctcctaacttaatctgttccaccattaaacatattcattgtaagtttctatcagatatattttatcaattaaagacagtttcttttgatttacatcttattgtttttatcacaaataggtgccgaatttcatgaaatacttttttagacttctgtcataaatatattaatttttcctttaatctgttaaagtaatataatttattacattacaaaagttactattattgaaacatccttgcattcttgtgatgcaaatggcttacttcgacatgggatatgttactctttcaatataattgctagcctgaattttatttaactttgtactctcatatctatgtacttgattttatatacatacaactttgtgttttatttggctttagtatcatgttatattagcctcacagaaagaattacaaagtgctctatactataaaatagtcttataacatagggaaatctgtttctttaggatttggtaaaattcacctataaaaccatatgggcctcacatctctgactacttgttaaatttttaccatgattattgaccaatttaggtttttaacctctttctgattcaaacagaatcatctatttcatctacattttccattttttggttacatgtgcatatatttgtatagtattctcatctatatacatagtaatatcccttttcttgtttcatatatgttctataattatacattttgttctttttcttaatgaattcaccaaaggtttgtttaatttattgatctattttagaaaacagtttttggttgtcagtttttggttgtattttttaggtttattggcttatcttcatttataaagataaaagtagactgggcgtggtggctcatgcctgtaatcccagcactttgggaggccgaggcgggtggatcacctgaggtcaggagttcaagaccaccctggtcaacatggtgaaaccccgtctctacaaaaatacaaaaattagccgggcatgatggtgggtgcctgtaatcccagctactcgggaggctatgacaagagaatcgcttgaacccgggagctggagggaggttgcagtgagccagtatcgtgacactacactctagcctggggactgagtgagactccatctcaaaaaaaaaagagagagagagatcaattttttttcttttggagggattgaggagatactggttaaaaaatacaaaatttcagcacaatgaacaaatgttcttaactgaaaacagaggaaaaaagttttcttctttctgctttgggtttgtcttgtagtggagggtgttcctttggctcacttacttcccatttttctaataaatgcatcttcttttcaatgtttcttggcctcagcccaccagaacatgcatctgatgcatgttaagactctggggttgacctccatgcctgttcctttcctcgtcccgcttcctatctctgactttttgatcgttctgcaatgttttgctctctatcttccagaccgctaatttggtctttaattctatttgcttctcaagccaacctagttaaccttttaagttcaatcaccacatttttaatgtccatgaactttcttgttctaaaagatcttttttcacaacaggctacttagattcactatacagcagctcaaatctctttgaagataccgactaacatgtttttggcttctgctatgcgccccaaagtctgcttactctgggctttttctttcatactatttattctcctcaaatgtctggtgatcctttgatgtgcattcacactttggaataaaagactgggccaatcaacaagggaaaccactgcatgcttccagtctggtattaacgctctcctggggaaggccagctacctgcaggctccgtgtaagaggacagaaagtgtccaatgatgggctttgctttaaggtatacaagtaaacaagcacggaggcagagtgggggacaaacaccaaatctgccaaaacagtctctcctccagtggcgaaggacgttcacagataccgcctgctagagggcctacatttccttcccaggacccctgttactgcaggagcccgcagggatctgacactctgctcggcttctctctcaggccccaacaccccctcaaggatccctccccagacacagttctcagtttttagccagagaccattgtataaatgtaatgcttcgatttcctaaatattactctagggccccttcctgttggtggttgttagtcactgtaaactcagcttttaatcccccccttttcttttgcacctgtgttttgagttacaattgttttgtttttgttttccttttgtcaatataatcccatctgttttcagtcttccaggaattcttcataacttttagtttaatagaggtaggcatcctttcaaattttctaatactattacagatgttttaaaatatttaccttttgttatttaaaaagatttttggcaagagagaagctggatgcatgtgttcagtctgccattttactcctaaaaatccagattgtcctcctgaatgcctaaatacttttttctaatttaaaatgctttattcaaagcaccctaaactagtacttcgctaggaaactgaaaaatattcctcttaattctgcttgctagtgaacagaacagactttaggcctcttgaattcattttaaaagtaactacagtccagttaaacaaggtaaggtccacaaaagaaaagacgtttaagcaacattttccaaagagagaaaaaaaaacacatatatgtaaggtttgatgagacaggcagtcctagaaaaacaaatggtacttcaccagatttcaaatgtaaagatttattcatttacaaggaatcaaaagtttgatccaataaaaaggcagttacaataaatctaaagccaatgaggattaagtttgattttttcaagcttgatttgatttctataaaagtataaaccccaaatatattgcttctacacattatatgcacatcagatgccaagtcaacgagtatttcataaatgtataacataaatatttaagaaagcaaaagagtataaagaaaagatgtggcctttgtcttttaaaaacagaaaatctgaataggaaaaaactatacacgtatctaaatctccacacagagataatgatagacgtagaagatggtgtcatgttacatcccactttttcagctcttacagaattgctacagtaattcacaagtatggtgagggagggagagtagctgaaacaggttgttgttgttgttgttgttttttatctgttattttaggttttactaatggaagtattgagactagaacaaaaagcacatactagatagatacttacctgaccaatcctggcaagaggactattgtctcactcacatggaattttaaaaatctgaaagtcttacataaaaatccaggtttccagtttgtcttgagtagtcagaaaagctgacaaatccagccccacattcctatgggaaatcatcagctggtgtgctggtaaacgttaacaactggctctctatagaagaaaaacaaaagcaaaagcccctgatctgtatagcatttgccatggtgtaaatacacccatcatggctgatttcaagctcccaacgtgatgcctggaaatgacaggcacaatcagctcatggacaacagtggccagagctgagtggtggctgccccttggacaggagttacgggccttccgtcctcactgctccctatagtcttacagtggctgctacctgcactggcaccagcccgccccacccctttctctctcttcacccccaagaattcctgagccagatccaagctggtggtagtgctgggcacaatgtcctcctaatcctcatcagaccacatggaaaaatcattgcttaggtaccacattttaggaggggcactgccaagcctgagtaggtaaagacagcaatgagctcagaagacatctccaacacaggatggctgacagcactggagatgttcacaccagatactgaccggggcagtgactctcaaagtggagagagaagagatgatgggtagggagaagtgcaccaaatgaaaaaaaaaaaaaaaaaagaactacttcatccaaaaattcttgactctgatatgttaaattcaattgcaaatgacattaaccatccacaacacttttatgtgtattaaaggaaaatatggatctctaaggattgtgaaacatttgtttaaaggaaacagtcaccctcctcaagtgtctaaacagctattcagtggaagaatctattttcagcatccattatgctaattaacaaggcatgttattttcaccagtggatatccaatttctaacatttattatgctaatttgatctgatataaaactataaaaatagcagagacactggtagtagctgtctctggagggcagcccttctgattaaaggccagatgtctagccctggatgcccccacttagagaatggcttaaataagcacctaatccacctgatgttttatgaagccttttgaattagaatagactactgggagatggtattttttgatgtcattgttcacaaaagggaagcaactgaaagcgccgacttttagaaagaacagaaacatcagtgcttattttaaacctaatgggagcttaggaacatggtccagtcagaggaggagcgctcccctgtggtgcctgaagcactcgactgtccacagctgccgacactcacctgggaactactgttctgatgatcccagcagcaacgcacaattcagtgcgccagcaccaaaggaggaaggaagacagaggtttgtttgggttggtttttttgagggggggtggggggatgtttattttactttaatcttgaattaggcatccaacttctcctaatttttattctcttaattttttctctgatacctcccccacccagtctactgcaaaggctcttgctataagaagtaatgaaaataggccaggcgcagggtctcatgcctgtaatcccagcactttgggaggctgagacagcggagttgcttgagcacaggagttcaagaccaacctgggtgacgtggtgacaccctgtctctaccaaaaatacaaaaaattagctgggtgtggtggtgtgtacctgtggtcccagctactcgagaggctgaggtgggaggatcacttgagccccagggggcggagcttgcagtgagccaagattgtgccactatactccagtctgggcaacagagcaagaccctgtctcaaaaaaaaaaaaagtaaatgaaaatgttttgtaaactacaaagtattatcaaatagaaatagtattccttggaatttgtacattattagtagcaacagtgatctttaaaatgagtcatttctgctagtgtttaataaattaattccttagagataagcctccctgcaggggctacttcattaccaataaatgtttactaaatgcccaccatatgcaccaaatggtagacgattggaatacaaaagcagaagggagcaggattctcgtcctcaacaggcaaggatctgctatagactcacaccatccttcaagtctggccaccctccccatgacactcccttctatgttgcctctgggttatcttgtctctaattaaacactttggcaaagtgggatctcgttacctggggaagcagcccttttcccctgaatcagttcctttccttcagttagctgaggtacttactgggaaagaaaactccatacatatgaaggggagtcctgtggcagcgtgcacctgagccatcacacacacaagagggcagagccatgaacgggggatgaaggactgtccccgagcacacgctaccacacgtcctgaacgtacggctggttacagctagttaatattttggaaatgctattttattggctaggaagccttttccaaatgaaaatctctttactgatagattagtgaaggtagtatagaggagttttattttgtttttgtttttttaatcagcagaaaagtctttcccgtcctctgggcagacagatagcagagaattacgcgcttaggtttcacagccaggctgcttccgttcaattctcagcactgccacaaccagctaagtgtacctgggcaaactacagaagccctataaacctcagtttccttatctataaaatgggactaattatagtacctacttaataggggtgttctgagaactgaatgagatgatactgtaatccttcaactgaggtccccagacaaatgctcaggagttcatgagaaatttttacttttgttatttcatggagaatcttttttaaaatttgacataagcatcctctgaatcagatggctaggtgctatgtcaccaagtattgctgtaagatttcagtgactatgtttgtatttttctggtctaatgaaaaaaggggtcaggcgcggtggctcatgcctgtaatcccagcactttgggaggccaaggcgggtagatcacttgaggttaggagttcaagaccaccctggccaacatggtgaaaccctgtctttactaaaaaatacaaaaattagctgggcatggtggccagtgcctataatcccagctactggggaggctgagtcaggagaattgcttgaatctgtagggcagaggttgcagtaagccaagattgtgccactgtactccagcctgggcaagagtgagacactgtctcaaaaaaaaaaaagaaaaaaggacagagacaaacccaatatataactgaggcatttgcactaagaaatagtcaaattatgtcaccacaacctgtatgatgaaaaattttacaagagtttgcaagatgaaagtggaggggaaattgcattagccggcaagtggcatgataggtagactaacattacagaaccaaatccggcagactggcagcatatgccacagttgtggaacagaggtttggttgcagcagatcttcatctgttgtgtcacggctagcttttattggctatatttagtttataaatgtgtattctagttatgaagttgtaaagaaactgcaagcataagggccaggcccatttttatgctttatatattcaagtaacataataaagataatcatattgtacttacgtaagggaatgttctcattcttttttttttttttttgaaatggagtctcactctgttgcccaggctggagtgcagtggtgcaatctcggctcactgcaacctctgcctcccaggttcaagcaattctctgcctcagcctcccgagtagctgggattacaggcgcctgccaccacagctggctaatttttgcatttttagtagagacggggtttcaccatcttggccaggctggtctcaaactcctgacctcatgatccacctgcctcagcctcccaaagtgctgggattacaggtgtgagccaccatgcccggcccaggaatgttctcattcttaagaaatgcacactgaattctttaggagtaaggaggaatgatactggccacttactctcatatagaaaaataatacccaactatatatacatacctatgtgtgtatatatatataaaacatgtaccaaaagacagagagaacatgtgcatgatgaaggaaataggggtagataaaaacaactggtgaatctggttaaaggacatgtggtagccaaagaactatagcttctcataactagaaggaatgcacttaaaagttcagatccagagttcccctaggaggatcattattagaccagtgattcgtgtggggaaagggacctgatgtcagatgcacctgggaaggctttgtcagaatgccagcaagtaccccgtctcctctctgaggatcgcggatagcagcgagccactcttatggatgaaaatgcacggcacacccctctggtattttaggatatgaaagtaaaaatcactgatgcagtgatcagataagcctccaaactatccgaaatgatcacagaaggaagtacttaatgaacactacagaagagctggcagaaaaacgatccaaaggccatgttatattgagcattatttttagacttaacttttctaaagtgcaactttacaaaaccaggagtcctcgaaatacatagagaaacagacagacataggcgacaaaacaacaactgcatttcccgtttgggctttcctgatgaaattctcccacagttgcacacacagttgctagaaagcaagagtacagtgctctttccctcactaagggaaaaccagactcaacaccaagactccaaggggaatgggcaggaatgacatcagtatgttgttctctttccagggcaccagaggacttggcactctgatcacaagtaaacacaactactccattagaggcagttcctccctattctaagcctttattattcctgggttttagagtcagtactccagaaaatggtcactccctttggtgaaacctatttgtctccctcctgtgctctggggcatgcctgcccctttgctgtaccatgcctcaatcgagtccaccttgtagatgctgatctactccggcatgtctgaatattaccggctccttttattttcatggcccacgtggcagtcagatcatcccagtgcatacaacggaggagccaggagtaaagtttatcacacgaaggagatgtaaaccaaatcatgttttttcaaactgtcggttccaatgtgttagtggatcctaaaatcaatgtaaggagccatgactcaacttctatttaaatagagtgcaaagaccagaaaagacacatcaaactgcactgtgcaaagtaagggtaaccattgtctcctctttttatttttttaaacatattttagagacagggtctcagtcgtcgcccaggctggagtgcggtggcaccatcacagttcactgcagcctagtactcccaggatcaggtgatcctcccacctctgcctcccgagtagctgggaccccgccgggtatgtgccacccatgcccacctaatttttaaattttttgtagagatggggtctcattttgttgcctacgctggtctcaaactcctgggctcaagtgaccatcccaccttggtctcccaaagtgctgggattagaggtgtaagccaccacctgagccagtactgtctcttaaaacttttggattggttatctcagtatatgtatatgaagatcacaatatgaaatggcttttttgagatggggtcttgctctgtggcccaggcctgagggcagtggcgcaatcacagctctctgcagcctttaactcctgggctcaagccatcctcctgcctcagcctctggagtagatgggactgtaggcacacaccaccacacccagctaattgtggtttttttttttttttggaggatgaggtcttcctatttttcccaggctagtctcaaactcctgggctcaagcaatcctccctcctcagcctgccaaagtgctggcattacaggcatgagccaccatgcccagcctaaaatgcttttttactgtgtgccacagtcaaccatattcaaaagccacagtattagatgctgagagaaaaggagagagaaagagacagaaagatcaggagtgggcccagctgaactagtcacaggagcaaaccccataagaggttcacttggctgatgcagaagccgaccagaagtcaccatgatcttgaggaaagaaatcataagagaaaagagtatatgagtgcaactaaacattacgttatcattaagctgacctggtttgctttcctttttttaaggcaaatgtagactacagcctagaaatataaacatattccatacaagagggccatgtgtccccattataataaaagcttgggttcttaggaatgcttacttgaaaggagtatggtaatcaatgcttcatcaattagtcaaccttcaataatcatctccaaacaaggagttagtgaatttcttggggcagatgcaaacgcaacccctgcaaaagctgctgtccttgccacatcactcacaccagccccatccagccttgctgatcatctgcatattcattcaaaagcactattccctccaccaaaaccctcaaagttttaatttaaagttattttaatctaagtgaggaagtcagcggatgcaattagatcttaaaattagaagatatggttaccaaacttaaccattttgtaaacattgcaataaaatggaatatcatgttaaagacatgccaaggtgttgttttatacattagcaccaagcaccttgccctcccattttcatcaatttaccctatgaagaaacagctggaggctggcacagtggctcacacctgtaatcctaggtgtgaggattattttgggaggccaaggcgggtggattgcctgagctcaggagtttgagaccagcttgggcaacatggtgaaacccctcctctactaaaatacaaaaaattagctgggcgtggtgacacacgcctgtagtcccagttactcaggaggctaaggcacaagaatcatttgaacccgggaggcagagattgcagtgagccgtgatcgcaccactgcattccagcctgggcgaatgagcaagactctgtctccagaaaaaaacagctggaaaaaagctgggacttcccagcaccagtattaccaatcactgaaaggagaggttcctcaagcacaaggaagaacagcaatctcaagttgtatttccattcagtaccttccagggttaccctagacactgattacatcaatgtctcatgagcagtggaatgattattttaagtaaatttatcccttccaggccatccagataagcaactattgtgttactacaaaaccaccattttactatttattttagctctacagtgtactattgaaatatttcttttattctccactagtagacatactgaagccttaatactatcaggtattatagactcaagtcataataggtactgttcccttcaaaatgctgaaacaataacatcctcaaaaatccccaagttttcagttctccaggagcaaaggaaaagagaatcatttaggtcaccttgatgagctgggaaactgatctcaagtagtagaacatttttctgtttgtaataagaggcccaaatcagattacattcacaaggcttttttaaagtgttgaggagaacgttaacctcccctaaagtctgagagcaatttacaacaaaagctaaaatagaattaatgtagggcagagaaagctgagtcaggctgaatcagcccaagtaagtctaagaaatccactgaaagacatcgaaacctaatgttcaactttgtctataaattgtatgacttttcacacacttacataataatacataactaatgaattaggtaacagaaaatacaatgcctggttttcgagctcagcatacttgagagtggtacacataacacaagagtaagaaaggtttcccaaaaatgttaataataattgaagacatctttggacttttttcctctcattcaaatgtaaaaaatgatcctaagaagctgaaaccatgatacagggattctagaattatgccagcccatctctaaagcaactggagtcatttgagtcaaaagaatgttcggctaggcatggtagctcacacctgtaatcacagcagtttgggaggccaaggcggatggactgctggaggccaggagtttgagaccagcctgggcaacatgatgaaaccccatctctacaaaaaaaagaaatagaaaaattagctaggtgtggtggcacacgcctgtaatctcagctactcaggaggctgaagcaggaggattacttgagcctgggaggcagaggttgcaatgagctgagatcatgctattgcactccagcctaagtgacagagcaagttctgtctcaaaaaaaaaaaggagaatgatctaggataaagtctacagtctattttctgattgttagagccttataagcgaatttatcctcattcttcaaaaacaccaatgggctgtgttcaacacagaaggaaagtaagagttcctctttcccttagcagtatcgttttgtttctccgaaaacagctctcccaaaccataggttccaaagggagtcttgcatctacattaccagctgtgcttgtccccacttctatacattttacagccataagcgtctgcacacaaacatattcatgagtcccatgaaggcaggaactgtcccttctttatctttatatgccccttatatataagggttcaatcatcactcactaaattggaaactaggtaggcctccaactggaacagaatgatcaaaagaggagacaagaaagtctttactctccccacttaaagacacaaaaggttaccctgaggtaattatttctatttttcattgtataaacagtattttgttttattattcctaactaaagttgggcattgtaaaagagagaaattcaaactactaccttatataaaaacttctaaactgactatattggcgctcaacaaagtctgcaaatagctattcaaatcagccacttctccagggtcgtcactgctccctacagtcttacagtggctgctccctgccctggcaccagcccgccccacccctttttctcccttcacccccaaaaactcctgagctagatccaagctggtggtaggcctgacacgatgtcctcctaatcctcatcagatcacatagaaaaatcattgcttaggtaccacattttaggaggggcactgccaagcctgggtaggtgaagacacagcaatgagctcagaagacatccccgacacaggatggctgacagctctggagagaggtgatatgcaattgtagaaagtcatatttcttgcaatcttagaggaataaaggagttttgttgttgtttaggtaaaaagccttcggcctgagctgcctctcccgagctccaattcctcagattcccatttaacatccttgaacttcaatttctttagtaaggaataattatacctcaccatcaggtggttatatcctcacaacaatcaaaagctaagtaagtgtgaattatacaagaggttgaaaaaaccttactagatacctcacgcaatcactggtagaatgatgatcttgtaggggtggtggcaggagggtgggaagacacagacgcatgatgataaggtttggatatttgtctcctccagatctcatgtaagaatgtgatccccaacgttggaagcaaggcctagtatgaggtgtttgggtcatgggggtggatccctcatgaatggcacggtgatgagtgagttctcactctactagttcactcaagagctggttgtttaacagagcctggcacctcttcctctttcttgcccttcctctcacatgtgacatgcctgctctccgtcaccttctgccaggagtaaaagctctctgaggcctctccagaagccaagcagacactcatgccatgcttgtacagcctacagcaccgtgagccaattaaacttcttttcttaataaatcacccagtctcaggtattcctttacaacaatgtaaatggactaagacacatgttaatacagaagactgggagaagccctatcagaagccaacaatgtgccaggagagagggcaaggcagtcccaaccaggagtcaaaagctaatcagtaagctcagtacacacgacagcccgttaatcctcatcaacactttgtaggtaggtattgttgctccatgttactaatgagaaaactgaggcttagaaaaataaaagtctaacagccagtagagaggtagacctcagattttaagaacatacacttgctgtctgccaatccaggaaggactaaactggaaagagctcatcttcgagaacttataatgtataaaacgtcaacctaaatttttttgttgttattaatattttagtgcttagaaaaagaactgttcctacatgaaacagtaattcttacaatattgtttagcaagtaatcttaactttgaacaagaacgtttaaaaataaatatattgttgggtgagcaggaaaatcactttaaaatgttgtagaataatcttccaatattgttcctttcacccatccctcaaactacactaatgaacattttttttctcccagtatttgctctttctcagcaatgcaaacataattttcatgactgttttccattatgacacatactgtacatttccaacgacataaatgacgttcgatgattttttttcccatctctagctctctgctggtcaattagtctatcaactaacacatatttatctcaacatctgagacacataaggagtatcttcattccagatcactgatagtaacctgagaaggaaagaacgacctacaattaacggttcaaactctagcatacaaagttaaaatactgattaaggccagacgtggcagctcccgtgtgtaatcccagaattttgggaggccgaggtagacggatcatttgaggtcaggagtttgagaccagcctggccaacatggtaaaaccccgcctctactaaaaatacaaaaaaaaaaaaaaaaaaaaaaaattagctgggcattgtggcaggcacctgtaatcccagctacttgggaggctgaggcagcagaatcacttgaacctgggaggtggaggttgcagtgagccgagattgcaccactgcaatccagtctgggtgacagagtgagactccatctcaaataaataaataaattaaattaaataccagttaaataccagtacccacacttgagtccacgagtttgaaaccagcctgggcaacacagcatgatcccatctcaaaaaaaaaaaaacaaaaaaaaaaacaaaccagtatccatagttaagtgccagttaaaagacttacatgttcttgaaaatacaaatgaggatgtgaagctgttatctctaaggaaaaccaccaaaattaacagcaaatagccagaaaaccatgtagagaagcatgtaattttgttatggagcagaagacaagggatcattaaagcacttaagctattttataatagactcctcacttacgtttttcgtcatcagcatgcaccagagatgctgccctggacaaaacatccaatggcgtctccattcctggttggagcctaagaggaaaaaataaaaggggaaaaaataatttaaacagaattcaaaagactcttagaatcctagtcattaacagaatgagtcctcaaccaaatgcaaatcattcttctaaggatgaaattcttcccacatgaggaaacagaatgggcttggttcagggagagagaaaagggttaaactccatttagtctactaagctaaactttgccaactacaggaagcagctgatgtaggaactaaaagaagggatattgtgaatattcatgcccatgttatttggtgcttatgtttatgtgcatgcataacatgcctgtataaacatgcccaataaaagaaaggttttcagaacaacggctgctctatgaacacagcatcactaccagtgaggtggtgcagcttaacacacgccacgtactcatggaaagctgtgtgagaaacccactggtaggttaattgatattttaagtccaataagaatctttatgttaaaacgtcatgttttgtataatggtatattatataatcaccacctatcatcaatttatctagcatcatgttttttaataagactggatttttattgttgtttccttaaattacagcatactataaaagctaaaacagcaaaagatttaaagctcgaggaaagccctggaaaaccagaatgctttttacccagtttcccttttctgggttatttaaacacacacacagttactggcacacacaccctactagctcaccagctgagaaaaacaactccttaactgtaccactttacagacacttggaatttattcagcattcttcaacacttatggagtacctactacgtatgcaccggtcacaacatgtggcagaccagcttttctttgtaatattcatacctcaggcctccaaagaaacactgatccacgaggcatggtagctcacgcctgtaatcccagcactttgggaggccaaggcgggcagatcacttgaggtcaggagttcaagactagcctggcgaacatggtgaaaccccatctctattaaaattacaaaaaattaggtcgggcgtggtggctcacgcctgtaatcccagcactttgggaggccgaggcgggcaggtaacctgaggtcgggagtttgagaccagcctgaacaacatggagaaaacccatctctactacaaatacaaaaaaattagccgggtatggtggcccatgcttgtaatcccagctactcaagaggctcaggcaggaagatcgcttgtacccgggaggcagaggttgcggtgagccgagatcgagccattgcactccagcctgggcaacaaaagggaaactccgtctcaaaaaaaaaaaaaaaaaaaaaagaaaaaaagaaaagaaaagaaagaaacatagatccctgatcatgcaatatgacttcattcagtaaacgttaaatatctacaaggagctccaggcgggaaaaataaacaaagcccagtagctgccttcgaggagctttcaatctgcacgggaggcaggccaccgagacatctagtttaaggcagcattcttccaaagcattctgcactgggtgttcatattttgtaagaaaaaaacgtttttctatggtaaataagtttgaggaagcctggagtaaaccaagctaagcagcgtattttcctccccgtgcctttaatctcccgttgtggggacagaaagccctgtacacgcgaaacctcgtagacgtcatgagccattttcaacccaaaacgcatctcagggaacatctggggaaaatactgggttagggcaaaatgtgcaaagcgtcaaaacagtgctagaaacaaagtcctacagaaataacagatgaattctgaaaggctttgtgaagaaaacagaacttgagcggaggctttgaagaacgaatataaaagttcctcccccagaagggaagaacagaagcagaatcggtttaacaacacgctgcccaaatcgcctacaagagtaaaatggggacagaaagtaagcgacaaggttggaaatttagattgggaccacatcgtgaaaggactgagggcttcgatgggaccgcggcttgacacgcattaaggagccactgaaaactccatctaagcagaaaagcggcttagtcatccatgcgttctgggcaagttatcctggccgcaccacgtggaacggagtagatagagctcgggaagctgagcgcagggcggacaacgggaaggccagagccgtgggcaagcacgcggagggcagcgaggggcactggcaccggagccgcggggaggcaggaaaacgcagaggcggagctcactgagcttggcaggcagagagaggaggggagggccacggaagactaagagtggcagggaggcaacgacctcctaacacacgcacatgtcttctttttcagagaggatgggtaaaagcagcggtctaagagggaaaacctaacagtgctcacattcctgatcttctttgtaaaaacagaaaagaccatctcctaagaggaaggatttgtgaacttgttcaacaatggagaaaaccaacaagaacttggaactgactaacagaaaaaagtctgctgaactcccaagaactaggtaatattctcttcacccaagccagcttcctattcaggaaagatctgggtttaaagtcttgtgatttggtcgagaccatcctggctaacacagtgaaaccccgtctctactaaaaacacaaaaaattagccaggcgcggtggcgggcaccgtagtcccagctactggggaggctgaggcaggagaatggcatgaacccgcgaggcggagcttgcagtgagctgagatcgcgccactgcactccagcctgggcgacagagcgagactccgtctcaaaaaaaaaaaaaaaaagatcttgtgatttggggtagtaactgctgataagcatcctactttgcaataatacagcatttagactcataattctctaaattaattttaccccattaagttgaaggacaatgctttcaaaattctagacctaaatagattaatacataccttaggttatataaagtatgcacagaaacaaaatatcaaagcataaaagtatcaaatgacataaggtagacccagaattctagcatagcggaatattagacatttaagtttatacagatgctatgaaatcctaaacccccaagcaacttacattcaaagtaggtagataagataatgggtattaaaggttcatccacaaggcacctgccatctgctgcaaccttattaatgaaatcaaccaatgtttattacacaattattctaagctcagcaaagtgcccagaaaaggttaaggagaaacagaagatagatctctgctttcaaggagtcacgctcttgttcggaaactaaattttataagataggataatgacaggcaaaatcaaaaagaggataaacaaagactaaatattatttaaaactaaaatgggtacagtgtcataaaagagatcaatgtcagctaacgtgtttgccttgtgcacatctattttttgtttgggggtggtttgtggatgcgtgtgtgtttcaaaaagccacttggaaaatttccttccccggttgccctgccccaggcagtcactctcctctctggcctccctcaccttcctggatcgcactgtgtttctgtatacttcctaggtgcaaggaccctgtcttatccccagtgcagtcatcctgagtcaacaacagtctgagaaaaggcacaggggcaggaatgagcacctgggacaggtggccagacctgactagctagaactgaaaatccacgttaggaagcagcagaagctaaattcaggtgagcctgatgcgggtggccttaggaaagagctgacagctggccttcaggttgatacttaatgtcacaggcaacaggcagttgtcatcatctgtccctgagctggcccgtgacatgatgttcacactattttagtttagaagttccatgcgtctaggcatgtggctcacgcctatagtcccagcactttaggaggctgaagcagaataattgcttgagctcagcagttggagaacagcctgggcaacatagtgagaccccatttctaaaaaaaaaaaaaaatttaaataaaaaatgagctggaagtggtggcatgggcctatggtcccagctactcagggagctgaggtgggaggatcacttgaccatggagggttgaggctgcagtgagccgtaattgcaccactgcactccagcctgggcaacagagccagaccctgcctcaaaaaaaaaaaaaaaaaaaaaaaaagacgaagaagttctgtgtaggatggtttgactggagagggtgactccagaagttactggaggtggatgagttaagaggcttctgtaggaagcaggtgcaagataaggacaatacagctgggacatgagggacggggaccaagcattatctagccatggaagaacaaagcaaaggtggaagataacagttattaaaaaaaaaaaaaatggtcttccaggtgggtgtggtggctcagccatgtaatcccagtgctctgagaggccaaggcaggaggatcgcttgagcccgggagttccagaccagcctgagcaacacagaaatttggaaatttactcatttctacaaaagattaaaaaattagccgggcatagggacgtatacctatagtcccagctactcgggaggctgaggtgggaggctcccttgaagccaggaggtcgatgctgcagtgagctatgatcacaccactgcactccagcctgagtgacagggtgagaccccatctgtaaaaaacaaacaaaaagtcttctgcattttatgtcttatatacatcctatccacagcactaaataaacccaataaaacatattgataatgtgggaggaaaaaccatggctacagtattagatggaggatcacaccacattgacaggcaaatcagcatcatgattatttcagcatcaaattagcatcaggattaatatgaatccaggtaaaccacttccaatctatgtaaccctgggaaatgacaacctctgtgtgtctatttcctcatctggaaaatggagatattaatattacctccctcatacggttttctgagaagtgaatgggccttataggtattgaaataattatttgccaaaacttatgcaaatatattgaataaatcacaaatgacagtaaatgtactgaaaatgacagggcactgtccactactttagctagcgtggtctgggaagatttcgctgaagagaagaatggaagttgagacctaaagaatgagaagaattagacccagaaagagcagggagggtgggaaaaggtgggagacagcagcacatgctgagaccaacacacaaaaaagctgggcaggtgatgtggggggcggccagggtggctgccctgaagtcagcaaaagggaggcctgaggtgggcagcacagggccaggtcacgtgtgcctggagggcctgcaacaccgatattttattttaagtccgtgaaaagtcctggaatggcccgaaaagcttcaagcaaggaagtgacaagtttattttatttcctttatgagccacaaattatcctctaccttacacaaaaaattatgctgcatctgaaaaacaaatctaggtctatcccaataatgtcttatttctgtggtagttttgcattaggatatagtgataaccaaaaataatccattgaggaccaggcatggtggctcacacctgtaatcccagcactttgggaggctgaggtgggcagatcacttgagggtgggggttcgagactagcctggacaacatggtgaaactcagtctctactaaaaacacaaaaactagccaggcatggtggtgatggcaccggtaatcccagctactcaggaggctgaggcagaactgcttgaacccgggagacgggggttgcagtgagccgagattgggaaagtgcactccagcctgggcaacagagtaagattccatctcaaaaataataataataataatccattgaaatgctgacacctggaacataacaacatttaagtgagtggagtgtggctctagaaaaagatacagagggccaggtgcagtggctcatgcctgtaatcccagtactttgggaggccaaggtgggcggatcacaaggtcaggagttcaagacgagcctggccaacatagagaaaccccgtctcttctaaaaatataagaaattagccaggcatggtagcaggcacctgtaatcccagctactcgggaggctgaggcaggagaatagcttgaacctgagaggcggaggttgcagtgagccgagattgcaccattgcactccagcccagggaacagtgcaagactccgtctaaaaaaaaaaaaaaaaaaaaaaaaacagatacaaagtacactgtgtgctccactgcactgcaaaccagtttctggtctatctattcacctttttcgtggttgtcaaatgtgaagttaattcatcatgaatagacatatattttgttgttgtggatttttttttttcaggtaatggtcatatattttctctgccagtccacatgcctttcctcacactcccttagcctcaattcatatgttcttccaaataactaaaggttgagaattagggaacaagaggtatcgattttaaagctacaaaaacttaggggcactcagtgctaacggcaagctcagctataaatctgacagccattttttggccttccacaaagaactgtccctttttagtcaacaaggggacatgagtacctatcttggtgtgttagtccattttgtgtcactataaagtaatacctgaggctgcgtaatttataagaaaagaggtttaactggctcacagtagactgtataagcatggtgccagcatctgctcagcttctggtgagacctcaggaagcttccaatcataatggaaggcaaagcagaagccagcacatgacatggcaagggcaggagcaaaagaggcaagaaggtgccacattcttttcaacaaccagatctcccatgaactaccagagaactcacgcatcaccaaggggatggcactaaaccattcatgagggatcgctcccatgatccaacctctcccaccaggacccacctccaacattgaggatcacatttccacataacatttggaggggacaaacatccaaaccaaatcacttgggaacagcactgtggggtatattagattatattgtttttcaagcaatggaacacaactccaaaatatgttatggaagttttccaagaagatttgcacaataaaagctacagcaccaggcatgttcactccatgtctgtcccatggcagtggctagatatgatatactttaggtaagagtacgagaacatggagcaactaccttgtctagatgtggaggccaggggggtgagcatcggaggaatcacattcaaactgccaggtgttcctgccacacacagtaacagggccaaaagtcagaaacagacagacatcactatccttaaacacctgatggcctctccaacttccagatgcacacaataaaataccctaattcctgttggccctgttccttcatgagtccaaactctggcctccccaggaccactccctgagctaaaaccaatttggtttcagctaataatatacaatggtaggacaaacccaaaagtatgaactatcacaccatggcatggggtgtacttcttggccatcaagaatttagagatgtggctgggcaccgtggctcatgcatataattccagcactttgagaggctgaggcaggcagatcacttgaggtcaggagttcgaaaccagtctggccaacatggtgaaaccccgtctctactaaaaatacaaaaattagctgggcgtggtggtgagcacctgtaatcccagctactcaggaggctgaggcaggagaatcactcgaacccgggaggcggagtttgcagtaagctgagatcgcaccatagcactcagcctgagcaacagagtgagactccatctcaaaaaaaaaaaagaatttagaggtggctgggcacaatggctcatgcctgtaattccagcactttgggaggccgaggtgggcagattacctgggcccaggagtttgagaccagcctgggcaacatggcaaaacctcatctcaacaaaaaatacaaaaattggccagtcgtggtggttcacccctgtaatcccagcactttgggaggctgaggcgggcagatcacaaggtaaggagatcgagaccatcccggctaacatggtgaaaccccatcccggctaacatggtgaaaccccatctcgactaaaagtacaaaaaattagccaggcatggtggcaggcacctgtggtcccagctactcgggaggctgaggaggcagaagaatggcgtgaacccgggaggcagagcttgcagtgagccgaggttgcgccactgcaccctagcctgggctccatctcaaaaaaaaaaaaaattagccaggtatggtggcgtatgcctgtagtcccagctacttgggaggctgaggcagaaggatggcttgagcccaggaagctgaagctgcaatgagctgagatcacgccactgtactccagcctgggtgacagagggagaccctgtctcaaaaaaaaaataaaaaagaatttagaggtatttactgggtatctcctctattaaaacactgtatttagacgttacaaaaaaggaaaagtaaactccctgcccttgagcaccgtacaccaaatatggatgatactgggtgatacactggctgtcaggctcagtgagaaggaaaactgaatgagaatcagaccaaatgtcaccagattctggtggcgacatgcaagcacagtttcacggttttaaatcctccagctctttctcctccccagagtgtccggtgatgccccaccaacttcgtgcagcacatattcttcctgttaacatcccattctcaaaccacccctctctgctcttcttgctaaaaatatctctcatttgagtaatccttttttcttctcgcactttaccatctgttaagtcaacagagccaggactttagcatcaggaagcccaagtttgagccctactttaaatctttcactcattcagtcaacaatccctgaaagcctattttgctctaggctttgccctagatgtctaacacttaattgtatgggccagtcatttaccctctccaggccctagtttcctccttaaagaaaaaagtaaaaaacattgcctaactaacttcctatgatcacaagcttatcacatagattaaacgatgtaactgagaatgtcttacaaactaaagagagaaacagattttattagtctaccaccaccatcttccaggtgtatagcatacatgttttcaaaatacattcacataaatgacctgattggattctcacaatcaaattattacttaggccaaatggccaaatatgattattatttttcttctacagattaaaaaaaaagaaaaattgaggcaccaagaatggaagtgacttcctgaagcaactaagactagaattcaagtctctcaattctccctccaatgctatttttactactcttaagttgatcatgctaaagaggttttagtgacaagcacaattatttagcctaggtcaaagcaaaccttccattagcaagcacgacttctagccctgtgctctttcctctacaccttgagatacctatcaggcaataatgtgaccgtttcaacagcgagcaaggggaagcaagcccttacccgtcaggaacacgcaaaccatggtatatttgaaattcttctaacagaggtaggcatggagtcacattaatagtaaccaaggcaggtaagaaaagaagactgtcacaccaggtcaattgatgctgagactgtggccaacaatgacaccggcaacaaactaccaagacatagcgatttctggggccacagccacagaggagtcaagctaaaaccctgaggactttgagatccacgaacaggtacagtagtaggaaggatggtgtcaacttcaccatgctcaggaagacctgtggtcaagctccaacggctaactgttaaggttcagtgagaacatttttaaaatttcaccttggtgctcgaactgctcacaaccttaaattgtatgttacctttctaaatagaagccagcccttattcaaaatattctctcaatagtcatattatcaaagaaagagcatgaccagacggatcatttgctattccagctttcctcacagaggcatgtcccaagcaggtataactgactcacgctgccgtaatttgaagcatcaatgccagaagaacttggctgcttctgcttgcgtcaaattccttacttctacacatgatcactcctgaaaattcattagaaggccaaacgttctaatatttgaacaatatatcttcatgttctatatctacctcctgagaactgtgtgtatatatattatttatatatatatatatatatatatctgcataaaatccctaattaggattttttcaggtacctgccaacctcaagtgtgagccccagatcacaccctttccataaggcttagcacccctcctgtgaaacctctgcaggagggaggtctacaggctgggcagctgtcaatctcttaccctccaatgtaggctggaggctgtatagcaggaacaggtaaccttaggtgcctccacctcccatgacctcaacagaaagtgagacccccattaactcagaccaaataaagggctaacactctggatggaaacactgaatgaatgctctgctcaaccactcaaggtttcctgatgctaacgtggctcagggcttgagtctataggacttctcagccctgcaggagggcaggggtacgatacttagtcatcacaactaccctggcaacaggagctagcagatagtgccaccacacagtgacaaaaatcctcggttattgtaatacagtttggtatcagtgtaaactatacaaatgcacagactgtatgaaagttgatcatgtacccggtgaggtacatctatacaggctctgggctgcaaaacccaacttacattacaacacatttcacggccctatgcaatgctgcctgatgctggtgcaaaattcttactgctggctgaagtccacccatctccctaaagtgtcccatggaaagtgactatatggtgggcccacactgaaactactgttatctaagggggacaaataaaaatcaagtctgaactttctgagcagactaccaattcccaacatttttcaacactgttgtcagcacaaataaaaatgaggccaggcacggtggctcacacctgtaatcccagcactttgggaggccaaggcaggtggatcgcttgaggccagaggttcgagtccagactggcctacatggtgaaatcccatttctactaaaaatacaaaaaataaaataaaataaataaataaaaatacaaaaaaaaaaagaaaaaaatgaaccatgtttttctttctcattttaggatattatgaatctctctctcttcattttcaagaccgcagccttatacagcaaggcatatgaaataacagaaactctttggcatttttagtttcctctggatatgcttgctcttgcatttatttgaagacttaaaatttgaatacttatgtgaatagttagtatttcctattcacaagtgctaaagcgacacatattcttagggacctattactcccaagaataaaagatgaatttgggctgggcgcagtggctcacgcctgtaaccccagcagtttgggaggctgaggcgggcggatcacgaggtcaggagatcgagaccatcctggctaacacagtgaaaccccgtctctattaaaaatacaaaaaattagccaggcacggtggcgggcgcctgtagtcccagctactcgagaggctgaggcaggagaatggcgtgaactcgggaggcggagcttgcagtgagccgagatcgcgccgctgcactccagcctgggtgacagagcgagactccgtctcaaaaaaaaaaaaaaaaaagatgaatttgcatcacagcccaagttagcaagcttcccagaacagcccaggtctaactctccatggttccaaaataaaatctcagccctcagcctattaaagccacataaagtcatctaattaatgacacagtgcaacattaggtagcactgtagttattaccatcagtaaatattattggttcttttttttattttttgagatggagccttgatctgtcgcctaggctggagtgcaatggtgcgatctcagctcactgcaacctccactttccgggttcaagcaattctcctgattcagcctccctagtagttgggatcacaggtgcccaccaccatgcccagctaatttttgtatttttagtagagacggggtttcaccatgttggccaggctggtctcaaactcctgacctcaggtgatccacctgcctcggcctcccaaagtgctgggattataggtgtgagccaccgggcccggcccagttcttgttattcatagtagttgtgttctgtaaaatctctgtgaacattgaattagtggatattgaaccagtgttcctaggggaaatgagagtgagattccttccggcttctggtcacatttttgcaaactgatcaatacacaaccttgttttacgtatgtttctgtttaaagacaccttatttaatacctattgttgattcattaatgttgaactcaaggccaacagcaccgtaactcaagcctgaatgaagctcatctaacatgtatattttctccatgaggctcatcacagccttcttggctgaggaacattagacagcattttagcaccatacttacgggccactgtaaatagcaaaatccccaataaaaagcacaaaaatgggcagggtgcagtggctcacacctgtaatcccagcactttgggaggccgaggcaggcagatcacgaggtcaggagttcaagaccagcttggccaacatggtgaagccccgtatctactaaaaatacaaaaattagccaggtgtggtggtgggtgcctgtaatcccagctactcgggaggctgaggcaggagaatcacttgaaaccggaaggtggaagttgcagtgagctgagatcgcgccactgcactccagcctgggcaacaagagtgaaactctgtctcaaaaaaaaaaaaaaaaaagcacaaaaatatataaaaacatgttactaaatagactgcaaaaagcacacttgtttacagcatgagagctcaaacaagaaggcagggtagtgccttgtctgagctctactgggaacatgtgcattgggaggctcaaatttttccccatactgcacatgtccacaaatgtcgaagaaagtgtcagaggcattgatttggggcttacaaataaattttagtgagtagacaaatttataaacatggaaccacgaaaaatgaggatcgactatatctggctattagacctgaggcatgagacacagaaagtacattctacaaagttttctctctttgcaaaagtgctattattctgtatttcaagaaggtataattgttctggttttagcacctcctacattccttttcctaccttggcagtttgtatctgccaaatcttgcatcaagattttgcaatctagttcttatgatactgggtttttttttgcgggggggtggtttatgtggacagatcctaaatgctacagattagcagcattcactttactcttctattaaacacccacccatagcttcattaactttaggtgagttccctgaaagaagcacaaatgagcctcagttaacatacctcgaagaaatttcttaactcacacacacaaaaaactttctctttcaccaggttctcatagctgcaacagctcatctcacacaagcaataagcagacacattggtatgttaaaatcaccacaccaaaacaagaaggcaataccctgccttcttgtttgagctctcatgctgtaaacaactgtgctttttgcagtctatttagtaacatgtttttatatatttttgtgctttttttttttttgagacggagtttcacaatttcagtgacgttaaaattttcccgtgtattttatttttccttcctgagcttacaacttttagtacttttgttaggtcatgttcaaagttacaaaacaacttttattgttaacctactcattattttactaaggcaaattaaaagctgcacagcaaaactctccaagacagatacctagaagagacacgaaataaactctccctttggatttgttttggcaaccaccagagactggtaacagggctgcctccataaggagttaagaggaatttcccactacagattttttttttttttttttttttttggtacagttgggagccgggagtctctctgttgtccaggctggtctggaactcctggcctcaagcgatcctcttatctcagcctcccaaagttctgggattacataggtgaaacaccgcgcccggcccagaacatttaaaagtgaaagtttttacataattatcatgtctgtaagaagtgttaaaatcttcagataaagtcataattttaaatcagttgggggatagcagtaacaactgtgtttatgtagctctttcaaagcttcaaagaatttataaataacacaaaatactttcaaagcacattattctctgtaattcctgaaactctgtgatgtattggaactaatattaccacccttttacaaaggaaaataagatacaaagtttgagtacgagtaacatttctggtcataaatctagtcagtgacactgataggactagaactcaagtctccagaaataataacccagagctgtttttactacaacattcacagttttggaatgtagtccatagttatttatagcagaattatcttcttaattgtattgtgttttggtcaacataaaaattagtttgcattcacttccaaatggaaagcaaaggcaggctgcccagaagtgtgaaaaaacggtggccggggaaattagcctgggattaaaattttgccaaagttaaacaacgaattgaagggtttacatcatttccaccgtgggggagatgacttttcaggccagatgtaacaggaaatacaagaaaaaattcaaaactgtcttgagtgtaagacaagaaacttctgaatcaagtatttctaaatcctttatttaaattgagagcattgggacttagagataataaataacttgtcccaagatcacaccacagggacagctttactgctccgaccccaaaggtctccttaaactgcccactctactccctcccagtcatgcgcagactcttcattagatgcaagcaggaaacaatgaacagtacaagtccgtggactcagcgagtagagaaagagttaaagtttggtatgctaacatggtatgcaaaactgaccttcaaatcctaataggcaaattaattttttttttgtctttgactatttagaggaaacaactgccagactccttctgagtagaggtaggcttgggtatagaacaagatattaaaactccacaaactgggagacagtgcctttcaaagagagggcaaccagctgttgataaaacccagcagaaccgcctccacttccccacacccctaccctcccgcgccaggctgctggttcttattaatcacagagaagggactacaactagcaaacatacagcaccgacgatcaaagtgaaaccgattttttaatcatctaacttaaacagacgaacacatgccagcaacgtacataaatacgaatagccccagcaagcactgtcttcataacctaagacagttaaatgtctcagggtgatgaatcaaaggagacttcaagcaaaacaaaaagcgaacagccctgtgctcttccgcgaggcctgcactgggtgcagggagagtgtgcagtcctgttttggggaccgggcaggaagcacaggaagagtacggtgccccttcccgcagtccacatcacagccctccctgaggccggcggggaccgcggggtgccaggcgcgggcctcctcgcccgccccgagcctccgactcccaggacgtcctccgggagcctaggcgcttccgctcccaccggcgcctcccgagcggcccggcaaggacccgccacctcctccctcccgcagggcatcccggttctgctccgacagcccaccccaaggcccctctcaggccagccctcgcccagcccgggtcccgccccgccgaccgggtcaaccgcactcaccgcccggcggctctgggcgcgcccgcctggggccggcctggccctgcgggggacccaggggcggggacgggacctgggcacgcggggcgcaccccgagggcgcgcagacgcacaggcgggctcgcgcccgagcccccgcacgggcccccgccaaacacgcacacgcacacgcacgcgcggaccgggccggcggacgggagcgcgggagcgcgaggaatccctggaatgaggcaccggccaacctgagccgggctccgccaggccagccaggccacgccctcggtcacgcccctcacggagcaggtgggggctgagccaggtgagccgggagggagataggggcgaggcctcccgcggcagggagaggccgctttccctcccccgccagctgcgcgcccggtgccagctcgcacctcccgggccgatgccggcgcgctggggcagtgaggtttgtcggggcgggcgctcccgagaggcgccagcgggcagggcgagtggacatggcgcacactgctgtggacacggcatctcgcacgcccccgcccccgaggccccgccaggggacacagcgccgtgcaaatgtacaaacacaaacgcacatttcgtgcgcgcccaggtgcccgccgcgctccccacgcgcgcacagtaggtccctgctcccgggggacagcgcacgggacgccgacgttcacagtccaaccagacccgtcccgcggacctgctgcccttcccgccacacacaccccgccaagcgcccggagttcagccgaacctgcggcacccacgccgccctccgcttcccccggctcgcgagcagccggataagggcgcaccacccgcccgcgccggttcgccgtccacacccgctcacccccggaacgcggcgcaccttccgtcccccgcctcccgggccccgtcgccccctctcggcacccgcatgcccgagccgcgctccccgacggccgacggccacgcacctgaagggacaggtcacaccggctgcgggaggggctgctcggcgccactgcgctcagaacggccgcggcggtcccgggcgctccgacgccgctgggtttcctcccattacagcatgttgcactccagcgctgcacttcacactcgcacacgcgcacacgcacacgcgcacaactccaggcgctcggcggcgtccttcccccgcctcgcccggaggaggaagtcctagtaaatcaaaacaggctgggagggagggagatcggagtggaaagagtccccttcagccgctcacacaccagtgtttgctgtgtttggcaaactcctggcgtccacaacccggactgctctgaaatgt

SEQ ID NO: 629 - DNA, 56435 bp, Homo sapiens
ctgtcaaaaaggatcaaacactttattcatctacacataacatatataaaagcaagcaaaatcaggatgttttcctcagccaccctttccacattttgtgcagttttagtgaactataaatcactgacttcttcaggcctaaaagagaaaagatgagaaagtaagaagatggaggcttgttgagtggatgctcagagtttcagtgacattctgagcagacttgtctttggaggagggcagtgaggggctgacccgtggctctaggagaccagggagctgaaggtgattaaaggtcactgtgatcaatgtagggggaaatgattctgatttcggcattttccgatttagggctatggatgccaacggttcctaagttattgggataagtgatccttttgagttatgaacatattggcagcctctgaatttagctctttcaaaaaggtaggacaaggataagactctgtatgccactgggtccccgttctctcaggcctaaattccaaccccacctcactgtctctatgtcactgtgaaaggcacctgtctgactatgacaaatgctgttcccatcactttctgcctcgttgacttggaatccctgtttggatttcttctctaggaagtgcttccctggacccacagggtggccccacagcatctgtgctcactcaacacactgtgcagtacgtgtgggccgattcacccacgcctctgcctggactgggagcttcctgaggacagggaccttgccctgttcacctaggtggccctgtcacctagtacaggacccagaacacagcaggtgctctgtgaaagcttttgaaatgacaagacaaatgtgcctcattcggagagctggccccctagcacccccatctacttagtcaggagtgtgtgatgaaactggagaaaggctctccgggggcttaggggaaagaagaaaaagggaataaaataaatgggtgttatttgtcagatctaagagtatcctatctgtggatgcgattatggactcaacttcctttgtgttgagggtgggatcattcagtttgtgtttcagggtgtggcccaaagatatgaacagtctttttcactgtgagacacaaactgtgatctgtgctatgagtgtaaagtgcacacccctggcagtgcactttggtgagcatgccgacaaggtaacaggtttcgctctggacatgcctagcactggggtttgagtgatggcttgaaaatatctggccctgttacctgtaaactgcttagtccacttagagccttggaaaagaccactgcagacagtggcaggggagcagtaaaatcattaatgaatacttccagacactctggcttcgtttgtctaccagctgactacttgcaaaccaacataacctagtcaacaaactcagagttcctttccctgcctccaccccttttaattttctccctggagcaaccactctggtaaaccccacccacttcagcattgagactagaagcttattatataaggtggtttttaaaattccagccagaaccaaccaaaagaccaagccgaatacaggtagttatacatggaaaggttcatatagcaaccccagggcactgagtcacagctagaggaggatgcatgggccatgataattcccagctcaacttcaaaaagcagttcctggatcttaaacatttaaggtaaatacataaagtagaagagtgtcaccatgtagccattttttttttttgttgctgctagtggacagaaatctcccttgactaaaacattctccctttcatggttctgccagtgagacattttcagaaagactgcagcagggaaatctgttagaaagagcactagaatcggagtcaagagacctggactctagttccaggtgggccacaaactaacagtggcctttccctgggcctcaatttccttatctgtaaaatgactgggttggaatagatgaggggttctctaacaaggggtccacagattaagtctgagtgtctgtgaactccctaacactgcaggaaaatctactgtgtgtgtgcgtaggtgcacttctgtgcagggcgtccagagttctagtcagattttcacagggatcctggacttgcaaaaggctaagaaccaacagatcagaatgaagagtcttttctgccttaatattataatttcaacagaggtggagaacttaaatttcatgattttggaataggcaaaaattttctaaacaggacacaaaaaactgctaaacatatagaaaacaaaatggataaactggactacatgaaattatgaacttcttttcaccaaaagacaccattaagagagtgaaatgacatggcttacagccataatcccaacacttagggaggccgaggcgggcagaccatgaggtcaggagatcaagaccaacctggccaacatggtgaaaccccgtctctactaaaaatacaaaaaattagccaggcgtggtggcatgtgcctgtagtcccagctacttaggaggctgggacaggggaatcgcttgagcccgggaagcggaggttgcaatgagccgagatcacgccactgcactccagcctggccacagagcaaggccccatctcaaaaaaaaaaaaaaaaaaaaaaaaagagagtgaaatgacaagccacggagtgggggattttgacatcacatgtatccaacaatggagttgtgccccgactacagagagaattcagtaagcaaaagagacaactcagtaggaaaatgagcagaagactagaatagacgcttcacaaaagagcatatccaaataaacaaatgaaaaatgctcaacttcctcagtcatgaggaaaatgtaaattaaaagatcaatatggtaccactagtcacccactagagtgcctaaaatgaaaaagacctaaacaggcattcagggaggtgctgcaacagaagctctgctagtgcaagtataaatgtggacgattgtttagcagtttctactaaagctgaacagtcacatgctttatcatccaggtattctacccctcagtacatacctgacaggaatgcatacacccacccaccaaaagacaggtacaaaaatattcacagcagcactacttctaatagtcccaagcgggaacaacccaagtatccatcaatagtagaatggatacattgcggtatattcacacagcagaatactgcactgggcagaaatgaaccactgctactcccaacacgatgaatctccctatgttataaatgaacagggaaaggcacaaaagaggacatgcttatacatggttaaaaaatgggtaaaacagaaccgtggcactgggagtcaggctggagcttactctcggagaagcaatgcctgtgacgggcatgaggggtactggggactggaatgactgtatttctttacctgggcactaggtctatgaggtgttccctttgtggaaattcatcagatttatgatttttgcacttttctatctatatggagatatttcctactaccagaaaatttagaatctttcatttatttggtcacacatagaacaaatatttattgagcacctgtataagcaagacactgaactagttgctagggatactggtacagataacagctatggtctctgccctcacagagtccacaatccatagacttctacttggtctacactaagcttactttcttcaatttttttttttttttttttactctgtcgcccaggttggagtgcagtggcataatcaaagctcactggagcctcgatcttctgggctcaagagatcctctctcctcatcttcctgagtagctggggctacaggtacatgccaccacgcccggctaattttattttatttttgtagagatggggtcttgctttgttgcccaggctggtcttgaacccttggcctcaagccatcctcccaccttagcctcccaaagtgctaggattacaggtgtgagcctctgtgcccagattacattaagcttactctttctacaggaaaggatgatgatttaggaattctgctcactccttccccagtggataaaaatgcaacatctctttagatgcattccctgtagagagatccttatttacctaaagctagtcattatgaattctggttagaatctaaagtcaggattttgttttagaagcatgcagaaagctatgtcactatatggctccttaggtttctcttctgatttccagcttgtttcacatgacctacagcgaagttaatacacacgtaagactatgaactccccgtgtgatcttaaaacagatgggctactgacagacaaactctccaggaaacaatgtgaggtagaaatatggctaggctgtgaaagatctctatctttccataatcttacgtttcagacctttgataaaattagtatccccaaaacatccttccagttcatttccaaccataagcagatatatcgacaaagaaaatctcttctgaggcaaaagtacaacttattttaagaactcacaggcttaagtgataagcaaatcagcaacagagcaccagtgttcttctaatttaaatatatagataccaacaaatggaagaaatgcttcagttttaagaaatcagaagcagaggataatgactaatccattctactgtgttcccggaaaaggctggtaaggatcaactgaggcatgccttttaggagcaagactgaacctgtcttgttaatttagtttagttgaatcttttgaagctagagaggtaaacaggtatttgtccccagagttaattctgattgaccacaaagtcaggtgggaaaaaataggatttaaaaattaaactcatcatcctcgcccaacctccccctctgctcagggaatgaatggctctactgcttcccaggccaaaaacctgggagttagttctgactcctccttcatgtcccatatccctttagtcaccaagacccagtcgttcccttctaaacacggcaaatctttcctgtctgaactgcaatgacctgagttcaggctgctgtaactcctcagctgactggctgtagccatatctatttggtctccctcgcaataggtttactgcccttccatttgatctctatgctctaactacggtagtctttcggcagtcctatggtgacttccctctgccctcaaaagaaaccctgaactccttaacatggcttttaaagtctttgtttggcccctgcttatctctccatctgatcactaaactcccccatttctcatctacctattcccacaccagagtactcagacagttccccttctctccactcgcgttagaaactttataaaaggctgctgctcgaatatgcagttgcttagctggtcttttgttgccagtttgagatgtgaggtcatctgctgctaccatgaaaggaagagcaggcaaattttaggaggctaaatagtcttttggtactcctaagccagctggcttcagttgctgatctgatgagaatgatgttattctactagcagcacagtctaagggaaattaaaacgatttgctaaataatcaactcccaggctaaaggaaaaggaaaacagtgtttggttttggaagcaattctctaatcacatttgaacatgagtgtatgtgatggtcagggaatttcaagggaactaataaagacaaagcatcagtgagactgcattgaggacatactgccatgttatccaacagtgtttactaggaagggcagtcctccgagctggttatagatgcctggcttccatcttttgtaggagtagagtgaaatttagatctacattcatctaaatttataaagcacctctggataacaccctggacgctctcatgtaagcctcagaacaccttgtgagttgggtattagtattcccaccacctcacagaagagagaataacataccatagtcatagagtgaagaaatgaataattcagaaccccaaaaccctatcctctgaccccaagcttagctccttcactaagcggattcccggaatttaactgaatttgacctttgtattggctggctaaggggaagaccaaatcttcctttttatcccatttatgagtaggaggttgcacaggggaggaggggtaatggctacaaaagaataaaaagtaaaccaaatatgctagggttttctcatcctacagatgacatacgagctggctgaaaaactgaacagaggcagaacttgagaaattttggggagaaggacctaaaaaagtaaggcagaacaacaacagctatgatgacaacaaaaggactcataaagaacaaggtggatctcagctcaaaagctccttcagctgataaacaacttcagtaaagtctcaggatacaaaaatcaatgtgcaaaaatcaccagcattccaatacaacaacaacagtcaagccaagagccaattaagaacgcaaccccattcacaactgccataaaaaggaatacatctaaccagggaggtgaaagatctctacaaggagaactacaaaacactgctcaaagaaatcagagatgacacaaacaaatggaaaactttcccatgttcatagatagaaagaaccaatactgttaaaatggtcatagtgcctaaagcaatttatatattcaaggctattcctattaaactaccaatgacattcttcacagaactagaaaaaaactattttaaaattcatatggaaccaaaagagcccgaatagccaaggcaacactaagcaaaaagaacaaagctggaggcctcatgctacccgacttcaaactataaatacagggctacagtaaccaaaacagcatggtgctggtacaaaaacagacacatagaccaatggaacagaacagagaacccggaaataaggctgcacacctacaactatctgatctttgacaaagtaggcagaaacaagcaatggggaaagaactccctattcaataaatggtgctgggaaaactggttagccatatgctgaagatcgaaactggacccttcctcataccatatacaaaaattaagtcaagatggattaaagacttaattgcaaagctataaaaaccctggaagacaacttaggcaataccattctggacataagaatgggcaaacatttcctgacaaagatgccaaaagcaattacaacaaaagcaaaaattttaaatgggatctaattaaactaaagagcttctgcgcagcaaaagaacaagacagtgaagaacagagtgaacagacaacctaggaaatgggagaaaattttgcaaactaggcatctgacaaaggctttatgtccagcatctataaagaacctaaacaaatttacaagaaaaaaaacaaacagccccattacaaagtgggcaaaggacatgaacagacacttttcaaaggaagacatacatgcagccaacaatcaaaggaaaaaaagctcaacatgactgactgataattagaggaatgcaaatcaaaatcacaatgagattccatctcacagcagtcagaatggttgtcattaagtcaagaaacaacagaagctggtgaggttgtggagaaaaaggaacatttatacactgctggcaggggtgtaaattagttcaaccactgtggaagacaatgtgccgattcctcaaaaacctaaaaagagaactgccatttgacccagcaagcctattactggagtacatacccaaaggaatataattcattatatcacaaggacacatgcatatgtatactcattgcagcattattcacaatagcaaagacatggaatcaacctaaatgcccatcaatcgtagactgcataaagaaaacgtggtacatatacaccatggaatactatgcagccataataaaaaagagaccatgtcctttgcagggatatagatggagctggaggccattatcctcagcaaactaacacagcaacagaaaaccaaatgctgcatattctcacttacaagtaggagttaaatgatgagaacacacaggacacatagaagggaacaacagacactggggcatactgatgggtgaaggatgggaggggtgagaggatcaggaaaaataactaatgggttctaactaggcttaataaataggtgacaaaataatctgtgtaacaaacttctatggcacaagtttacctgcataacaaacttgcacatgtaccccaaacttaaaataaaagttaaaaaaaaagaacaaggtggagaaggatagaggttctgaaacttactgtgaggatgaggaaagagaaacaggcaaaccagtcactcggtgcctgtcactgttagtttactccagctggagacctgggccaggggctaacactattcaaatatgacattgtaaagaggcttgttttaaagagaggtcaggaaacttttaggtaatgataccaaaagaagaaaaaccagacacaatgctagatgccttaatatatcttaaaatataatctcctggccaggtgcagtggcttaaccctataattccagcactttgggaggctgaggtgggaggatcacttgagcccaggagtttgaaacaagcctgggcaacatagtgggactccatctctacaaaaaacaaaaacaaaacaaaaaaacagccaggtgtggtattgcatcctttagacccaggtacttgggaggctaaagtgggaggatcacatcattgtactctagcctgggctagaacctgtctccaaaaaaacaaaacaaaaacaaaaaaacaaacgtaaaatacaccattgcactctggcctgagctagaacctgtctccaaaaaaacaaaacccaaaacaaacaaaaaaccaaacataatcttcacaacctggtgaggcaggcataattattcctatgaagttaaaactcagaaaaattaggtaacttgcccaagtcacactggttaggttgtaatttgagctctagtctctgcggctcacaaacctctgccctcagcactatgctaggaaacctttgtcacagcccttggccataataaacagagcagccagagcataaggccatttaacccacagaatctgaaggggtgctcatcactttccatgctttatgtcacctcagtgtgaggtaacatacattctgtcactctggacttccacaatgcaatgtggcatcattagaagtgaagaaaaggctgtgcaggaagagaggttaaaatgtttagaaaaatttatttaaggaaataatcaatgaaagcttcccaagtctagcaagtgtgtcagatatccagatacaagagacccaatgacccccaggtgaatacactgcaaaaaggacttcaacatagcatactataatcagaaggtctaaagtgaaagtaaaagaaacaattttaaaataagcaagagaaaagcatctagtcacccataaaggaaacctcatcagactaacagtggacttttcagcagaaaccttaaaggccagaagagaatgggatagcatttttaaagtgctgaaggaaaaaaaccctgtcacccaagaattttatatcctgctagaataagcttcataaatgaaagagactagtctttcctagacaaatactaatggaatctgtcaccactagaccagccctataggaaatgctcaaaggagtcttaaacatggaaacaaaacgctgatattcaccatcacaaaaatacccagaaatataaaactcacagttcttataaaacaatctcacaaaagaggaaaagaaagaaatcaaattacagaatttcatcaaaacacaaggacaaaaagagaaaaagaaagaaaacaaagaatttataaaataacttgaaaataaccatgtgacagaaacaaaacctcacatatcaatattaactttaaatgtaaatgcattaaatgcttcatttaaaagatacagactggcagaatggattaaaaaaacataatccacctatatgctacctacaagaaactcaccttacctgtgaagacacaaatagactgaaagtaaaggggtggaaaaagatattccatccaaaaagaaatcaaaaggagaactatatatatgtcaaataaaacagactctaaatcaaaaacagttaaaaaaaaaaaaaaagactaagaaggtcattatataatgataaagggatcagttcaccaaaagggtacagcaaatcctaaatatatatgcacccaacataggaccacccaaattcacaaaacaaatattactagctctaaagaaagagatagatagcaacacaataacagtgggggacttcgacattctactcacagcactatacagaccatcgaggcaaaaaattaacaaagaaacactggactttagaccaaatagacttaacagacatttacagaacattcttcccaacatctacagaatatatgttcttttcatcagcacataaaacattcttcaagcatgggctacatagggagactttgtctctacaaaaaataagattaaaaataaatgtagccaggcatggtggtatgtgcctgtggtcccagctactcaggaggctgaggtgagaggactgcttaaccttaggaggtcaaggctacagtaagccatgatcacaccactgcactccaccctgggcaacagagcaagaccctgtctcaagaaagaaaaaaaaaaaaaaggaagaagaaacattcttaaagatagatcacacatcacacattaggctacaaaacaagtcttaacaaattttaaaaaatcaaaatcaagtatcttctcagacaatagtagaataaagctagaaatcaacataagaggaacttcagaaatgatacaagtacatggaaattaaacagcatgcccctaaataatcacttaatcactgggttaatgaagatttttttcccctgagacccctgagacagggtcttactgtgtcacccaggctgtggtgtaatcatggctcaccgtagcctcaaactcctttggctcaagtgagactcctgcctcagcctcctgagtagctgggactacaggcacataccaccatgcacagctgcacagctaatttttttgtagaaatggggtttttccacgttgcccaggctggtttcaaactcctaggctcaagcaatccacccacctcagactcccaaagtgctgggattacaggcatgagccaccatgcctgaccttaaaaatttttggaaacaaataaaaatgaaaacacaacataccaaagcctgtgggatgcagcaaaagcagtgctaagagggcattactaatgtttacagcattacatgtctacataaaaaagtaggaagatcacaaattaacaacctaatgccatacctcaaggcattgaaaaatataacgaaaactataacaagaaaaaaaataactaaactcaaagttagcagaagaaaagaaataacaaagatcagagcagaactaaataaaatggagaccaaaaaacaatacaaagtatcaacaaaatgaaaagttgggactaggtgcagtggctcatgcctgtaatccctgcactttgggaggctgaggctggcggatcgagattctaggagttcaagaccagccagggcaatgtggcaaaatctcaccttgacaaaaaatacaaaagttagccaggcatggtagtgtgcactgtagtcccacctacttgaaaggctgaggtgggaggattgcttaagcctgggaggcaaatattctagtaagccatgattgtgccactgcaccgtgtagcctgagtgatagagccagaccctgactcaaaaaacaaaaaagaaaagttggttctttgaaagatacacaaaattgataaaccactagctaagactaagaagacaagagagatacaaataaacaagatacaagacaagaagagatacaaataaacacaatcagaaatgaaaaaggagacattacaactgataccacagacatacagaagatcatcagagactattataaacaactagatgtccacaaactagaaaacccagaggaaactgataaattcatggaaacataatcttcaagattgaaccaggaagaaacagagtatctgaaaagatcagtaatgtagtagcaagactgaatcactaataaaaatctcccaagaacaaaaagaagcccaggacctgatggagtcacagctgaactctaccaaacacagaaagaatgaataccaatccttctgaaactattctaaaaagatcaaggagggaattctccctaactcattctatgaggccgctatcaccttggtaccaaacagacaaggacacaacaccaccaaaaaagaaaattatagaccaatatccctgatgaacacagacacaaaaatcctcaacaaaatactagcaaattaaatccaacagcacatcaaaaagagaatacattatgatcaggtgggatttatcccagggatgcaaggatggttcaatatatacaaatcaataaatgtgatacatcacataaacagaattaaggacaaaaaccacatgattgtctaaatagatgcagaaaaagcattcaatagcctgggcacagtgacttatacctgtaatcccagcactttgggaggccaaggtgggcagatcacttgagatcaggaattcaaggccagcctggccaacatggtgaaactccgattttactaaaaatacaaaaattagccaggcatggtgatgcatgcctgtagtcccagctactcgggaggctgaggcagtagaattgcttgaacccaggaggcagaggttgctgcgagctgagattgcaccactgcactctagcctgggtgacagagattccgtctccagctactcaggaggctgaagggggagaatcgcttgaaaccaggaggtggaggttgcagtgaggtgagatcgcgccactatactccagcctgagcaacagagtgaggcagttgctctgtctcacaaaaaaaaacaaaaaacaaaaaacagatgttggtgcagatgtggagaaaagggaatgcttatacactgttgaagggaatctaaattagtatagcctttatgggaaacagtatggagatttcttaaagacctaaaaatagaattaacctttgatctagcaatcccattactatgtatacatccaaaaggaaagaaatcattatatcaaaaacaaaaacaaaaaaaaccactcgtatgtttactgcagcactagtcacaatagcaatgatatggaattaaccaaagtgtccatcaatggaggactggataacaaaaatgtgtatatatctacatctatatctcaccttgaatactacttagccataacaaagaatgaaataatgtcttttgcagcaagatggatagaactggaggccacgtgtataagtgaaataactcagaaacagaaattcaagtatcacatgttctcactttaagtgggagctaaacaatgtgtatgcatgagcatacagaatagaatgacactggtgactataaaaagtgtgagggtgggaggagatgagggttggaaaattacctattgggtacaatattcactatttgggtgatgatgggtacactaaaagcccagacttcaccatgtaagaaaaatgcacttgtattccttaaacgttttaaaaattaaaaagaaaaaaaagtgaaggggaagcaagcagtaagcactcaggggaagcagcatcagcactccagggccacaaggacagctgagctgtgggttctgtgatcaactgccctctgctggtgagtagaaataatgagtggaaagaggaccaaaggctcatttcaggttgaaggtgtcaagaagatctttttcagccttttattagagaaaaattcaaacttaaataacagacagaagagtataaaacagccccatgcatctttacctagctttgacaatatatcagctcatggccaatcttgtgtcatctacccattacccactgccctctgccatgttttattttgaagcaaatcccagacaacatatcattgcatctggaattattttagtatgcatctctaaaagaaagggaattttttaaaaagctccataacaccaccattgtcacaactgaaaaataattaacaataattctaataattccaataattccttatagcatgggacgccaacaacaaaacaaatcattaagcctcacccaaggaggatcatggcaagggaaaggcaatcatgcaaaattcagattaacagcatgaatcacccaaacaaacaaaagtacctcatcttcagtcttgccagagtaaactagcaggaacatagattaaatgaatatcttaactggaaatgcaaagccatgcacccaaatggtaggaaaatctttagttcagcagatgtgacacaagtgctactaagtctttgttgaaacttttatacaatgtttttattattataattttttttttttttgagacagggtctcactctgtcacccagactgaagtgcagtggtgcgttcttagctcaatgccgcctcgacttcctgggctcaggactacgggcgcgcaccaccacgcccagcccttttttttttttttttttttttttttttgagacgaagtctcactctcgcccaggccagaggcagtggcacaatcttggctcactgcaacttccgcctcccaggttcaagcaattctcctgcctcagccgctcaaaggtgggactacaggcatgtgccaccacgcccagctaattttttgtattttagtagagacggggtttcaccatgttgcccaggctggtctcaaacccctgagctcgggcaatctgcctgtctcggcctcccaaagtactaggattacaggcatgagtcaccacatccagcctattttttctatttttttagagacagggttccaccatgttgcccaggctgatctcaaactccaggactcaagtgatcctcctgccttggcctcccaaagtgctgggattataggtgtgagccaccgcatctggcctatttttgttatttttaaagagacagggtcttgctgtgttgcccagactggtcttgaactcttgagcccaagcaatcctcccgccctggcctcccaaagtgctgggattataagtgtgagccaccatgcctggccttgttgaatctttccagtgattcaggagggcaacacggtccttgagggccaaatgctcagaggagtatccaagcagctgggctatgagacactgagaggtgtgaccataccagctccccagcaatctcaaacccagggattagaattaggttgaaagatcactcccctttttgggctacctctgtgctatttctccctctcttgcaaatttctgttagcatgtctcttttcccttctaaattatacgcctctgcaagtcagtatagcatttgatatggtttggctctgtgttcccacccaaatcttaccctgaattgtaataatccccacgtcgtgggagggacctggtgggaggtaattgaatcacgaaggcaggtctttcctgtgctgttttcataatagtgaataagtgttacgagatctgatggttctataaaagggagctcccctgcacatgctctcttgcctgccgccatgtaagacatgattttgctcctcattcaccttccgccatgattctgagacacccccagccatgtggaactgctaatcaattaaacctctttcctttataaattacccagtctgaggtatgtctttattagcagcatgagaacagactaacgcagcgttgtgttcacttttgtatcccgagcagctggcacatgagagatgctcaatggatgcttgcatgaagaaagcctgaactagaaaagtctatcacttgatgatgccaaatgttggaaaaaatgggaagaaaagagtattctcctactctgcttgtgggacgatgaactgatacagccactttgtcctccaaagagatgtcaaatatttaggccataaaacaagaataggatgcaaaaaacaggagcattcagagaacagcaagaaaagagagagttcctggaaattataaacactcaacagaagggttggaagctaaagttgagaaattcgagaaaatcttccaaagcagagcaaaagaaaaacagataaaaaatagaagacaaaagaaagaaaaccaaagactaatctagggggtgcaatatctgaataaaaggagttccagaaagagaacagagaaaacagatgggacaaaattaaagaaaaaatttaaaacatttttcttatatgcttatattctgagtttcccaacagaaagggcaatgaattcccggtaaaacagataaaacagataaaaacagactcacatcaaagcacatcactgagagaattcagagcactggggaaaaataaagacctaacatgcttccagaaataacatacacaaaggattaagaatcagattggctttagacatagacaacaatcctagaagtaaaagataaatgcagcaatgatctcaaaattttaaaggaaagtgatttctaatcaatacccagcctaagtattaactatgggtgaagacagacaaaaaagactttcagacatacgtggtctccaaatgtgccttccatgttccccttctcaggaaattactggaaaatgtgcttcaccaaaatgagagtgtgcaccaagcaagtgaaagacatgagatacagtaaatgggggaccccctagaggggacagcgaagacactctccatgagagaagaacattatgcagggaaggaaaggtgtactctgtggctcaccataccatcaaactgaaaactaattagccaaaaccaccagacaactatattaggaggacagagggatgggagggtgcgtacatttgatgagggtgggtgccagagttgacttctaacctcccatagagagaagtcaatagatgatacctaaagttgaaacgtagagaaggagcaacgaaaacttaccatttagagaaatggcagtaacaacaaaaataacccactaagacagatggaagcagttgtctcagagaaggggaagaggagggggagcacagatgctgctgtttttgcaatcctatgcatctgtaactttgataaataaaacaatatgagggaaaaaccctgcacacaggaagtgtctcagaaaattcagaagggcagtaaagcttccaacagcactgccaatggtctgacattgttcgaccaccaggttctgctgctgttatgcctgtttgtaccttactgcaatatcccagtttatggccatcaaagctcagcatttcacaagcacctaaaagatacaaagctttacactgtaaccaagagtgtggaagccactcagtcagcaggtatgttacacacggatttccaaagctcttaccagcagtaaaaatgcctttcgtgctctgtcttatactagacggtctcacgattgctgaaagccctgcgagaaaaaaaccaaaaaggagaccaaaaaaacccaaaacagatgttagtcatcttaacagttttaaaacttgaaactaaatattctttctagtcagccaatcaaaccaccaaatctatctctgtcctgctgtcacagtgacaatgaaaagggcagtgggattgagggccaggagaccagagcagccagccgtggcgccacccggctgtgtgagtccaagccgatgaccgaacagctctgtgcctcttccccttaaaacaaggggatgggttagctgaccctcaaagggcattttatgacttaaatctgcttgagatttctggttctcaattccataacatgaaaagataaaaaccaaatgattacatctacgagaaaaactttcattctgaaaacacacatacggattccacagtgaggaacaagtttcactcacctcaaagagacggcccagatcacactgttgccaggatcatgttcaaacaaacaacagtgtgcctcgtacagagctatcttcaggatggggagctggtgacctaaacacacactctgcaaacctagtgcaggcccaggaggagagtgggcgtggagcgcctgctgcagctcatccactgcagtgcgatggtctttgcaaagcattactggaaattctatctggcacgcggaggagctcagtaaatatttactgaatgaaaacaggagaatgcactcaattgacagagggactcattctcaatttcataaatatttcttgattgactgatctcataaattacctttagcaccttaaagggaagttagtctctgaagataaggttcaggctcttttttttgtttgttttttaagagatacgggctgctctatcaccaagcctggagtgtagtggtgcgatcctagctcattgcagcctccaactgctcaagcgatcctcccacctcagactcccaagttagctgagattataggcatgtgccaccatgcccagctacttttgtaatttttgcagagacagggtcttgctctgttgcccaagctggtctcaaactcctggcctcaagtgattctccctcctggacttcctaaagtgttgggagtacaggcgtgagccactgcacctggcctgggttcagagttttggataaacatcagggcagtgctggggaaaatgctgtggaacgtgggccatgtctgagggaatgtactcaacaatgtatgagacacatcaaatggagttgattgaggaaagctgtgttctcgatgttataaaagcacaaaaaaatgccaccaatctcttttctcagaccaccacaaaacacagacacatcttttaaataaattctagaagttgtgctctaggaaccaaaagaaacattgtttctccctttgacagtgatttaggatccaggaatttaaaaacagaagtattttcaccatcttacttcaaacaaataaaaatgcagatttagaaaaccctcaaatttttagtgctttcttcttctgagaggcaatctctctatctcgctaaacaaaaaggaagaaataatacattccaatcacaaacaaagtctgcttttccccatggctggcatttcctcaacatcaaattcataaacgtacctagtcgcaccacatctccacagtcgggatcatgagccacttggaataaagtttcttccacatctctgttttttccaggagggtccataatatgatttatctgttgctgtaaggttttgggcaatgtcatcagctgagtgaactgtccttctgggcttttatctatctgaagggaggaaaaaaaagacgacgtctatggaagtgctttaaatcctacaaatactccaaaactcagggcttctctttaaaaatcacacaaacatatatgcacccacacccctggcgaggcagcaagctaaggaaactctctttttctgaaactgaatgggtaagtgttcaggagtctaagtcccttcaaaaaggacaattcttgtcctataatattccatttctacctgagaaaagaatagaagccactctcaaggatcaatttctgacttttggttttaaaatttatatttgtcttaaatccagcagtcaaaggaagtggtgctgcagttgacactcgtggaggccgcgtcaaatccaggcactgagatgacccctcccatttcaaacacagggagactggcgtgccctgatcacatcaccaatgagagtaagtgggatctgaattgtgtctcctgcctgtagggccttttagtatgctgtatttcacaaactgtaggaatacactgatgacagaaactaatcttacttacttttaatccccagcacacagtaggtactcaaaaaacaataaggaaatgagtaactgaatcaatacaacttagttgtcctaaagctactatgccagcggcttcggttcccaaagtattctaaaacatactaaggtgctgaagataaatatataaataaaacatgtaaaactatgtgtcagactttactcagaaacccttgaatcaaaagttagccacagagctgaggccagacctagctttcctaactccaagtttcatacactgtgcctcgtggaatgaatttttaaaaatcttgtaaacattgatttcctgccaagtgcagaaccagtaacactgccctcaacagcccatcacattatttcccaaggaagaatctgtcttgtatccttttaacaaatatttaggttttaacttcaactaagagaagagtaagaaaaaatcagatcaatgtattacattttaggcttagagtttacagataggacgaactttcttaataattagaatccactcattctaccattttttaaattgaataaatatttattaagtacataccaaatgggccaggagcacaggttcacacctgtaatcccaacagtttgggaggctgaggcaggagaattgcttgagcacaaaaattcaacatcagccctagcaaaagagtgagatatccggctctacgaaaaaaaaaaagaaaacaaaaaaaagccagacatggtggtgcaagcctacagttctgtctacttgggaggctgaggtgggaggatcacttgagcctgggaagttgaggctacgatgagtggtgattgtgccactgcactacagcctgggtgacaagaccaagatggtatcaaaaaaaacaaaaaagtatataccaaatacctgaattttctagttttgtctataaactctatgaagagaaggagaaaaatgttattatttaatggctccataaagctagaggggtaaatatttaggtttttatctaaatatttgatatttatcactaggatggttctaaattcacaggccccatcctctacttagctttggctacaaaaatgacaacaaatttgagtatttatgtaaaataatcttagaaatgacatttatggacttatgttttgaggccacatattgggattagttagaataaacttatatttaagttatgctttacctatgaagcttccaacggcttgagtgacatataaaaaaattagaaagtacttatctgccactgctttctcttgaggaaaataatgcactggaattttcacttgaaagcatgagtgtaaagataaaataccaggtgacatgatttaaaaatttggtaaattctcattttccttacactaactctcattaaaataacgaaagtgaaagcattcagctaaactgtgaaagtcaaattgcattttaaaagcggacatggatacaattattatatgtcaacttaagaaaaaagcagatatggaaaaaactttatatgattccatgcatatgaactgtccagaacagaaaaattacagagacagaagtggattagtggttgcctgggtgaggggagagctggggacggctaaagggtatggagtgacagaaatattctaaaattacattgtggtgatggctgtgcagctctgtgactatactataaacactagcttttatggtgtatgaggtattcatcaataaagctaatattttgttattattatttttgagacagagtctcgctctgttgcccaggctggagtgcagtggcgcgatctcagctcgctgcaacctccatctcctaggctcaagtgattctcatgcctcagcctcccgagtagctgggattacaggcgcacaccaccatgcctggctaatttttgtatttttagtagagatggggtttcaccatgttggccaggctagttttgaactcctggcctcaactgatccacccacctcagcctcccaaagtgctgggattaaaggcatgaagctgccattctctccccctggccaaaagagtaaagaaaaaataaaaccatatcccaggacgaatggcagagatgagcaccacctgtagacctaaaagatgcaagggtaaggcagataattttatgtgtcaactcagagcagtggcacagcctgaagacactgtcctgcgaggatgagttgtgctacacatcctgaatcaatcaccattacgctgtactatattcccaactggcagaagacatgggcctggggaccaagggtagaaagagaagtgaccttgcttatcgtcattcccagggacccacttgggaacactttgcttcctatcactacagctctagatctgtgggtctagaggtcccagttcccagagaagggatgcttctaccagaggacatagtaagcatcccattaactttaagttacgactgccacccaattaatttagaatcccatgccgtaagtccagcagacaaggcaatgagtcactacactggcagaagcaatcggccctggtcatcaggagctggggtgctgatacacgtctcttagagtaccccttgcccaattttgatggttagtggacaagtgcggtagccagggtcctccagactcctccgagatgagggtctgggccaccctgtctagataagcagaagtgatagatgagggtgaagggaatctggaggagtagcagagatgggagaagatgagtctcagttgcagcctcaaggccagatacagcactgggagctgtagctcagtcccccagtcttattcttgtaagtttcctgggaaaagaaactgatgcgaaactagatcatgcaggcttttataggccatagggaggattctggatacctttatttttatagttagagaaaattcctagcccttttcccttgttcagtttctagaaagttggtagacagacacattatacttccctgtcctctagccagagaatagaagatctctggagaaattctacagacactgatatttgagatcctccaataaaacagctaggtccttggccaggtgcagtggctcacaccagtaatcccagcactttgggaggctgaagcgggcagattacttgaggtcaggagttcaagactagcttggccaatatggtgaaacctcatctctactaaaaatacaaaaattagctgggtgtgatggtgcatgcctgtagttccagctatttgggaggctgaggcacaagaatcgcttgaacttgggaggcggaggttgcagtgagccgagattgcgccactgcactccagcctgggcaacaaagaaagactccatctcaaaaaaacaaaacaaaacaaaatagctaggtctttgcctcataatcctatagtcaagcccaccagttgacaagcctgatatatcacaaagaacttccagcctgtattttagtgcctcattctttaaaaacaggccagagccaggaacggtggctcttgcctgtaatcccagtactttgggaggccaaggcaggaggatcgcttgagcccaggagttcgagaccagccagggccaacaaagtgggaccctgtctctacaaaaaaaaatttaatgtctcagatcatatgggtacaaatatatgtgtgtgtgtgtgtgtgtgtgtgtgtgtatgtatgtatatatatgtatatatgtatatatgtgtatatatgtatatatgtgtgtatatatgtatatatgtgtgtatatatgtgtatatatatgtatatatacatatacacacatacacacacacctgtgtatacacacacacacacacacacacacacacataaaaaaatcagctgggcatagtggcatgggcctgtagtcgcagctcctcaagaggctgaggtgagaggatcacttgagtgcaagagttcaaggctgcagtgagctatgatcatgccactatactgtagcctaggtgacagagtgaaatcccctctcaaattgattaattcattaattaatttaaaaaatcaggccaggaaggaaactcagacatttgaaaaaagcttctaacataacagactagagtaaaaacagacaagaggaactaagagaaagaaaacagtgtgagagaacaagacaaaatcttcaaaagttataataaagatcattaaagagattaggagaaaataatgcatccataatacaagaataggaagctataagaaagaacattttgggaaaattaaaaatttagtagaagtgttagaaaaccaatcagaaatattctcccataaagctaaatttaataaacgaagagacgagagagagagagagagagaaaggaaaaaaggttaaaccaggaggtctagcaaccacctaacaggaatcccaggaagaacaaactaagaaaatgggtatgaagaaataattacagaaataataaaaaaaattccttagaattgaagcttataaaattccagatagaaaaggcccactgaggctgggcgctgtggctcacaccagttaacccaatactttggaagaccaaggtgggaggatggcttgagcccaggagtttgagaccagcctgggcaatatggtgaaactgtttctactaaaaacacaaaaaccagccaggcgtggtggcgcgtgcctgtagtcccagtagttactcaggaggttgaggtgggagagtcacttgagcttgggagtttgaggtcgcagtgagctgggattacgcctctgcactctagccagggcaactgagcaaggccctgtcaaaaaagagaaagaaagaaaagaaagaaagaaagagcccaccaagtgactgaataatgaatggaaaacagacataaataaagaaggaaaattatctccaccctagaatttgatatctagccaatactatctatcaaagggagggtagaattttcagaggtatatagtctcaaaaacttgcctccctcacaccctttaagaaggtaataaaagacaaacttcactaatatcagagtataaaccgtggaagaggaaaatgcaagacccacaaaaccaaaaactagcacgggggaggcaaagggaattctcagggtgataatgaagggaaggtggaggagtgcggctgtgcagtgagctagaaaacaaccagttgagaaaggaacagggcagggggctccaggaaaaacattcctgtgagaaacaagaaacagaaaatacccaataaatctgtctataatgggaagagttttacggatctgtcaagagtttgaggatgactgacctaagcaactgaaaaaataagacaactattaactccaggagaaacaaagttgtacaggaaaaggaacttcataatgccacagctcatcaataaagaaaaggctgtcacaataaaataaacattgaatattaagctaacaaaaaatatgaagtaactttatgtgaagcatgagggcgtgaggtagaaggggaagagaatgtgtgtgctaagtgcatgtgtgtgagtgtgtaattggtataagaattgatggggtagtgtaagacggtaaaaaaaatccccttcttccaggatggcaaaaataaagtgtaagattgaaaaaaaatcaagaaataatagtcgaagcatattatttagaacatggaggtgaatatcagaagaatcagctatagagacgaaagcagctgcctctggtaagcagggctgagaatgtgggaacgtatgcagcacggaactgctctttttgttataaacttgaggtatcatttggcttttaaatcatgtacatgcataaaacaaaaaacctcaacctgaaccaaatgtggcaaaatctgttaaactgagtggtgggtattctcgcatttcatatgtcactctctattcttttcttgttttaaaataattcctatttttttaaattccctttttagctctagaaattccattaatctattactcattacaatgttagttgcccctactatgtggatggagaagagcataaatgaagaaaaatacagtgttctttacattaaaggaaaaaaaaaaaaacctttggcccggcctggtttttattttcaaacaaacacttaatattaattgaaacaataccttgataagaaagttttatttgatatatcaaaaagaaaaattcccagacataataaacaaaacaagtggggaaagaagagaattttgaatatgtatgagcccattaatgtataacaaaaccaaacctcttcctatatgcatacaaacatatacaaaagtacacgtgaaaagatctggaagaacagacagcaggctgggtgcagtggctcatccctataatcccagtacttttggacgctggggcgggcagactgcttgagctcaagagtttgagaccagcctgtgcaacatggcaaaaccctgtctctacaaaaaaaatacaaaaattggccaggtgtggtggcatgcacctgtagtcccagctactcaggaggctgaggtgggaggatggcttgatcccaggctggggggtgttgaggctgcagtaagccgagatcgtgccactgcactctagcctgggaacagagtcagaccctgtccccccaaaaaaagaaaaaaaaacaacaacaaccagacaccaaactgtcagtacagttacctctggggagctaaatgggtctggggatggaatgagagtgatctaaaagtttattttcacttgttttgattggtaattgatagacatggtaataatttccaatggcaaaaaagatatacatggtcaaaacaagtccctctcccacttctgcccctagttcccttctccaaaggcagcctcttattactagtctgttaccttttagcattattccagatacacagaagcctatgtttacatacagtacttactttttaaactataaatgttctcacaccagtcatgctgttctacccctgactttcttcctgcaaatagcctttgtcttagaaacaatacaagctattttccacatacagttacctccagccagccttgctggcttttatacaccacttgaggattttcctgtagtatgctgccatagagctctcgaaagtgggctatattgggcttcacaatattcaacacttttgttttatcttctccaaccaccatccgaaagtcacctagttaaaacaaagagataaacacatcttccattaagaatccacactctcgacctatgaacgacgctccccacactgataccgcacgggttcactctggcaggatccctcatcagaacacttgcttttcctcctcaaaacctggacactttaccccaagaaatgtgagcacttgtttggaggaaaagagggtctctcaaatcacaaagccctttatgccagttaaattatagttacctagttacacaaggtaatcacaagcgagtagctaacttgttttagcttttccaatgcagaagcttctgtacctacaaagtcttgtcttatgggccaaattctgcctgtggccaatgaaggagataggagctgtgcaccatcactgtagacttgtccttgccattgcttcctcatcgttgacctgtctgtttatgagggcttttgaggcacttgatgaatataatcttatcatattttacaaaggcaaaataaggcttaaaagttctgtaagaggaggtttgcatttaagatgaaattgaaaacagatataactttttaaattgcaagtgatgagaaatgaggaatgttacatttgcctatgggatgaattgagctgaaaaacacctaattctgaaagacaaaagcatttctgaatcaaatgaaaagtgccctgccaatgccactgacaaccatcggcaagatggaggagaaaggaatgggaaagtggacacacttaagtgcatgcctactgggctaatgtgaaatcacaagaggctggacacacgcagaaccttctgagtcaagcgtggtgaaagcaatgtggctgaatcctttgttggagagggagcaaattgtcagggggagtagagaggtggcaagtgtaggcagataacccagctgctgaggaatcccctggggctaggatgacaatataatttatcatccaaactaggtcacttctgagggtgaagggatcgctataaataatcacactacgacaagtataaactgagcaaaccaggacatatggttaccctcgccaatttcttttttctggagaggggaagggatcatagaggtcattatttgccacaatggattttcctagtgcaaactgttggcttgttttagaaaaagtaaaaatacaaggaagaccaacaatatgtacttcattgagtaaggaataaaatatgctaggttttaagcttcaaaggaccaacttacactacaatttggtggaatgcaactggggactgcaagcttagaaaaacagacttccaggctgggcgcggtggctcacacctgtaatcccagcactttgggaagccgaggcaggcggatcacgaggtcaggagatccagaccatcctggctaacacagtgaaatcccgtctctactaaaaaatacaaaaaaattagccagacgtggtggcaggcgcctgtagtcccagctacttgggggggggccgcaggagaatggcgtgaacccaggaggcagagcttgcagtgagccgagatcgcgccactgcactccagcctgggtgatgaagcaagactccatctcaaaaaaaaaaaaaaaagacttctaaagagcctctggaacccgatcttggtgtacagggggtctgactgttcaggtgagtgagcagaagcgagtcccagtcctaaaaatctgctcaaatatggatgaacttgtttttgtcactattattttgaagggaaagagagttagatagttaaaacctgggatcactgctaatgaggaggttgagaaatcagtcctttcacatattgctgttgactgcataaactgctaaaattcttctggaaagcactgaagcaagaaaccccatctctggagcaagcttaaagaaataagccagaaacacagagtaagacagaaacacacaggtaacgtttaccgagcatctggtaaataccagccactgtgccaagtgtgttgtggtattgcttcatttaatacacacagctctcctctcaggtagataggattctatccccattcatacacaagggaacaaagacagtgattaagaaacttgcgtaaggtttccaggaagtaaaaatatactacatatataaaattgctcactgaagcactacttataatactgaaagcatcccaaatgtccaacaacaggggaaagaatgcactatgatggcatatggttactatcacagacagtaatcacacacaacaagatggaaagtgatcatttaatatgcagtaagaaacaaagagatacaaaagtataacaggctgggcatggtggctcacatctatagtcctagcactttgtgaggccaaggccgggggaatgtttgagctcaggagttcgagaccagcctgggcaacatagcgagactctgtctctatgtaattttttttttaagcataccaaaacaaaaaaaacttcataaaaaatgagaaaaacaagacaaagagactatataaaaatgcttatttttgctctaataaaatacatttattgtgggtttttgcatgtgtgctttaatttgctatctcatttggtcatggcaaagctccataaaataagtactattattcttaattttacagatgaggagatggacgtgcaaagacaacatgccccaggtccaactgcctctcggtattagggtagtgaaattttaggtgatgattttactctataatttccccccatttccctcacttctataatgctggcatattactttctagcattttaaaacacatttatgggatacacagatgatgacgtgacaaatgtgaatggagtggtggctgagttaacttccaactgtgtaaatccttacacgtataaaaatggattccattaatctttgaagagatgaaatgtcatcaaattctgactctaacaaggctggccctgaagtgaaagatcagtttctaaaactgttgaattctaaatatttgtgtcattccttctttctgtacattccacaaacaaaaagttcctcaattttagacagtcactttctgagagaaggatttaccattttaaaatatcaaggattatgttttacaatccaaatcttccccctaaaagaacaattgcatgccatgattaaaggacctagaaaacactccaggctctcggagaacaaggaccggggcttatttatgtctgcatccttagctccttgtgcactgcctggcacagggaacacatacatcaataaatgtgtgcagaactgaatttctctcactggtgtgcagctgaactagctcaaccgcaggggataggaagcaaatgggcttatgactcatttcttcagaacaaaatgaataacatcatgggcacagcacgaaccagcatctgatcataacaatcaatttttcttaccttgggagatttgttttcaacaaaactacagcaatggattaaaactgactgctgactttattttatgcctctagaactgccagtacaataggcatccaaaaggatttctccttgaccttgaaatgatacaaactccaaggcctgcaagccacctgtaggtggccttccctgtgattcaggcatgcagccagcagtcagggacctcattacaagtatgcagatgtgaagggctgcacagtacagcggcaaggccctggctttcaagtctggcaatgtcccagggtgactgaggtcaagttacttaaaccttctgagtccttcactgtaaaatggcttaatcacactaaccttacaaagttgctttcagatttaaggagttagggcagcagtccccaaactttctggcaccaggaagaggttttgtggaagacaatttttccatggatgtgggtccaggggacagtggtttcaggatgattcaagcacattacatttattgtgcacttcatttgttattattacattgtaatatataatgaaagaattatacaactcaccataatgtagaatcagtgggagtcctgagattattttcctgcaactagacagtccctctgggggtgatgggagacagtgacagatcaggcatttgattctcataaaaagcctgcaacctagattcctcatatatgcagttcaaataggtattgcgctcctataagaatccaacgcagctgctgatctgacaggaggcggagctcaggcagtaatgcaagtgatggagattggctgtcaatacaaatgaagctcgcccaccactcacctcccgctgtgcgtcctggttcctaacagggttcccaagggttggggaacccagagttaaggtattagagaatgctttgtaagtagtaaagcagatactacttatgatatgtatatagcatagtcgaaggatggagggtagaggaagcgctgggtcttggagataataattaccggctaacttttctccctttaaacgaattgcaagactgctgtcatttcagttcagtgaatatctgagtggctacaaagtaccaggagctgtgctaggcaatggagatccaggttgggcaaccctaatctgaacaccgaaaatgcaaaatacccccaaacctggaaaccttttgagcactggcaggacaccacaagtggaaaattccacacctgacctcatgcagtgagtcgcacatattattaaaaatatcatataaaatcactttcaggcgatgtgtatgaggtgtatatgaaacataaatgaacttcgtgtttagacctgggccgtccccaggatatctcattatatatgtgcaaacataccaaaatctgaaaaattccaaaatctaaaatacttctggccccaagtatttcagataagggatactcagcctgtccagatataggctctacctcaggcagcaaacagtatgaaaaaaagatcatttcagtgcagttttttatgtggtagtgtttaaggactgcagcccaaactggatattgatatggcaaaataatattcattttcatgactgtttttcagatataattcacataccatgtaattcatccatttaaagtaaataattcagtatttttaattctgtttacagagttgtacaatcatctctccaatctaatactagaatattccagcctccctacaagaaaccccatactcctaagtgatcactccccaactcccttcattccccatccccagcctgaatttaaacattgctgtcattttggttcagtgaatatttggctggctacaaagtaccaggagctgtgctagacaatggagatccaggttggatctaatctactttcttgccacagatttgcctattctggacattttatacacattgaattatacactatctggagttatttttacgaccttagcaaaatgttttcaagggtcatcacactgtagcatttatcagtacttcactcctgcttatggttaaataatagtccatcgtacagatgcaccaattttatttatccatttctcagttgatgaacatttgtgctgtttccacttttgggcgattcattatgaataatgctgctacgtacaagtttttgtgtggacatatgtttcatttctcataggtagatatataggagtagaactgctgggtcatatggtagctatgtttaacatttggaggaactgccaggcttttttccaaagcagctgtaccactttacaatctaatcagcaatgtatgagggtcccaatttctccacattctcaacacttgttcttgcctttcttttttatcacagccattgtagcaggtatagaatggcgtctctgtgatttgtattgatgtttccatttccctaatacctatgatgtttaacaacttttcatgtgcttactggccatttgaataccttttctgaagaaatggctattcaaatccttctcttgtttttaaactggattgtcttttcattgttttgttgttgttgttgtttttttttttttttttttgagacagagtcctgctctgttgcccaggctggagtgcagtggcatgatcttggctcactgcaacctccgcctcctggggtcaagctattctcctgcctcagcttcccaagtaactgggattacaggtgcacaccaccacgtccaactaattttttgtattttcagtagagacagggtttcaccatgttggccagactggtcttgaacccctgacctcaagtgatccaccagccttggcctcccaaagtgttgggattacaggcgtgagccactgcgcccggcctttccattgtgttttaaaaattctttatatattctggatactagtcccttatcagatgcatgatttgtaaacattttcttccattttgttagctgcctttttactttttttttttttttttttagacagagtctcactctgtcacccaggctagagtgcagtggcatgatctcagctcactgcaacctctgcttcctgggttcaagctgttctcctgcctcagcctccctagtagctgggactacaggtcaggtgtgtaccaccatgcccggctttttttttttttttgagacagagtcttactcggtcgccaggctggagtgcagtggcatgatctcggctcactgcaacctccgaatcctggggtcaagctagtctcctgcctcagcttcccaagtaactgggattacaggtgcacaccaccacatccaactaattttttgtattttcaatagagacagggtttcaccatgttggccagactggtctggaacccctgacctcaagtgatctaccagccttggcctcccaaagtgttgggattacaggcgtgagccactgcgcccggcctatccattgtattttaaaaattctttatatattctggatactagtcccttatcagatgcatgatttgtaaatattttttttttagacagagtctcactctgtcacccaggctagagtgcagtggcatgatctcagctcactgcaacctctgcttcctgggttcaagctattctcctgcctcagcctccctagtagctgggactacaggtgtgtgccaccatgcctggctaattttttttttttttttttttttgtgacaaagtctcgctctgttgtcaggctggagtgcagtggcaccatctcagctcactgcaaccttcgcccgcccggctaatttctgtatttttagtagagatggggtttcatcatgttggccaggttggtctcgaactcctgaccttgagtgatccatccgcctccacctcccaaagtgctgggattacaggcgtaagccaccatgcctggccttccttttgtatacattagaaaatacaaaagtaggaagtaatagggaggactcaggttcactatattggttcaggaaggaagcagtataatccactcatcaaatatttactgagcacctagtacatgtcacatactattggaagcatccaaacagaaggagcaaaacaagacaacaattccttccctccacatcctcagtggtggaacaaagaccaaagatcagccagccaaccaacaataagatacagtgtagccgactgtggaaagtgctatggggaaaacacaaacagggaaagacatagggagtggtggagttgcagtagcagtcagggaaggcctccatgataagccagaactgaggcccactggggtgggtgtggggaggggaggtgtgacccagtgggtcctggggaaggagtgacctaagtgtgaaccaggagtgacgcccaccaccaaagacctttcatagaacagtgaagtgttaagagcaagcattccaggaagaagactgcctgggttcaaatgctagctcggcatttacaagctatgtgacccagggcaagccacttaacttatctgggcatcagtatcctcaaatgaaaaaggggagcaataactagtttgtacatttcagggactgaatgaatgttacaatacctgacacacagtactagtctaaaaagtttgggtattgttcatgctttctatcccttcaggagtgctgcgttctcagaaattagcaaatgactactgagtaacctgagttccggctgaggcacagagaagcaggcttccaaagtcctgaggcagtcagctcccatatgctgatacaaccacactgcttgtaaggtttcagatggcttcatcaccacagaataaatcttactagcttccactccagagaaaacgtttctttactggcttctaccagaatccagaatccacactttagagagctggcactgaatgctaatttttttccccaagaatcactcaactggcaacttcctcactgcttcgtcttattcctagaagtagctgaggctgtgttcagacaatctggcaattaaagaaacccattctctctctcataggagagtgcccgaaagtgtttttcattccatgaggaccttaaccggccagatgaaatggggctgtcatgtttcaatccatctgatctaagtactcagctaattttttttttttttaatttaagaaacagggtctggctctgttgcccaggctggagtgcagtggtgtgatcatagttcactgcagcctggaagttgggattacaggtgtgagccacagcaccctgcaaattttgacaggcattgtttgtcaatatgtaacaagttttataatttttatagctgacaacataattccactttggagaacacatccaaggaagtcagtgcctcctttgcccctttcccaacgaaagtaatctgtacaaagtgattcacagcagtgttgctaataaaacagtgagaaatggagctaatataagtgtccatcaatcactggatgattgagcaaataacagtttctcaacctgaggaaaacccatctgaccaacaataatacataaaaataataataacagcaatcattttctgaacactgactattaatgagataagatgctggaggcagccaggcgcagtggcccacacctataatcccagcactcggggaggccgaggcgggaggatcgtttgagctcaggaattcgagaccagcagaagcacacagcgagcccctgtcgctacacaaacgaaattagccagccgtggtggcgtgtgcctgtggtcccagctacttgggagtctgaggtgggagggttgcttgggcccgggaggtcgaggctgcagtgagctatgatctcaccactgcactctagcttgggcgacagagtgagaccttgtctctcaaaaaaaaaaaaaaaaaaaaaaagatgttggaagctattatacgtattatctcattgataatttctttgtgagatagttatttgttttacaaataagaaaactgggggctcagaaaggttcaagcttgtgtttcaggaaataaaataatgaaaaacaaataaaacaaaaaagaaaggttcaagatacctttagaaagctggtattcaaactagtccaccatgtaccagatgagtgaccttagacagggaaccattctgggcctcagttttctcatctgtaaaatggggcaatgatacagcacccaaatcaaaaggttaatgtgaggattaaactagttaccaaatttaaagtattgagagtagtccttggcacccaataataaaggctattttccctgccattaagccacagacttcagtcacatcagtctactgctttcctcctaaacacatcatgttctttcacatccttcttgcctttttcacacgtgttgtttttcaagtctaccactgactcactgtgactgcatgttattaatgtgaagctccttagagcagaaattccatctgcagttcttcagggtatggaatgctaatttgcttgataaatattaaaccaaggaccattgcctaaaattagtcattttaatagttgtactgacataacaaagttcaaggtgactctttaaaatgcatttggtgctcctttcctgttcatttaaatgctgacttctaagaaaaactagagttagaaagctttctttctttcttttcttttctttttttttttttgagacacaagacagtctcactgtgtcatccaggctggagtgcactggcatgatcttggctcactgcaacctccacctcgccggttcaagtgattctcctgcctcaacctcgcaagtagctgggattacaggcatgcaccaccacgcctgactaatttttgtattttagtagagatggagttttgccatgttggccaggctggtcttgaactcctgacctcaagtgatctgcctgccttggcctctcaaattgctgggattacagggccaccacagctggctgggttagaaagctgtcttaaaacagaaaagaggaaaaaaaaaaaaaaaaaaaggaggggggtggaggaaaaataataaaaataaaaaataaaaaaagataaagctttctccttcccagtttgcagcctctcatcctccacctactctcttctcacccataatttataataatactgacctcagggcagtcaaagtaatcctaaaatactatataaaatgtaaaggattgttattgctacaaataataccaatctcgcctctgcctaagtaattactggcaggaacttgtccaacaacatggacagacatggtttttctgttccttctcctgcccactcccaggaaaaatactgaacttcacagattagggaccatatataatctcacaactggaaaaagatggacaatgcaaagttataaataaaaatgagattagtagacaatatgaattttggcatattctcagggcttcggagatttgggtggtttgccaagggatagaaaccaatcaattctacaacactgggttctcagaagcctacaaaagtcaggaggaaaatgtgcctttcaacactttgcctggggtaggtctcatacctatgaaagagatctacctacagagcctatgtcattttctaccttcattactctcttcttgttccagcaaaaatcagctaaacttggtagcagcttgaaggctaaattaaaagtcttcaaagaggtgaaagcagctatgtcatttggtaaatttccttagtaatattcagaatttagaaggaactcccagaatccatccaatgctacgaagatgttgactagaagggaagaaatggaggactggtagtggtaggggcagagtagagatcagtcctgcatcttctcccaccaagtcagctttcataaaaggcttccgttccatcatttttcacaggggagtatggaaaggtaatcactctaataaagtgacttcctttgctcacacagtgtgcatgtgacctgctcattccagcacagggccacgccactctttgcccctatgtcttttgttggaaggcagggaggctgccaggtgaagctggaagcacccagagaccaaggttgcttcaacgcctttctctacagtgttgcaaatacagccgtagtcatggtagatgaattttgggaagatggaagaacaaaacctctaaggtctcttacagcattaaatttccatgaaatcttacctgtctgtactgggatttggaggctaagtaaactgcttttccaatgttctgagcataaagttctttgactcatactcaaaaatcgggaaagatgattttttttaagatggtggttttcaaactttttaaaaagcggcagagcacttgttttgtaaatgaaatcttaaacggaaccttactatagtaaaaagatagatgggggctcctctggttgcagcgagggtgagtggccaggggctctaccctctcagttgtctcagtttgggacataatatgtgtgacctaccctcaaacagtttagaaaataaatatatatatagtatgtttacacatacagagaaaacagtggttctcaaagtgggatccctggaggggcatcagcatcacttgggaacttgtttctaaaaataaaaattattgggccctacctcaaacctattaaatcaactgtctggggtagggcccacgagtctgtgttttaacctgagacttcctagttgttcagacacaggctaaagtttgaaaaccactgatacagaaacaatgagaaaacaaatatggtgcaatgttaaaattggcgaatctgggaaaagggcatagggagttttctgtattattcttgaaacttttctgtaagtttgaaattacttcaaaataaaaattaacaaaaacaacaaaattaccctgggacaataagcatggagatgtggagaggggacccaggaggtagggaggcaaatcacgaggttagtgcaggaaccactcaagagtgacgtgatttacaactaagactgtagcagctccagggccgagtgagaacaggatatccgcagtcttcaaatataaatctctcccttgtagaacatctgggcagcaaccatactaacctgaataggagagaccggcaatctctatgaagaggtcttcttcagaaaagctttcggggagcatgaggaaagcagcggtcacagcactcttcagatttctatcgagggctgatctaagagtgacatcctcgttcactgagataattttcacctgaaagaagcagaacattgggaagaaaaattccagaagtggagtattgctcaagcatgggttacaaatgcactggaactatctcaaactctcttcccactgaagatcttggaatactggttcaggtgacacaaaattgttcctctaataagtaatcccagaatctccttgttttatgccaaggtcaaagaaatcatgacacaggaaaggatcaaaatgccaaagaaaacaaatattcttcttaaatgaggaaatgcagcataggtttagaaaaagagcaaaagtcctttggaaactttaatatttttaaattttataatctcactgtcgtcacttaattttttagtcgacagaggcattttacctctttatttagacctcatctgtaatcttggaccatatctaacataggaagttcatgctctatttcgcactttctagatacatcgattttgaacttgactaaggaaaaatgaaagaaaactagctacagtagaaaaagaacgggttttagagataggtatgggctcaagtccaggtacttactagctatgtgagtttgggcaaatgatttgcatcaaagaatcgtcacaaagattgactataataataaatgtaaagtgcctagaatactagcaactgcttcgctcagaaagaatttttctcctcaatacagagtagaagcttccatctgagactttctgcaaatccattaaaatacaaagagtgactgggtgtggtggctcacatctgtaatctcagcactttgggaggccaaagcagggggatcatgagaccagcctgggcaacatagtgagaccccatctctataaaacaaaaacaaaaaaaacaaacacctagccaggcacagtgatgcacatgtgtggtcccagatactcaggaggttgaggtaggaagacagcttcagtccaggtggttgaggctgcagtgggttgcagtgagccatgatcatgacactacactccagcctgaaagacacagttgagaccctgtctcaaaaaaaaaaaaaaatactaagagcttcagtctgttctgagattcttacttttaaagattgcactgcagttaagagatgtgttcaaatgccaactccatctcttactagctctgtgactatgggcataattccttatcagtaaaatggagtaaataacagaatcaagctcataaggctgctagaaagatcaagtgagttactgcacacaaacccttcagtgaaatgagcttccttgtgtgtgcttctcagtgcacaaggcaagagcttctctgggccagcggttctcatctttagctagcattagcttcacctggagaactcgttaaaatgtgtattatcggatgcaactcccagagttctgtttcaggaggcctcggtgagggctgaaaaatgtacatttctaacaagttcttaagcaatgcccagggaccacattttgagaattactgctctaaggtgcatacttagcactgtcaaattgctcttcagagtggttatgccaatttacactcgtaccatgatcttttaaaaacatcatactgtttctgattgactttctatacaaagtaaagggtctagaagtcccttaataaggactctcatatgtctaaaatatatctaccatctctaaatcttttggtactatcgacacattttctacctattctagaaaacagggcataagttgccttttatttgtcaaatacagataatttctgacaaaattaagatagcacataaaagacacactatgagaaactccaaaataaatattagaaagcaaggaaagaggagaatgctgcagtattccaaggcatagcttcttctcttctaattgtaaaaaacagtattataaaacatataactattattttataaatcaggcttcagaatctgaattcttttaccttttttccctacttttttctaagggagtatttgtaacatacaaacatcatatatggtaggtaagccacttgattcaataacaccccctcctcccttacaattctgaggacttaatggaccttaattaagcctttcagcacttaggtgagtttagtattactgcaatcatctgcagagagtaacccatgaccagccaggaacatgacttgcctacagttgcataatgagttgacaacaaaaatcaggatcacattcttttacttggcaaattcagctctaaatattctgaattattctcatgcattcatttagggttatattctggttaacttatcttgaaagatgattaaaacaaattttaaggtcctataaaaacacctatgcttattccttgaataactttcctaaaccttatagagttggctcttcgtatctgtgggttctgcacccatgggattcaaccaatcacagatgggaaacattcagaaaaacaaaaaaaaaaaatccacaaagttccaaaaagcaaatgttgaatttgctgccacatgccaattactacgttgaaggcaggcgaatgatgtgaagtgtaagcacggtattaggtattaacagtcatccagagatgatctaaaatataaaggaggatgtgcataagttatatgctaatactaggccattttatatcagagacgtgaattctgagggtgggtgcaggtcctaaaaccaatccccatggacaccaagggatgacagtattccatactgaatgattaatctaggagggcaactgcttcatcttactgacagaaaacttaggcctggaggggttaaaggggttaaaagatttctccaagagaagtagtggcgaactggaccgggatccagtcccaggattcacccagtgctctttccacaactctgtgatgtctctctacttccacattcccgttcttcatccccattcatcacacatccttctcaataattcttcacctctctgtttttgatggcttttacagaagcccagtgaaattagaagctattttgagatgctaacaattcaaagatgcaaagaaaagactaagtcttgggaaattttcccagttaacaaaataccacttgttctccaaggaagttgttctacataggctgtaagaaagcagtctgtttgctatttaagattaagaggatgaaaataaaagcatccttactcaaaggaaaaatgtcagttcggaagattctgctactgtgctgatctggttcttcaatgaaaggtgaactaggaacttgtctcagcagcactgttatttgttgttcagagtgaaaagccagtgaactcttgggacactgccagagaggcctgggaaaaaaagaaagtgctcagatttgtgaatagctgtttgtatcttactgggaatgccccgacctgaactgcatagataacattagcacgactgccagggaggaaaatctttactgtagagaaaggggcattggcttaaagggactttcaaaggagatatttgtgagtacctttcaagacaggaaaaaagagaaactcacatgtgggctcctctaaaactgtcacaaggagagactacttgaattgcagagtgaaattttaatcacaaagaccacagccctacctactgttcaaatactcaaccgcccaccagaacttttccattccaaacgaccaggaggtttaactcttctaaatagtcactgcttaaggatgaagaagaaacgctgaacattagagctggatgaaaccttactcaatatctacctgctggactctgggctcttcgaggacaagcaacatgatatcatttttaaaaattcctttggcatacacagagaagaaacagttgtcttttgaataaagaaatgaatgactcaatctgtgcatttcaaacgctagcggcccaaacatttgcttatagtagggcagagccaaaactagtaagccaggttttccaactcccagtttagggatcttttatagcactgggggtttttctatccacacaaaaaattaatcaacaaagctgcaatatggtgatagttgaactctgaatatagtaaaaatcattgaattgtactctttaaatggttgagctgtgtggtatgcgaattttatctcaataaagctgttattaaaaaataggccagacaagggggctcatgcctgtaatcctagcactttgagaggttgaggcaggtggatcccttcagcccaggagttcaagaccagtctgggcaacatggcaaaaccccatcttcacaaaaaaatacaaaaattagctgggcatggtggcacgtgcctatagttccggctactcaggaggctgagatgggaggattggttgagcccgggaggtcgagtaaattgtgttcatgccactccacttcagcctgggtgacaaagcaacactctgtctcaaaaataaaattaaaataaaataaagctacattactaaaaggcaaaatatattgcaatgaatacattaaatcaaaatcctcttaacaaggtggcaaaaaaaccactgcatgtcaatataaatgtcttaaaaactcaagcacaattatttatacactaaaaacaatgtaaaatacaaaaatccaaaattatgttaactaaggaaataactattaattattactttagaggtttcttggcttaaaaaaagtttggtcacaatgctatattaaacactttaaattccatgattttttacttgggaaaatattagtaaactcagaaacttaaggttgtactggaaataaaaatagggtattccatcaattatgagataagttaatggtaaagtatgataaaaatttaatttacactcaacttttcccagaaagtccatctttttaagcaagatactcaaatatatatatttggagacatggtcttgctctgtcatccagcttggagtgcagtggcatgatcttgactcactgcaacctccacctcctgggttcaagtgattctcctgcctcagcctccctagtagctgggattacaggtgcgcaccacctcgcctggctaatttttgcattttttagtagagacggggtttcaccatgttggccaggctggtctcgaactcctgacctcaggtgatccccctacctcagcctcccaaagtgctaggattataggcatgagccaccgcactcggcctatatcccttttaaagacttgaattactagtgattgaggaattctatttcaatttgcaagatgcaagacaattctggggctttagacaatgtaatttaatgtgattccttttaaaacacaaagataaagaattcatactcatattctcataattctttcttaagatatttacccaactttcttgtccaagatactaccaccctcttttcattagatttgttcaagtctgattaatatttgctgccacctagaggcacagatagtttgtttaaaaatcatcattctggttaacagtgatttccacatgttgaaaattgggagcaaggtagaagagagagttaatttgcccatttatcattctcaattaaaaaaaaaatatgttcatcactttcaaatgactttatgataccctaattttcttgtgctagaagcattaaaagccttagaaaataatcattgctatcagtaacattttcttctccaagtcagctgagaaatgcagagttttgcatgaaatgagcatgggtgctactacttgtcttgaattgctgtttttgttttataaggatataacagttagataaaacctgagctcatttccagtgcttacattctgagatttcatggcatttcagctttctaaagccttttttaaaattttgaaacattctaagcataaagtataatacaaagaacaatacaacattttaacattcaatttcatttctatctcaaaataactgagataagcaaaggcacagagagaaggcaaagaccattttctgagtgtctactaagtaccaggcatttcagaaccctctgaggtcagcgccatcagactcatctacagatgaaaacaccccgaggcttagggagactgtcagtggtgcagggtcacaacattaggaagcatcagagctgggattctaaccctacatctgttagattctgaaacactgagttcttcccagcagtactactctgcttccaatattccttttcctttttttttttttttttgagactgggtctcgctgcgtcacctaggctggagtgcggagtgcaatggcacgatcttggctcacctctgcctcccaagttccagcgattctcctgcctcagcctcccgagtagctgggattacaggtgcatgccgcaacgcccagttaattattgtatttttagtagagatggggttttgccatgttgtccaggctgttctcgaactcttggcctcaagtgatctgtctgcctcagcctcccaaagtgctgggattacaggcatgagtcactgcacccagccctgcttccaattttcaatacctttgtggacctttattctacagataactgaagttcagaaagataaaacaagatgcctaagtttatgtaacagctaataggtggcaggactgaatatgactcaaggcttctaatttcatgtccactattcttcccatcaagctatatattatgtttttgtttgtttgttttgagacagagtctcgctttgtcacccaggctggagtgcagtagcgcaatctcggctcactgcaacctccactttctgggttcaagtggttctcctgcctcagcctcccgaatggctgggattactggcgtgtgccaccacgcctggctaatttttgtatgttcagaagatctggggtttcactatgatggccaggctggtctcgaactcctgacctcaagtgatccacccgcctcagcctcccaaagtgctgagattacaggcgtgagccacagtgcctggcccatcttttgtatatttaaaacaaacaaacaaaacaaaaaacaaaacaaaaaacccttggaaataaaatatttacaaatttccaactgctcagttatgagctttactagtcatccaacttagaaatgagaaatgtatctgtatagacatgaaatttcagtaagcctatcatttctggactttaaaaaatgtttttaattaaagtaaaagttacagtgaagtgcacacatcttaagggtacagtttgataaatttgtccatgtgtatacctgtgtaacccctgcccggatcgagtatttctggacattttaaggagctacactatgaaattgtaagcccaggtgcaaagcaggagaatccagacagcccatgcacatcaataaagagatgtttatgacacaaaccagtgagctaaggctatggaaatctgtcatttttcccatagatagctacagaagcagcacatcactgttgggggagacactcgagaacaatctatcggcctcttgtggagcctgggaccctctcacgcacagtgaaaatcttccttatagtaggaagtgtgagattagcaactgtaaatatttaacacagtcctcaaactatggaaagaccctttctcagagcacagactgattatctggaaaaaaaaaaagaagaaagaaaagtgacattgcaaatacttgttaaaagtttaagttctctcccactttttttttttcctgttttgtgtttgtttcctgtttctactaaagcccagggagaagccgactccccacagcctcctctagctgtgtcccaaaagagctaagacaatagagaaagcatcaccactggcctgagaaagagaataaaagggatgggaacaccagtcccttggaatgactacttggtgcattcatttattcaatggttactgaaggatcccacgactcaggcactgcccttgggacgcatcagtggacaaacggtgcctccatgatacatgtcctagcagacaaggtgactgggtggtgctaagggaggctccactgaggcaccaggcacctcctctgccacccttcccccaaatgggtcaacttggagcccgatccagtcattggagaatcttgagggggagggcagcaggagggagagtggactgtgacccggcttctactcccagcacttctgacaccaaatgtgggtgtcacaccaaccaattctccagccctccagacaccaactgagtgtcctacaactgaattcgattctgaccctagctacctggagtcagagtcagatcccacaggttatgggctcagttccacaagcctcccccacttcagacaccaatcacaagtccaggctgcctgtactctgatcgttcacttgaaagggatgggggctacttcccctctcctctggtttcataatttgctagaatggctcacagagctcaggaaggcagttttttgttgctgttgtttttaagacggagtctcactctgtcgcccaggctggggtgcggtggtgtgatctcggctcattgcaatttccatctcccagattcacgcgattctcctgcctcagcctcccccagtagctgggattgcaggcatgtgccaccacgcccaggtaccttttttgtatttttagtagagacggggtttcaccactttggctaggctggtcttgaactcctgacctcaaatgatccgcccaccttggcctaccaaagtcctgggattacaggtgtgagccaccacacccagccgggaaggcacttttcttgcatgtacttggttattatgaaggacacaactgaggaaccgccaaatggaagaaatgcttggcaagatatggggtagcagaagggtgtggagcgccacgacttctccgggcatgtcaccctcccagcaccttgatgtgcttaccaacccagaagttctcagaacccccttttttttatggaggttccactgcctatgcacaactgattaaatcattggccgttggtgattggcccaatctccagcccttttcccctctgtgaaggtgggagtggggggcctgaaaggtccagcctcttatcacacggctggctccctggcaaccagccctatcctgaatctatctaggggcccatcaagagtcactttattagtataaactcaggtacgactgaaaggaacttgttatgaataataaaagaccctctcatccctaacactcagatattccaaagattttaggacctctgaaccaggagcccaaggaaaaaaaccaaatacatatttcttcttatatcacaatagaatatgtggatattatttggcaataaattttatagggaataggaagagtcagaaactcatttctatttccagagttccatctcattgcaatcacaatgatcaaagtaaggttaggctcagagaggaaaggcatccttaactgtgcagcctataaaacactcaccggtttttggagtcgtccagcaatgtataagttattccagttgaggagatcttcaatcagaacgttagtgctaataactccatatttgataagctgaaggaaaaaagaaatggcacaaaacggagtaaaataccatgttattgcttatacaagtataaaatataaggaaacagataaaattcttgaccagagcagtaccttgattccaaagccactcaaaacacctgacttgtgaaaacacacatctccaccaaaacttttgagaggttaagtgtccaagactgatttagcccctagggtatgtaaggggaggttgcaactgtcttcacaagattataacagagaagtctagcatggctgactccatcttgctgccagcctcacaggctggctatccaagctcatgcctgggcgtaggtcaagccaaccaaggaggaggaatatagtttatagtttaattttaaagcaaggatgataatagtccctccctaaaactgttcccctccccagtccagagctgaaatcccctttgtaaaactaatgaaagtccacaagattagggttatgggaagggcctgaattctgctaaaatgttgggatagtttctatgatgtcttactgctcaggagacatgtgtccagaggtcacaagacttgtgagttctccaattaatcctatagataacatcactactgtagaacctaaggttggtcttttgagatgttttcagacttttgcattccagcaactgactgaccccacccagaaccatgactcaacactcaattggtcctgttgcccctccctcagcaaaaggcccactcagcccatgaggactgttttccacacctgtatgattgcatccccaaccaatcagcagcacccattccctagtcccctgttcaccaaactatccttcaaaaaccctaactgccgagctttcagggagagtgatttgagtgacaacaccagttctcctgtgtgcccagcctcacgttaatgttaattaaactcattttttttttttttaagatggagtctcactctgtcacccaggctggagtgcactggcgcaatctcagctcaccacaacctccgcctcctgggttcaagccattcttgcacctcagcctcctgagtagctgggattacaggcacgcggtaccacatctggctaattttttgctatttttagtacagacaggatttcatcctgttggccaggctggtctcaaactcctgacctcaggtgatccactcgcctcggcctccaaaagtgttgggattacaggtgtgagctaccatgcccggcctgattaaactctttacagcaataccacagtcacagtgaaccgattttgtccatgcgacaggcaggaagaacccaccaggcaattacaaggtgaccactatttcaacttaggtccatgtgatgttaaaggtggaatggctcttagatgctatctagtattggtcctcagtggattgggagtaaaaaaaacttgtccttccccaaagacagtttgagaagtgataatttagttcatgttcctcatttgagaaataaaaaacctaaagctcagagacaacaaatgacatgctcaaggtggcaccagtagtagcagagtcaaaactaggtcccagaatttcagtctggtcttccaatgctcttttcattacaaagtacaagaaattttcctttaattagaagttttcactgacatgctttacatagtgaatttctcttttgctactgactatttcaaacacttttgtaattacaaagcaatatccaaaaataaaacttctttattcatgctaaaaaaagaaattatagttcagcccatttctatttttttttttttttttttttttttttgagacagagtcttactctgttgcccatgctggagtgcagtggcatgattttggctcactacagccctaactccctgggctccagtgatcctcccacctcagtctccagagtagctggaaccacaggcatgcaccatcacacctgactaatttttgtattttttgtagagacagggtttcaccatgttgcccaggctggtcttgaactcctgggctcaagcaatccatccaccttggcctcccaaagtgctaggattacaggcatgagctgccgtgcccggacagttaagcctatttcaataataatttgtataaatcctgtagatttcccaggttacaaagtcccatttgcataaacaagtatcttcagacccactttgctgaacctcagtatccaaacagccttctcaggctgcaaatatataaaaagcagttaaaaattatcaattaaaaagtagtcttttggcatataattatgcccaaacatttggttactggaacttataatattctttgaaaattactaattacaggtaggtttggcataatattaactgtggagaaagaacaaagctaagtgtcctgcatgactcaagtggatgcagaaggctgtgctgagtgtcagccttttccccccaactccagcagcagcactgcagaaagcccttctagctgcaggcaagtaaccactgggaggtaacagaaacaccacgggcctggaagtcaggggacctgttgcaaactagctgcacaaccttatggaagtcatttcctctctctgaacttcagtttcctcaactgcaaaatacaggtgaagcaaggttggatctcaaccggaaaagcaaatatatggcccaaggggtatgcagacgtcaccagtcaatcacaacactcactccttagccaagttcagacagaccttcaaatccttctcaagtcagtactccaacctcctgccctttaaagcgtgggcctttgaccaatggcattggcatcacttgggagcttataacaaatgcagaattacgcctgtaatcctagcactttgggaggccgagacgggtggatcacctgaggtcaggagttcgtgaccagcctggccaacatggtgaaaccccactctactaaaaacacaaaaaattagctggacatgattacagtagtgggctctgtaatcccagctactcgggaggctgaggcaggagaatcgcttgaacctgggaggcggaggttgcagtgagcagagatcgcaccattgcactccagcctgggcaacaagaacaaaactccatctcaaaaaaaaaaaaaaaaaaagcagaaccttggtggggcatggtggctcacacctgtaaatcccagtactttgggaggactgtttggggtcaggagttcaagaccagcctgggcaacatggcaaaaccctgtctctacaaaaaatacaacaattagccaggcgtggtggtatgtgcctgtagccccagctacttgggaggctgagacaggtagatggcttgagcccgggaggcagagattgcaatgagcggagatggtgccactgcattctagcctgggtgacagagccagaccctgtttcaaaaaaagaaaaagaaaaaaaaaaggcagaatctcaggttccatctcagaccaactgagtcaggatctgcactgaaatgggatctccaggtggctcgatgccggccaaagcctgaccgccttgaacaatgagtggcagagctggcacagcaagtgaaacccatatgtcatccctggcccagggaagctctaggaagcatctgatttagacccctactgatccttgcaggctggggttctgcctaggtcttgacagctctcttggagactgcgatgcttcagctgaaagacagttcagcaaagttcctgctgtcagatgaaccaccagcaggaatccatgcaacttacctgctctccaacagcccactgtcaaattccacgcgtctcctggcaccaagaggttcccgtctatcacctgacacacatgctctcaatcacctgtgatatcctcttcacttccaacttcttcctgggggtgtctgcccctccttctagataaaatcaatctccaacctgacccaaaattggcctgcctattcctcccactgaccagaccaatggttctagaccagcagcttcagcactgtttggaagtgtgttaagagatgcaaatcttcaatccctaccccagacctagtgatcagaactctgggggtggggcccagcaatctgtgtgtccaatggacacacaacctaggggattctgatgcacactaaaacttgagaaccacttggccaaagacaaaaaaataaagtcagtgtggccgggctcagtggctcacgcctgtaatcccagcactttgggaggctgaggcgggcagatcacctgaggtcaggagttcgagaccagcctggccaacatggtgaaaccctgtctctcctacaaggtggcacacgcctgtaatcccagctaactgggaggctgaggcgggagaatcacttgaacccgtgaggcggaggttgcagtgagctgcgatcacaccactgcactccagcctgggcaacaagagcaaaactccgtctcaaaaaaataaaaaaaataaaataagtcagtcacacccaaccacctcctcacactgcaatgacagttaatgggacatgaggaaggactccagtccctgctctgtccccaagttcaagacgtctggcaggagtgtgaatgtttcctgactataagaatatacatactataaaaacatacatatttcccgactataacaacgtccagcaggagtgtgaatgtttcctgaccacaagaacatacatatttagctggcactctaataacccaggtaaataaccagccaagttaagacaaaggccagcagtcacttaccctaccattacacatgatcaatgaattgtagtaaactccagcgccatagttattctggatggacgtgataatcttgggccctaaaacttttaggaaagagtagtgactccaatttttcttcaggttctttgaatgccatgcgacagggtcatctactgtgaacacaaagtccagcatagcattctgtggagtgaagaaaagagaataatttcagtattaattcctagaaaggcagcaagagagcatggaaaagctctaacatactacgcaattatgatcaatagtcagaaggcctggtgctgtcatcagaaatgtgagcgagtctctggaacaaatatgagctttgttttcatcaatgtaataatagcaaacacttctttaacatgtattgttgtgccagcactctttaaacactttatgggtaacatacgcagtcactccatttatcctcagcacaaccctacaaggtagctactgctattatctcaattttataagaaaccaaggcacaggggatgctctttgcccaaggacacagagcttgtgagtggcagacctaagaggtctggctccaaactgtgtgtgctgaaccactgcactacactgcctttcacaaatgtagctaaatgtgctccgcttttcttctggatcaaattagcaccacctggataaactctacaaaatactatataaaaggaagtcagttattttatctcttacctattcaccaaccacttattgagtacataagtaatgaactctgacaggccctagggtagaagtatagagctcagagtctactggagagaataaacaaattatcactacattgacttgatagaggaatgcaaaatgtactaactgcactcagcatagggatcagatcaggggcacaggagggagaaattctcctagagatgacaaatctgagtcttgaaggacacgtgagttaaacagacttgctggaagcactgggggaagcacagggaagggtagggagccgtgttggaggaaagtgctctgtggatatgggagccagcatgttctggaagctgccgtcagatatgactgaaatagaacacatttatgcggtgggagatgagatcagagagggaggctgtttgccatgctagaaaattttcctgcagaagagctgactggagagaagagggactaagggggtgggggaattagatctgaagccatggcaagattccaggggagaaatgaaattatattagctaaggcgctaaggatggggactgatgtgagaaagatgtaggtgttggaatctacaacttgttcacttgaatgtaaggaatcaaaagtgagggaatgggaaggaaggaccttttcttgcagggaattccaggtctattcaaaggaaaacctccatggaagaatgaagaggtggccatcaggaggctaacgcctgctctgtagagtgtgactctacagaccactggggacacttgagatttggtggcgaggcaggtatggaataaacatgttttttaaaaatgtgtaattatgttaaggtaaattcgggaaaaataactagcctataataacctataatttctcatatgctgccaatttaaagaaaaatattaaatagtagtgtaagtgggaaacagaggaaatccaagcaacagcatagatggcctcaccaggaagtgaacaggcaggatgttaatcagaagacagactacagtcaggtatccagacgcagggggccccattaaaacctgcacactgaattctgcaaattacaaggaaaactgtacccttactgaggctgtgctgagccaactctgaaaagtaacaatgcctagtctcaaacagaccgttgttaaaagtgctgagcgagggtaaatacactggtcacgcactaacttttgatgttagttactttcactgcacctgccctggccctacaaccagtccgccaacttcctgaagtcagaagatcattttgcattttctcctacatttatagaggtgactctcaacaaacttggctgcgcattagaatcacctgggacgtttcttaaattcctgaagcccaggcctcatcccaaaccaattaaatcagaatctccatcggcggaagccgagcattaggattttcttaaaagctccccagaaaattccgatgtccagccgactaaaacactgaaagaacctgataacgatttcttttcctttcttccatttgcccctgcagcagtttttccttctgcctaactgcttctcctgctctagacccacgtggattcctaagtatccttcaacaccgtcgcttcaactcgcgctgtcgttatactaggaaggcaggcctatggttcactctgctagtggacacgtggagtgtgcagagcggacaggcagctctccgactctgaaggaatcgagggcaaaacgggactcgtgagaacagacagttccccgtcgtggggctgcccgggctcaccttctggtctgaactcggccctgcctggcggtacaccccggagccgtagacgaaagccagactcagctcctcggggaagtgagacaggatcttgcggaaggtcacccacgagctctgcagcgtctgcagcgccatggggtcgaggctaacaggggacactcagcgcagcagggcgaggacaaccgggcggggaacagacaccgggtaggcggtttagggtgggaaatggaagtcggagactggatcgagggacacaaggctgagtgtggggtgggactgcaagcacacgcaaggattggggcgttgggccacgaagagcagcggcgagaagacgcagcccagataggctcgggtgggcggcggtcgcacaggcagag

SEQ ID NO: 630 - DNA, 427207 bp, Homo sapiens
attatttaaagcacatttttattatagataggttaagtgtggtttgctgtggctaaagatatatttataatggatgaacaagcttttctagataccaagaggtataatatttttctttcagtattgaactaatatttctctgataacaaggagacattgaactggctgagcctattttaaatgggaaaagacttttttttttctggatgttgctttaaagactggtaaattaaaaattttaaagtactaacactaaatttaagtacagtgaaagaaaatcaatgaatactacaaaacatataatttctacaaagcagaaatataaaggttttataatttaaaacagcagcaatttcaaaaaatttgctgaattaaaactttacaaaatatatatacactaagtatcattccagatgatcatgaactttaaaaacagtatggcacaacccccaatctgtaccccaaacctactactagatgtagctggcctataataatttttacaacaatttaaaaaataaaacaaaaacaaagaaatctaattcttttgcgtacaagcacaggttacaatgtgctggctttgattccaaatacacaaagagaattttaaaataaaacaaggacttcacataaatagtttcacgtgttattaagtgtgtgaccaaacaaattaaaataagtactaacaaccaaaacatatcttgatgtaaccagtacatacacttttaaagaatgacaaagatgaaaaaggaaatagtctatgaaagccataagcaccttgttttcgaaagagcaccaagcaacacaaagaggcaacacgtaagaggtagtgtatcaccggctaagatgtatatgcccatcggggacctgaatacagcttagtgttttggaaaataagacatattagactgtggcttgtaatttttagacagaagcagtgcacatctggaagcattagccagtattgctccatagtgctctgcatctccagctgtctaatgggtactacgcactcagtcaaaaatataagataccctgaagaattccatatttataaatttttagttctagggaattctctaagaaagctgagatgaatataatttttaaaagaattaaatactttatcaatcatagtcctttaaaaatgccttttctccttcttaggaggaagtctgttcttcctgagattctttaagatttagccaatgctttattacatgcatttcataatgactgtatctgtctgtcttatttctccctctgcagcaattacctggccaacagcctgaattcggaactaattcagagactttacagaaagcatacagaactgctgtcaatgtaatactttcgttcagttttgagatgaggaagtttttgtacttcaatcactggaagttgattaggttcctgggtgtgaaaaagaaatgttgccttatgccagctgccatcttgaatctgtaaaataagaacaaaatgctttcatacgcatttcattagcagtcactttcagtagacaatgcctttcacagataatgtgaacttgttttaaggattagagataacgaatagaaagtgcctagaacaatgctcaataaatggtaaaattactattattagttgaaaacctggacttattcctttctctagaatggcactgtctgttctaatttttcacttccagaggctaaggccaggcttctgcttcaactgtctgtgaattattggaccagatatgaattaaaaggctgcaatactcctaatatgagtaataaccatctgttctgtattcctttatttgggactgatacctcaggatggatatttttctttgataaaagggaacgagctatttcaacctctgtattttaggtagaaaataaacagaatcacctcagtcagaaatagttaaaattataattatgtgcaatcatcttttaggtctcttcccccccgccccattctgtagctctctatttatacagtttccctctttcttctcttttgtgtctaataaactctgtggaacaaaaacatatcataagatatcctgtgattaagattcaaccagacacaatagagaaaaacaattgatgagttttgtggagctgttatttaggagctaattcacttattcacagaattatcatgatataaattttaaattttgaaggaactttagagattatttaagctataaattttattttaaagttaaggcaattgaagctcattgaaaataagttacttgtctaaagtcataagcttggtatgataacaagacctaaaattctgtgtgtgaggcactgttagattcattcattaagtcttttaagcaatatttattgaatactaagtatatttagcatagttgaataagatgtaacacttagtgttcttatagtgcttgtgaaatacacgatgaatacaatagttctggcttctaaatgctagtggcttataaatctaattgaagagagtaaaaacataaacaaataaccacaacaaaagaccatctatagaaagtacaatgtaaaaaatgtagatagttagtaaattccacatttctaactagagtactcagggaaagcttcatgaaaaaatttggaatatagatgggctttaaagtatgcctaaaatttccacttgattagtgaggtacagaaaggcatttcagagaaaatgaatggcttaagctgaacacccatacatatacacacacacaacaaccaccacaaaaaactaaaaaacagaagggcaagtagaaagtggctgtgaaaattagcttagcatggcgtttaaattcacggatttgacctgggacagattttgatagaaattctggtactctcactttccccacatataaaatgggaataataaacacctacctcacaggcttgcgaggattaaatgaagtttcaatcaaaagtcactagcagtacagtaaggcctgggctttggagttctccatgcctgggattgatttcttttcttttcttttttttttttttgagacggagtctcactcggtcgcccagctggagtgcagtggtgcaatctaggctcactgcaagctccgcctcccaggttcacgccattctcctgcctcagcctcctgagtagctgggactacaggtgtctgccaccacgcccggctaattttttgtatttttagtagagacggggtttcaccgtgttagccaggatggtctcgatctcctgatcttgttatctgcctgccttggcctcccaaagtgctgggattacaggcatgagccactgtgcccagccatgcctgggattgatttcttgttcctcctctaattagctgtatgactgcgattatctaattagctgcattactttaatttttatttattttttactttaatttttattttacttatgctaattttacttacttgcgaatttatttttaattatgctaattggctgccttactttgctcaaaataaccttgagcaagttctctgtgcctttactttcatacctataaaataggaccaataatatattctttacaaagctgttattatgaataaaataattaatgtaatgcatggtcacttaacatataataaaactcccaataaatagtagtaggagctgttgatattattatccctattattattgtaacagatgagtttgaccatagtttacaacagacagccagtgaaagcccaatctagaaaagcaggctggggtctggttgttgtaagcactcaatggagttgataagtttgaattgtgtctcagaggtactagtgagtcactgaatgtttctgggcccaactgtacaagttaaataaatttgttgatgatactcatctcttcaaatatagataataaaatatatatacttctatttgcttatgatttttcaagcactattttcctggaaataaaatgttatgaaaaagtagagtaacttggaaatgttgagatactaaatcatgggtttcatagtacacaaagataggaaatgaagctacttaaaataattaatgatacatatataaagtgtacaactccattctctaaaagaggggtcggcaaactcttctctaaagggccagatagtaagtattttacattttgtgggccctgcagtctctgtcatacttactcaactctgccattgtagtgccataacagccatagataataagtaaatgaattaaggatggctgtgttccaataaaaatttattcacaaaaacatggagtgggcccgatttggtctgttgaacatagtttgccaacacctgctctaagaaatagtgttttaaaattatagatttttcatagtaactgtcatttaatttttttttttttttgagatagagttttgctctgttgcccaggctggagtgcagtggcacaatcttggctcactgcagcctctgcctcccaggttcaagcaattcttgtggctcagcctcctgagtagctgggattattggcgtgtgccaccatgcctggctaatttttgtatttttagtagagacggagtttctccatgttggccaggctggtctcaaactcctggcctcaagtgaaccacccgcctcagcctcccaaagtgctgggattacagatgtgcccccacagtgcctagccccattatttaatttaatttaatttaattttttttttttttgagacagagtcttactctgctgcccaggctggaatgcagtggtgcgatcttggctcactgcaacctccgcttcctgggttcaagtgattctcctgcctcagtctcccaggtagctgggatcacaggtacctgccaccatgcctggctaatttttggatttttaatagagacggggtttcaccatgttggccaggctggtcttgaattcttgacttcaagtgatctgactgcctcggcctcccaaagtgctgggattacaggcatgagccaccatgcctggccccactatttaattttaatggaaaaaaaataggccagaattcaaatacttactggtggggccagtcaatatgtaattatacccatatttggtatcaggtacagggattgacagaatgaaataaaactcacttgcctctataacttgccttttatgcaataatgagatgtagaattacagcagtgaaaacacatgaaaatatttatccaaatacactatctatttatcatttatctatctgtctatctatccatccatccatcctggtataattatttcatatagggaataaaaattaaatttacatcttaacacctgttttgcatgcaaaaatctaagaccaattggtatgacacaagttgataaggtattatataaacaaatgattgattctagaaaatgcagttacaagtcaggcacattaaaacttactacccttctgtatctgcagtttgtaattaaagtcttactctaattatcctaattttatggttttatcaattttaagttagttatattgaacaattctaaaagtgccatttccttaccttgcagtcatctgaaagcactttaggttcaagtagagtgtttactttaaaaatctggccattccatcccttgaaaccaataggcaatcctgggccacttgtttgtgtgcttgtccaccttggggtgtttagacagtgaatggtgatgatatgggtggcttccgaactcagtaaatgaaggaagttcatctggactttcccaactccaaactccaactaatgtcatagaaatgatatgcaggttataacatggcaattgagaaacttaacagttcaggaaaacctgaggaaaagtccttcaaaggcagcctccagaaagctcctttccttggaactgaagtgccagtcagtggtgtgctggtaaatgtttaaccactgcttcttggaggaaaaaccatgatttatagtatttcctgactcctgtggtagaagcactcccaaagtgctgggattacaggcatggctgaattcagactaccaaggtgaggtcactgaacacggcaatgggaagaaatgttaacaagtggctttcctgagcctatatgaattggctccagcataccatcaggctactacatataatatcaataaaataaagataattttcacagtatataaagtaacaatttgcttttggttaatgctttaatactttttttaataaaaatctgagattctgtctctgccttcgagattttttttgtgagagtttccaaagatgagttacaagctgtaacaataatttggttgagtaattttaactttgagagccttaacggactaggacagaatcctattctttgtgttaccagcccttaatgtagtttcattcacacagtgaatcgtcaataaatatttattgaatgaatgaatgaatgcataaacaagtattaactaatatatatattagttaatatataggacaatatcagacttaagaagactgactgcacgtttcccaggcttgaacaggaaggcagattttcctatagctctagacatgattattattattttagcattattcaagcagggatatggtcataatgtaagtgaacagaaatagttcctactgaggaatttgtactgatttccaagcataaagttagaaaaatatcagttatgaggtaatgtagaagaaaaacaataacaacaaaaagaaaaacagaaagaaaaaacaaaatgagaggaaaggcaaaagaagggcatacacatggaaagataataaggaacattagaatttaagtaattcaattccttcattttacagattagagtcagaaacttgcaaacaatatttaagctttctgagccttaatttccttgtcagtaaattcgggtataacactaatctggcatggttgttatgaggattaaaaatgacaaatgtaatttacctagcattgttcctggcacagagcaggccctctggtggatcacagttttattccctaggttcatagaatagagactagaaccccagtccctgattccaagtctactgttcatcccagtacttctctggtcttccttgggttgagtttatgaatcaaagaaattagagaagtgatttggtcatggaaacaactagagtccgcttccccactgctcctatttcctctgcacagttcacacagccccatcttctttccttctatgataatcctatgccaacttccactggaatgaggatgatgatgtggatattttggaagtaggactatcatgctgctctttattagaggttcatgattccctaggaatggaaggatccttccctcttctatttcaggggtaataatggtgaatgcctattaagataaattgatggaatgccctggttaatgaagagaggtgttttaggaggagagggcggttcaataagaagcagctaaagagattgaattttatctgctgtctttttatgatgaacaaaacacacaataggcacatgtatcagttctttgtcaatgagaaattcttgatcatatatcaagctggtttaatcagaaaaagaaagaaacatagttttggtttcaatatatgttataggtacagctaggatttaggttttataaatatttgttataactcccagtgttataatatatgttagtttaacaaactaacatgcattcgttctaaacgtttgatttatagaattattcatgaaagaagtttttagtagtattctgtggatgtttaagaaaggttattatgtgcccaataaccataaatagcaagattttgtggcaaattcttttttaatgattataatataattttcagcaaaacttcaggtaactgattactggttacaaacactagctgtttaagaaatttctaatgtgtgtgtatgcataaaaacatagcatatgttgcacaattttaaaaggaatttaaaaaacatgatcagtagggtaaggcaaactaagccaaataataaaaagacacaatcaaaatgtcaagatttactgtgattaactagttttaaaaaataacatatttatttctcatacacaatagagaataatctttgctttcattcttaaaattcataattatttaaaatgatagaattttaaacataatttttcactgatactgtgcaatataacgacatgtgttctaaaattcagtaacatacctttgttacagaaacaggaggtaagcatgtctggccaccagcactgaaattgcagaaaacctcaatggcatctgaaggacagccaagatttgggtcaatccagtattttcctaataatttatagtaaaacataaagttaaagttattaaatgccataatccttataatttcttttttttttttgagagagagagtctcattctgttagcccaggctggagtgcagcggtgcgatcttggctcactgtaacctccgcttcctgggttcaagtgattctcatgcctcaacctcctgagtagctgggattacaggaatgggccaccacacccggctaatttttgtattttcagtagagatgggatttcaccatgttggtcaggctggccttgaactcctgacctcaagtgatctgcccacctccacctcccaaagtgttgggattacaggcgtgagccactgtgcccggccacatccttataaatggtcatggtactttaaatacatattatcacagtttcacctgttaaaaacttagaagattatatatttacatttagtgaatgaatgaatgctgcattatgtaaaattgatactaaaaatgctgtatttttcacataactatcaatttcagagtgtttcataattttaatcaattatgattaaattatgataaaatgatagaatagctgaattgattgcttcattctacagataagaagatgtgctcagcaactaaaagtgaattgtttagttacatagttaacaaaaaagttgaacttaatgaagtatatgtgtatatttctgttatacatcattacagtgtttcaaacgaacattttgttttataatagaaacaacttccatctcttgaaggaaaaatatatctttatgtataatactgataagtaaaataaaaatatgagaacatttttgttttcacaaaaaaatcatacaattaaatgtttatcatttttgtactctttcagattttcccactatcactcagtgggaaaaactgaggtccctatagctagtgaaattctaccagtctttgctccactgagtgcccaagagaataaaactgggcctaaactcagactacagaaaatacttagactgaaaagcaatggcctagcatcttaattccagactaatagactgagagtattaaaatagcatcttattccaaatacaaaggacaggaatttttgaataaggcagccctgttttcctgcattaaaaacgcaagaacattcaatggtttttgttaaatgtcattttttctacagtaggcagaagtccttgttcattccacttttattccatagcaaagattcctctagctcatcctgagtttcctctagcttctaaaacatcctcaaatattctcctctctactattctactaatccctctaaatgcttacttgcttaattggtagctcaaagggtagaaatggtcctcagctgcagcagtgttcaaactttagtgtgcatcaaaccatcactaaaacacacatagctgggccctacccttgagagttgctgatttattaagtctggggtggggcttaagaatctgcatttctaacagtatctaattctggtccagggatcacatttggagaaccactgatatattgaaatacagaagaaaggggtgaaggaggtcaaccattcctagtcccttatcttcagaattttgaatatttcataaagtttttagaaagtacagctgaatttttcatcagaatctgatgagggcttccagtcttacctaatggagtaaacatatatcttctttcaccttctcttgtcttccaagaaatactatcctactactatatgagctaataataaaaaattctttataaaaggttttccatcaagcaaattttatttttatatggggtgaaatgctttgaattcaggtgttatattctatttgggtaggggctccataatttctttcaaggtatgccaagctagagatgaagtcctataccatgacatatcttttgtgagcctaaatgttctgactcaaaactagctcttccctgaggacactgcttctcttgtagcctctacagtgttgtgcccgaaggtggcaaggcatctttcttgctctttgttgctacttacagaccattctttgcattttctccctgaaaacactccatattgaaattactataatcacattatatcattcattagttcctcctggtgtaatcatttactatttttctatgacaattttagctttttatcactttcagaaaatctacttatgacctaattcttggtgattttaaagccacatagatgatgctttcaacatgttggtcttcagttccttgaattgtatcctccccaaccctcttacttttccaccaatgatcttgtaccctccccctaccctcgtaccttactttaaccattaacttccaaggccatatcctagcttttgttattaccaacaactgcatctcctccataatttcatttctcttctctttccagttcactccctctagtgtcctaactccaataattcttcactttcatcgggacctactatcactttttcattgcccctaatgatcatatgttcacttcccttcttacccagcttaaaaatccacagtcctttactatagtaatgtccttataaacttccttacacccttgccctgcctcatttcactctacttgtcttataaatccccaatcctacgtaagtttctccctaacctgtgcctatacctgcacagaaaaaagtggtaggagaaaaacacaactgttgtgatgggcatccttcaaattcaaatgtgtctgtaaagctgctagacagtaatatggtgtttccagagtttattccctctatcactaagatagttaactatcttacacctattcattcgctcttatcctcaactgataagcttccaatttcaatgagacaactgaaggaatctgaagaaaatttatgtaacttatataaactcccactatcatatctacccacatgtctgtgcttgtacacatatattctaccttctctctctttttgaaataggaatttctctcttgctctgttgcccaggctggagtgcagtggcatgatcttggctcactgcaacctccaccccctgcaggctcaggagatcctcccaccttagcctcctgggtagctgggaccacaggcacattccaccatggctggccaatttttctatttttagtagagatgaagtttcaccacgttggcctggctgttctcaaactgatccgaaaaaaatgttggcctgaagtgatctgtccacctcggtctcccaaagtgctgggattacaggcatgagccattgcacctggcctgccttctctcttattatagtgaataaactgtgttcctatagaagaattatcctaaggccgggcacggtggctcacgcctgtaatcccagcactttgggaggccgaggcgggcagatcacgaggtcagcagtttgagaccagcctggccaagacggtgaaaccctgtctcttctaaaaatacaaaaaaaaaaaaaaaattagctgggcatcgtggctggcgcctataatcccagctacttgggaggctgaggctggagaatcgcttgaacctggaaggcggaggttgcagtgagccgagatcgagccactgcactccagcctaggcacaggggtgaaactctgcctcaaaaaaaaaaaaaagaaaagaaaagaaaaggaaagaaagaaagaagacttatcttgttcattatacttgcagatttaaattctacttcttttctctcttttgagtctgctttcgttgtctgctgtttctactagttctcattcatggtgttgtgtcaacttgtgtgtttggttgttgattgtgtgctgggcactgcatttttgaaattatttgtggaaatagtttgagttctaggaaaatgttatcttttatagaagatttttgtttgtttctgacagtatgtgggagttccagcagtttggaaccattttaatacaagttcaaagtttgggattttctgagctatccagatgatgtgaagcaaagctacagtctgtatgaatgttcgttttcttccagtttatctttactactagaatgcaggcctttgaaagtctaagtcctcacctttggtgggccacagattctaacttttgacccctacctcctgaagccaccaagcttctcaacatactgggggcaaaagtagctccaaatgttgggttcactttctgctgtctcctttaaagtctcagcttgaaagttcattgctgtttgttatttattttatgcttttaacttaaaaaattaatttagccaggtaatatgaattatgtgcttcgttactgggaatgaaaagttcctagcattatccttttctcttaaaatctgataaggttttaactactaccattcctctaaactgctcttgatgaaggtccttaatgatgtctgcattgctaaattcagtagtcttcctcagtttttgctttacttaacgtggacccagttaatcccttccctccctcctcctctggcaaacattttctttgcttgattttcaggacaccacatccagtttgcctcttatctcagtgatagctgcttcttagttttgtttgctagttcgccctcaccttcctgatctttaaacattagagaaccctaggatccagtttttagacctcatttcttttttctttttttttcttttgagacagagtctcactctgtggccaggctggagtgtggcggtgtgatctcagctcactgcaatctcggcctcctgggtcaagtgattctcctgcctcagcctcctgagtagctgggactacaggtgcgtgccaccacacccggctaatttttctgtatttttagtagagatggggtttcaccatgttagccaggatggtctcaatctcttcacctcatgatctgcccacctctgcctcccaaagtgctgggattacaggcatgagccactgtgcccgtcctagacctcatttcttcctttacttactatctatgtagtcttaagcagtcttaaggcattaaacaccaattaaatgtaaatgatttcataatttttacccttacttaggatctccttcttgaccttgaacttgagtagtcaactacctacttgacattcttacttgaatgtctaagagacatctcaaagtaaatatatccaaaattttactcctgatcttatctccaaaattgcatctcctgttaacaacatcccacccttttacagaaaaaaaaaaaaaaccctgagagtcatcctttaccattctagttctctcataacccacatccaatctatcaacaaaaactgctggctctaccttaacccatttattcctgaggttgtaatttttttgaatttttgcaatcagaccttggtgatgaccttaagaagtaggatataaatgactcccacatgcttagtgttccaataatggaacgctaagcataaagcatattcaagaatctaaccactttttaccacttcccctgcaaccaactctagtccaaccaaccatcatctctcctggattatgtcaatatccttctcagtggtttccctacctctacccctgtcttcctgattgtatttgcaacatattagctagagtaatattttaaaaatctgagccaaattatgtcacttcttcgctcagcaatttccaatggcttcccatcttatcaagagtacaagctagagacttctgagtagtctagagggtcttgtataatttgactttttgatatctttctaatttaatttcctatcattctcccctatatgcactctcttccattcatactggctttcttgctaattctaaaacttgctaggtatactcaaagactcagggcttttgcatttattctttgtgcctggaaagctctttctctagatttcttgtggcttgctctcttacctccttctgatatcacccaagtgtcacattctcatagatgccttatctgatcattctatttaaaaattgtatcttgtgctccacttcctatcaaatctccctaccctgctgttttgtttttccttatagcacttatgatatcctagtgatgaaagtatttggggggcgtaaagattttttgaacactgcacaatccacaccatttagctatttctcttataaggaaggtagactttgaattacatttcatactaattttgtatgtcttacaagatctttgttcctttcaattctacagaattacactttaatgccctcaaatatgggaaaaaatcaagctgagaattattataggcaactacaattttagtattattttagtttttatattaatctagggcagaaaaatatctttagaagttaagtgtttgattaatgtaaacaaaatgaatgttttcattgaagttctagaacggaagcagatgttttggacatgtgtgtatgtgcgtgtttgtgtgtgtgtgagtgcatgtatgtgagatgtgtatgtacaaacaaaattaaaatgaccacagaataacataacatagctttttcaaatcagcatttttcacatcagcacttttcaaatcatacatttttttttcaaacatgtcattgtgttaaaactagagtttgtagcagacaaggtttcccctgtttaactgatgacttactcctcttgatttaaaacctttccttggttgttctaatctaaattcatttttgcacctctggctaatgaaatcggggcatctgtgttgagattagacacttccaagaatgacaaaccgctcccatcttcatggtcatcaattctagaaggcgacatttaaattccattttgtattaaaaaaaacccagacttttagggagtatggtgaaggagatgctataatatatttatttatgttgctaacttttgtagtcctgacttaccaagttctgatgagtactactgtctgttaatgcaaaggtcaggcctacctttcttaatttttaatatgaatatgctgtataccaagtacaaaatataagcaaatgatatagctaggggtggatgacatcagaatcatgtctccctcatagagaattttattcttgatgacattaaaatggcttctgccagggttttatcaaactaactatgatttggagtgaacacattacaaatctcaaacacactgaaatgatgaaatgaaattcactatcagagtttgaggtaaccaagaacttaccatctgatactttttgttcacagttaagtaaatctttgcagattcgtgctgggttatctcgtgtgccaagaggattcttgatgctgtgcaataaattgctaaggtagttcagggttttgaatatctcttcactgtggtcaattaaagtcacttcagtattctggtagctctgccaagtcatcataagaattatataagcaaaaaaatcctgaggaccaacatgggccaaggcaggagaagaatgtgtttccattatgtgtagtaagttgtgagtagaatgtaaagaacagtttatatttaagcataggcatatgtgtatgctttaataaccttaatcttttaaagaggttaaattcacatttgcaagtttagttttcaagctaacataagaattgctatgtctactgtattatgttttttaaattacacattgaatcattagagtttaaataaatgagtagtgataatatatatatctcattttaagaaacatggctaacctcatttaactactttcttggatagtaccaaattccttacaaataacagtactaaatttttgatttaaatgttttccttacaaaacatcctacgcatatatttctgtttaattataccaaaatcacttactttgttcttgagaatggtttcacattttcaatctgttttaaatacaatctttgagataatgtcacattttggcctccaaaaattttctctgtttaattggtatattgagagacagtgccaatataaataaaaccagatatgttacctccatctgtagggcagtatttgattcaatcaaggcttgaatagcagcattgatatccatttgcttctgtgtaaaacaaaaccatttgagattagcaataagatcaacactgagtgccctaaagtaaaggctgtaaattctgaaagcactgctgttaaagtataccagacttattatctgaaggggttctgtaactcttacggttagacagattttgcaaatattgcctggatatctgaaaggacaatatgccaccttcatccaaatctcaaacgtctcctaattaaaataggaccagagtctacagtcctcagatgaaaaactatttgtttctgttgcctgaaaacacacacacaaagttcctcaaatggaagagaataaaatatgatcctctcagttaataaattgtaaagtgaagaataaataactgtagcaatttttaacagttacattcttggaaggagtagaataaaatactactgtcctgaggtagtcaccacattaatttaatctgatacttctgcggttttaaaaataatttctgaagttggaaaatgtaccatgagtcccaaaagaaataatacagaatgaaatcaatctcctcttgcatttaataaaatatatttttagaaaaagactgagcacaaccattagtaaaagtcttttttttttgtaattcttttaaaaaaattatcttagaacaatgaagcatgagttgggagaaggttctgggaaatggcatctgtgtaagtgaaacaagcaatttaatttctttcagtcattgtactgtgaagacatctttttacttgaaggctgcataatagaaactgtattcaacagatatctcatagctcatggttggtagtttgaaaaactatttgaaatgatggaataatcaataaaatgtactctcccttgcttcagcatgtgttgttcatactggaaaataattgactcattctgcatatatatactgccaaacactgtgatatatattgaggataaaatggtaaagaaaaaagaaacttgcccttatggaacttaaatttagagaggagataggcaataattaaattatctcaaaaatcctaattaccaattgagatacatgctatgaaagaaaagtgcacgaaactatgagagaaattagagaaattaatcaaatctggaaaatgtaagaggttggaaggaataggtcagggaaggcttccctgaggtagtaaaatttgaactgatgtccaaagaataaataagaattgttaggagaaggggtaggagagctttccaggcagaagcagcaacctggcacaaaggccatgagacagaaggagcatggactattcaagtagcaaagagggtaaacctaaaatattctctgcagattaaataattatgaccatcctgcttgcgtgaatgagcagattttggatatgggtcacacaaaaatattggcactaaatatgggaaactgaattaagggctaaaccatagccacctttatgttgttcacttggtcccctgctggtgattatgggttttaattagaaaacctagcatagtggttctcaaactcttcagaatcagaatccttttgcacttttaataaaggattcctttattattagaggccttacaaattttttgtttatgtgaattataactttttttttttttttttttttttaatttgagatggagtctcgctctgtcacccaggctgaagtgcagtggtgcgatctcggctcactgcaacctccgcttcccaggttcaagcgattctcctgcctctcagcctcccaagtagctgtgactacaggcttgtgacaacacacccagctaatttttgtatttttggtagagatggagtttcaccatgttggccaggctggtctcaaactcctgacctcaggtgatctgcccgccttggcctcccaaagtgctgggattacaggtatgagccaccgtgcccggccaacttttgatattgactatagtagaaaccaaaataaattttaaaactattcatgtgtcaattgctttaaaatttcaacaaacccattatatgttaatataaatatttttataaaaattaactatattttccaaaacaaaaaaattaatgagaagggtcacccagttttacacttttgtgcatttctgtaatgtctggattaatagattacagctaaattctcatatttgtttttgtattcaattagttgtgaagaaaacccagcctaatagagatatgtagtaggaaaaaagaaaagtatttaagtcgtgtttttcaaataattatggattttcttctttcatattataccttataccaaaacttgataagtggtagtttcttaaaggttagtttttgtgggaaaactgaacccacctcaatgaacgttttgtacttttatactaaaatccattggtctgttttatactttcataggtcttttgcttatacatgattttattaacataatatattgatcattctgaaaatactgatttatggaattatgcaggtcttccaaacacagatacagctcattccttaatgtcaaaaattacatttgttaacatcattaggaaaacataatgttacttatcaggaaaacataagtactgggaatctgtcaaatcctcagtgataaatacatgttttccctaatttttatttttgcttgagagcttgaaatttctcactggcatcaaattctgtcagttgttttccttgaaatggaaggctaacttcattcattttcaagaaaatatctgtgaactactcatgtcttaataatgctggtagtctgtcaataaaaaatggtactctatgataaaactggctagttgggtttgcaactcaaatagctgcacagtgcttttgaagcaatcactacagtgtgcactatatgtactttatatgtccttccatttcatctacgaaatattaaaaagatatttaaagaagataagaaatctaggagacagcaaaagtggtggaataatagccttccagaattctctcttaggcaagttaaaaaatgaaataaaaccatgtctttagaactaaaggacagagggaggagccaagatggccgaataggaacagctccggtctacagctcccagcgtgagccacgcagaagacgggtgatttctgcatttccatctgaggtaccgggttcatctcactagggagtgccagacagtgggcgcaggccagtgtgtgtgcgcactgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcactgattgctagcacagcagtctgagatcaaactgcaaggcggcaacgaggctgggggaggggcgcccgccattgcccaggcttgcttaggtaaacaaagcagccaggaagctcgaactgggtggagcccaccacagctcaaggaggcctgcctgcctctgtaggctccacctttgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaccagaaaggacatctacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaagactcgagaactacgtgaagaatgcagaagcctcaggagctgatgcgatcaactggaagaaagggtatcagcaatggaagatgaaatgaatgaaatgaagcgagaagggaagtttagagaaaaaagaacaaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacgtccccaatctagcaaggcaggccaacgttcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaacatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcagtcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacaattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaaactctgaatagaccaataacaggctctgaaattgtggcaataatcaatagtttaccaaccaaaaagagtccaggaccagatggattcacagccgaattctagcagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaaggattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcttacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagcaatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactattgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaattaaaaaaaaaaaaaaagaactaaaggacagtatgagaaagatgtcttactaagtagagaatataataaaagcacataaattatagaaaaaagaaccaaatagaaattctgaagttaaaaagtacaatagctgaaataaaaatttactagataggctctacagtagatttccataggcagaagtaagcaccagttaacttgaagacaggtttattgagattatcctgtttgaggagtggaaaaaaaaatgaagaaaagtgaacagagacttaagagatctgtaggacactgtcaagcttatcaacatatgcatgatgagagtctcagaaggggaggagagagaaaagggggcacaaagaatatataaagagatcatggctgaaaacatcacaaatctgatgcaaaaatattaacctacacatccgagaagttccacaaactttcccagacacatcataatcaaactatctaatgctatagacaaagagagaattctgaaagcagagaggaagctcatcatgtccgagagatcttcaaccagattaacagctaatttcccataaaaaaccataaaggtgagcaggcagtaggataatatattcagggtgctaaaagaaaagacagtcagccaagaattctatttccagtaaaactctcctttaaaaatgaaggaaatattaatatattcccagttaaataaaaaccaagacaatttatcactaacataccttccctagaaaaatattatagggagtcattcaggcctaaagtaaaggatactaggcagaaacttgaatccacctgaagaaataaagagcagtagtagaagttacaatatagtaaatataacatatagtatagaccccaagtagccaaaataattttgaaaaaagaagttgttagaggcatcatgtttcctgatttcaaaacttactataaagctgctgtaatcaaaacagttggtactgtcataaagacagacataaagaatgaaatataatagagagtccagaaataaaccttctcatttatgatcaaattattttcaacaagagtgctaagaccattcaatgaagaaaggatggtcttttcaacaaacagtgctggaaaaatggaatatccacatgggatagaatgaagttagacccttaacttacatcaagtacaaaaaaacttacatcatgagttataccatgaactcaaaatgaatcaaagacttgaacataagaggtaaaactataaaattattagaagcaaataggaaaagcttgataacatttgattttgcaatgatttcttggaatgataccaagagcacagtcaacaagagaacaaagtagataaattagactatatcagaaaaaaaaaaaaacttctgtgcatcaagggacactataaagagagtgaaaaggcaacccaacggatggaaaaaaataactgcaaattgtctttctggtaaaggattaatatctagaatatttaaagagcttctacaacttactaacaaccaaaaaaaaaaaaaaaaaaaaaaaggcaacccaattcaaaaaatgggcaaataacttgaatagacatttctctaaagaagaggctgggcacagtggctcacacctgtaatcccagtactttgggaggccgaggtaggcagatcacttgaggtcaggagttcgagaccagcctggccaacatggtgaaatcccagctctactaaaaatacaaaattagccaggcgtggtggagggcacctgtaatcccagctactcaggaggctgaggcaggagaatcacttgaacctgggaggcagaggttgccgtgagctgagatcgcaccactgcactccagcttgggcaacacagcaagagtctgtctcaaaaaaaaaaaatacaaatgtctaataaacacatgaaaatatgctcaacaccacaaatcgttaggaaaatgcatgtgaaaaccacaatgagataccgcttcataaccattaggatggctgttatagaaaaaataaaccagaaaataacaagtgttggtgaggatgtggagaaactggaatcttgtgcactgctggtggtaatgtaaagtgtgtggcagctatggaaaacagtatggcagtttctcaaaaattagacatagaattactacatgatacaacagtttcatttctaggtatatacccaaatgaattgaaagtgaagactccaacagatatttgtacagcaatgtttatagcagcattattcacaatagccaaaaggtagaagcaacgtaagtgtccatttggataaacaaaatctggtatatgtattacatggactattattcagctttgaaaataaataaaattcgaatatacgcttacaaaagagatgaaccctgaagatattacgttaagtgaaataagccagtcacaaaaagacaaatattgtatgacttaacttatatgaggtacctagagtagtcgaattcatagagacagaaagtagaacggtggttgcaggggctgggtaaagggaggaattgagagttattacttaatgggtacagagtttcagttttggaagacaaaaaaagttctaggcatgggtagtaatggttgcacagcaatgtgaatgtacttaataccactgaactctacacttaaaaacagttaaaatggcaaaattttgttatgtatatcttgccaacattaaaaataacaagtaaatatgctcattatcccttagaccaaactatcctacttctggcaatttgtcctctaggtattctacaaaatgatatgtatatggacaggacatttgtactatgtgtaattaaaaaaactgaaaaaaagatgctcaccaacaaagggcaagatgaataaatcacaggatattcttagttggcaacactatgattttctgtgtgtggcagtaaataatacaatgactattagtagattagtagtgtagagtttgatgctttagtcatgctaaggtaccagcaattttaaacaccatcagtgcaggcgacaactcaataaaaaggcattttttttcccaacaggtattagaaagaaaagaaatttcataacacttggccactcaaaaattttcttgacaatctccatattcctagaatccccaaggtattcacaaagcctagctcatgactggcacatagcagtcaatcaatttgttgaatttattgactttttccccacaggcagactttaagaaaggcagggtcagagaaattgtattaagaggatttgcctgggaagtcattcagtcacatctaagtgcccacatcgaagtataaatctctcattaagtgcagtgaggggatcaaataaggaaaaataacttcttccaggcactctagttagagagaacatattcttacatggaaatcactcaatatttacaaaaacatgcatgtaaaatagaaaacagagaataaagattgattatatgttgtgactagtgagtgtgaaataatgaggggaattagacagcaggattcattatactttgggagaatgtaatcttcataattctctccaaatcattcgagtgaagagcagatctagtctaggcacctcagtattttgaagagaagcgttattttttcatatgtctaaagtttcaagatcactggatggtgaaaatgctgaccaaataggaactcatttcaggtcacacccctctttatgatagaagtttttgctgattctagagaaccagtatataatagcagcagccacttcttaattcaccaatccaggttctacagttgacccattaattggaatacatcagttgggaattctttctctcacttaatgatttttaacgattgttatttccatcatatacaccaaacacagacacatatagacaccctgttcttccctttattctactaatcatttctggttaactttgacatcatatggcatacttctgtgttcatttctaaataccttaccatacacactgaggtctggtcattaccctatcctcacattcaaattcaccatcaatacatattccttttcctgaaacatttccttttagctattccactttagagaactgagcaagttactttagtttcataggtcttataaagatgtggctggactggattagaagttttcatacttatcttgacccacagtaagaaatacatttttacatcatgacaaaattcacacaaacatacatatattcaaccttaaaaagttctgtaaaaccatatttattcttactgatgatgatgtactgatttttttaaattgaggtaaaatttatataacataaaattcactattttagtcatttaaaaatatacaattcagttgtctttagtagattcacaacgttgttcaaccactaccatgatagaatttcagagcattttaatcacccaaaaagaaactccatatctattaagcagtccctccccaatatttttctattctatttcatttgctctaaaaataatcctgaatgagactcactaaattggtcttatgatccgctgaccaatgaatcccaactcaaagtctgaaataactgcttaataattactgagaggacctctagttctatgagtctaattttttatagacattgtttctctccaagtgaaatctagtttagaagattcccactaaaatttcctgagatgttgccttttttgtattcatgcaagcatgcactcaacatttattaagagcttaaatggaaggagaatttaaaaagtagtctctgtcttcagagggttcacaatataatagaaaagacaaacatgaaaataaatgagtatgaacaaagaaggggaagtgatcagttctatcttgtagtgtgatgagggaatggaattaagaaaagtttcatggaggctgactttagaaagaatgtgtaggtgtcttattgtcatttagatgtctgctctagaaatcttatcctcaatgttattttcctacaacggactctgcaagttccaggaaaacagcattatatatggaaatctgttttcatattggccaagaaggaatacagaaaggaggaaaagggagaaaagaaggaaacaaagaaactagcatttattgagtagttataatgtattcaacacacgtattttcttacttaatcttcctgattaatttctcaaagtgtatacatattttaatccacattttgctctgagcaaaaacctctcatgtcttactctattttggctgtgtaggaacacatgtattttccaagtgagacagggatatgtgtcacacagtttggcacttaaatgtgaaaattttcactaaacatttctttaatttgccaatgacgtatgatcctttagaacttgaacttgttctttcttgagaagggagctatgatatatcaaagtcattataatttgggaaggcaattaatgagggtacttgtaatccatgcattgtggggatccaggaggaaaggaagaataaacaagtggaaagtgatttgaagacttggagaaagacattgttttttttttttttttgtttgtttgtttgtttttttgagacagagtcttgctctgccaggctggagtgcggtggcatgatctcggctcactgcaacctctgcctcccgggctcaggtgattctcttgcctcagcctcctgagtagctgggattacaggcatgtgccaccatgcctggggttttgccatgttggccaggctggtctcaaactcctgacctcaggtaatacacccacttcagcctcccaaagtgctgggattacaggtacaagccaccatgcccggccgaaagacattcttattgatgtccacacagggagagtttccctccatgttagtcagaaggccagaaaggggaagtgattttttaaaatcacagataaatgggtctcttgttttcaaggggatagtcttccttgtggcactttgcctggaagttattccttgccccaatgaaaagctgagggaaatgaagagttcctgatctgctgagagtagaccacaggaaaccaccacctagaactagcagagatctaaatgacatcagagcagcatgtgaaataagaaggcttaaatggcataggactgactattgtttgggatggtgtagcgaacagtagatccatgttaggcagaaaatgtgaccaaggaccactgtatttgaccaggaggctggaggagtggggtgtgggtgaggttgcagatggagagagacctttcatagggagcagaaagacaaacagactgcggaatatgagagtggatacaaagcataaggaaaatcaaacttagaatatcagagggcatgagaatagcagaagcaacataaacattgcctcagagataagggtagcaagttttgggtcatagtagttagataataagcaaacataagagaagtctgatggcttccagagttaccagcaactgagaaagatttgatttacttcatgtaaatcaaagaagtggataaccctggctggcaaaaagagaacatttaaaaaaggagagtgaagatgtagaattaggaagaaatggagataattagtttttcaagtgcttattatgtattatacaatgtgctgcatgctttacttcttactcaacacttgaaaccacccaagaaagcaggagataccatctccattttataaataagaagtctgaggcttggatttcatgtttgtgtagctgggccagccctgtatcaggttagcaaaaaagaacagaggtatccaaaagggataccttttaatagagagttaacagaaggatatttaaaaagttaatatgacatactaagataaaacaaaacaaaatcaaaccaagcaaacttactcttgggcctggtgctccaggtggaccctagaacacagcaaattaaaaaaaatacacatttatttagtagacatcttaaaccaggcaaacatataagcatcaatggtaaacagatataaatgaaaaccaactcactggaggccctggttgacctcttggtccttgaggaccctggaagaaatggagacaaacacaagacctatatattatacttttggttgggtataagcaagataactaatattcaacctctgtaactgcctttcgtgccaggcaagtcatacaatttaaaattgttttagtattctaaagttatatgctgtggtacttagcaatcatccatattcataaacaagctggatatttattttcctgtttatcgatattattagaaactgaatttactcattttaataaactattataaatgtaacattttaaaatattagtattgtctaaagatgtttttcctgttatttctaactaccatccacctaatcatcaaatatagaaacttcggtgttcttagacacattaatttcctttatctacctgtaaactggttactaactcctgttgagttcacctgaaaatctctccaaaataatacttctccatttttattgataattaaatgaatgaatgatgttaaaattaattagtattaatttagaaattagaaaagtgaaaaggtgtatcgcaaaatgtcaaaagttatgttgacatttttcaaagcgaagcaataattactgttaaaaatgctcaaaggccctgtacatctgttcaaaagtaacttagatgttcagctaaatgttaagactatattgagtcaactccaattacggttaaaagatggcaaagcaacacttatcttcagctaagttttggataatgttgacaccatgcttgacttagtattaagcatcttgtattgccaaagctgttaatcctaaatatactgtgatagctagaacaaacaatacatagtaacttgaaaagatcagagtactccaacactgtgcctgctagacatgtctcagtttatctggtttatgattacaagtttaagcagagaatgtacaaaacttgtacataattaaatgaatgaatgatgttaaaattaataccagttaattttaatactagtcaaaattaatactagttaatactagttaattttaacatcatccattcatttaattatcaaccaatgcatatatctcagaagctgcagggtagctgacagaaatgtcacattggagatagccttttaaatatacagaagctcaaagtgaaattggttatgtccgcttctccattttggatcaacaatgtaaaaataataaacagttgcaatagtccattccacttagcaagtttttgacatttggaaaatatcactgatggttcagtacaaaatacatatgttacctttgacttcaaaagaggaatttatcatagaaaaataagaaacaatttctactgctgattttataaagttcacttcagcttattattcagaacaagtcagatcacaaatatgatcaaacaaaatacttcaaacccaccaggatagggcagggcaactccaatgtaaccacatagaatagggaaagtagccaagttaaaaaaatatgattccaacaatataacattttattagttcttttttattactctagctaatacaccattaaggtgaagtgattcactgtctattctatataaagctgtttataggccaggcatggtggctcacacctgtaattccagtactttgggaggtcaaggccagcggattgcctgagctcaggagtttgagaccagcctgggcaacatagtgaaaccccatctctactaaaatacaaaaaaattagccgggtatggtggtgcactcctgtagtcctagctactcgggaggctgaggcacaagaattgcttgaacccgggaagcagaggttggagtgaaccaagatcacgccactgcactccagcctgggtgacagagtgagactctgtctccaaaaaataaaattaagtaagtaaagtagtttataacaacaccatgattgtctctgttaattttcttttactttctttttttttttttttttgagacgtagtttcgctctgtttcccaggctggagtgcagtggtgcgatctcggctcactgcaatctctgcctcccaggttcaagtcattctcctgcctcagccttccgagtagctgggactacaggcgtgcgccaccactcctggctaattttttttgtatttttagtagacatggggtttcatcatgttggccaggctggtctcaaactcctggcctcaagtgatccacctgcgttggcctcccaaagtgctgggattacaggcatgagccactgtgcctggccgtctatgttaattttctaaaggggaaccaaattactctgaatggttatggtggttatttggctatagtaaaaacacttcctatgaaaacaagattctcttttcactttatcccagaatttacatacgatcctccaaaagtaacatattttatcagtatactttaaaaatacgtgtaagtgcatatccttaaacttgagtatgttagtcttcctttttgtaaattcttttatttcatttcctaatgtcatttcctttatgtcatttcccttatgtaaatgcaatcttgatttagcttcatgatctttattttaggctggctcagttgcacagagcttccttttctcatttataaactgaggagcttccattgtaggatgtttagcagcatccctagcttctacccactagatgccactgacatctcattcttttcccccaattgtctcctagggtggtagggggacaaatggctcctggttgagattcattggtttgaaaggagaatttagtaatattaaataagattaactagatagtaatgtaattagaatggaatgagtgagcaccacaagtcatagggcgtgactgcaaataagaacataaactcttcaagttgtcatgcgggtgacagctgggctactcttgatctaggtggaggatacacacacacacacacacacacacacacacacacacacacacacacacaccatattccttaccaagacctcctaaccctctttttctgaaaggcactataatttatagaaaaacacaatcatataggaattgggaatctgggctctggttttgtctttgtaacttaatttgctatatggtcttaagtgaactgctgcacatttggacctcagatatctaaattgtaatataataggtctagtgaagataatctccaaggttcactttagaattatgattttcaagacttttatcaattttcttcctgatgtgtgtttttttaatttttaaattttctttaaagacgggagtcttgctatgctacccaagctggctttgaactcctgggctcaagcaattcttctgctttaggatccctgagtagctggtaccacaggcatgtgcttctgcatgacctacctcatgttttttatctggataaagaaggtgtacacaagcatacagattgggaatttaaaatttaaagtctgtacaaatgtaatggtaagtgttcttgaatttaaaaagtttgatacttttaaatgaatgatttatactatttatgaattttaaaaagaaatacatacatatatatgctttaaatgcttactgtgttaatatttaggacctatttcccatatcctagtttttccttctaatgcagaaaccatccttctcactttcaaattggaggcaaataagacaactgctaatcaagaactgtgaagacatattaacttagagataatattagagaaaatgtcaatgggatgtttcaatattttatgatttcattaaatagtatattataaatatgaagcagctaatctgaaaattcatgctgagattgttctctgtttttttttattatttctatagctgtaagttatatgattcaagttgttacattttgtcaaaattattttcaggtcaggtatagtgactcatgcctgtaattctggggctttgggaggcagaggccagaagaatcacgtggggccagggttcgaggccagcctgggcaacactgggagacactgtctctaccgaaaaaaaaaaaatcattaaataaataaataaataaataaataaataaattagccaagtgcaatgacacgcacctgtagtcctagctatttgagaggctgaggtgggaggattgcctgagcccaggagttcgaggctccagtgagctatggctgcaccactgcatgccagcctgggtgacagagcaagactctgtcaagaaagaaaaaaaatcctttgccgatatctgacactaggatatcatttctgctataagttaaaattttacttagaattttacttaagttaaatttttactaattgtatcccattatttccagcagtcgtctttgcattacttactctgaaatttactcagttgtgttttaagtgtttcaggtctcatagaaagtaggaaattttgtaaactttcaggatttatttggcagtaacacaacagttttgaagtagaggaagagtagagaattctacatgttatctgctaggtttccttaggatgccataaaactctggctctgtttagaatatatatatatgaataggactgggtgcggtggcttatgcctctaatcccagcactttgggaggctgaggtgggcagatcatctgaggccaggagttcaagactggcctgggcaacatggtgaaatcccgtttctacaaaaaaataggaaaaaaattagctgggtgtggtgctggatgcctgtaatcccagctactcaggaggctgaagcacgggaatcacttgaaccagaaggtggaggttgcagtgagctgagatcttgccactgcactccagcctatgcaacagaacaagactctgtctcaaaaaaaaaaaaaaaaaaaaaagaaagaaagaaagaaaaagaaaaagaaaatatatatgaatctagggactcattttaaaaacagtccataggcaggcagaccgggagcaagtatagaacagaaagaaaaataactctttcataaatggccatacagaatcagctctctcagtggtggaaaggacctacttgggatcaatactagagtttacaatgttaaattacagaagacatgaagttttctaatcaagaaacccaaattataataaaggagttacttttcatgtattgtataatgagctataaacttatttgcatttttttaaagtcactgaatcatgctttggtcatttttttggttatatttaggtataaaacttggtaaggagagcacagtttaataaattcatagtttaataaattttcctccatggaaaattttaaaataagattgaggcccagcgtgatggctcacgcctgtaatcccagaactttgggaggctgaggcgggcagatcacgaggtcaggagatcaaaccatcctggctaacacagtgaaacctcgtttctactaaaaatacaaaaaattagccgggtgtggtgatgggcgcctgtagtcccagctactcaggaggccgaggcaggagaatcgcttgaacctgggaggtggagcttgcagtgagccaagactgcgccactgcactccagcctgggtgacagagtgagactccgtctcaataataataataataataataataataataagattgacaaaccaatttgatagattgttgtgattctgatctttgtgcaaagacttaagtctcttacttgtctcaatacaataggtcttagctaataaaatccattccaaaaatgcaccatttactagcattttctgagaatgacctccgcgaatgtattacattctgaaagacagtaaccaattaggcgtctttagccagtcaattatttaaactgcctccttaaagaaaacaaactggtagaatgtactgaaaaattcccaatgaaaagtgtaagaaatgttaccaagcttttccataaaacaaaggagaaaaggtttaacggcacattttatggattatgataattgcagaatgatctccaggaattaaaagattaactttataaagctccttaaattataatggaatcaaaggaaaagaagtgattaaaaaggtatttagtatcagttatcagttactcaacaataaaacagaataaactcataattgtaatgtgccagttaatcctttttttttttaaacagcatatttagttgcctactctaaatgccactgtgcctatttcccatctcccttgggtactggaagtttgcaccttatttatgaagagaagcatgataacccacagactaaaaactctaaaaagcatgttaattcaggaaatgctactttaccaggctagaactggaaatagtgtttcactttttaattttagggcatattattcatttatcaactattacctattacatggcaagttctgttctagacactgataacctgtgtaccacacaaagttccctactctcatgaagtttacattctagtggaggggacaggaaataattgcaatgagtgctattatgaagaaaacaaaacaagatacagtgaaagagaatgaccggaaatgatgagacagaatggtctgagaagacttctttaagatggtatttgagcagagacctgaatattgagataaaattagtcatttgaagagtatatgaaagaatttcctaggttaaaaaaaggcatattcctaagaatagaaaggaggttagtgtaggtggcaggtggaaaatggtacatcaggacactggagaggcaaacaggggccagttcatgtagggccttgtaaatcaaggcaaggaagcttagattttattctaagtgcaagaagaagtcatagggaggtgtttaaagaggagaatgatataatttgatttattctttaataatatcactctatttgctatgtagagaatagatcgtagtgggggaaaagtggaagaaacgacaagaaaccgggagtccaggagggatatcatgatcacctgcacaaggatgccagtgaggaagaatgagagatggattgagaataggatttacagctgatgggaattaatctctaaagaactctttatgttctatggctttgttagttcttttgtgcggggggagggcttatttctttttcttttatgtagaatcacacatattcagatctggaaagaactttatgggtatctcttctaattccctactcagtgcaggaataccagtccagtaacttggggagatggtcagtaggctttggtgaaaggtagttattaccttgcaaaatgatctttttgtgtagttttcattattatattagacagctcattattacatggagctgaaattagcctcagtatcctattaactttgtcactaagtttttattgtgttaattatgtatccggtgctataatagactgggtactaggtggtaacaacgatggtaggtaggtactaggtggtatctaatatatttcatgccttcatggagctcactttctctcagggagctgagcacagaattcaataaattcaaacaattcaataaataagtcttttaaattttatcctctagagttactcatattgtatctatcctctcttatataagataacctttcaaatatttgaagacaactattatgttccaacacctcaattttgtctaattcatttaccaataattcattaaatatttattgaatgccaactataagagaggcactgccaggtgtgagggacacagcattaaaacaaaaatcaacagttaaaatgtttgtgtcttcaaggctacattctagtgaggaaaaatataataacaacaaaaaacaaataaatatgtactatgtcagttggtagaggcacaggtagaaggaatataaggcgtctcaggaaggtgggggcactgctattcacacaggctagtcaggataagaggacatttaagtacaaaactgaagaacacgtgccaggcattgtactaggtcctgagggctaggtattatgtccagggtgggagtagggtggggtcaaaacattagcatgcctgccccgagaaatgttcattaaatcaaaatgtcaagatcagcaggagctctctaccatacataaagggtatggtagagaaataacaggtacaaaagccaggaagtgcgacgagagaagaaagaacaaggagagagatgtaatcaggctgcagaatctggtagaggctaaccatcccagatatttcaactggtcctaccaggacataggttcccccagatccttccccttctctgaatgtgctttaatgttgtccatgttttctttggggatagcatgactggtaccactacctgctttatactgcatgccatatttctatcactacaacctaagatggcagtcctaatctattgcatttgtaatccatcacagagccactcaatttttttttcatgtgaaatgcttgtgacattgccataggtacttcaggcttcctaatcctgatggaaactatgtcccagccacagtacttggagaggatactggggaggcatgcagagccacactgatatggaacatgggctaattccaagtctctctgcttttcccttccctctttcactcttccttggaaatatagcttcactgtgtacatatgctcttgcttcctgttacaataaatctgctgagaaaaggtgaggatcacatttctacaaattgaacacatcgatttaaatatccttttgtgattcttaggctatctgaaataacataatttctcctttttagctagttaatataactgcaacttaattattctgagtctcaagcataccctaagatgagaaaaaaaaaaatctcagctgtgactatgtaatctcattaccttctaatcaagactttactgctatatttaagtttattctcatgggccttatgtacttggtttcaatctccctcattttattccatgtctgtcctctgtttatggtgctgctttaataagtttggcatggatcacatgctaagtgagtagatgttagcttctcttgcaataaaaaaaaaacaaaaggatgggtaatcatgtgagatgaatatgttaatttgcttaaaaaattacttataatcaaattacttgcttataaataacctttttactatctatatgtatcctataacatcatgttaaatctatacaataaaaaacttattaaaaaataagcttagcatgatctctgctgaagaagtggcccctttacaacacatcttctttagcatggaagaattggcatcctagaaatgagggaagtagggccagtataagctactttggtcacaaaagtgctgtgtaccttttgcccatcctctcatcattgtctctaactggctgatatgcaactaatgatttgcctctgcattgcagatctctttggtgctgactggacatagtgggtatatgcctaaagcgaattggcagtccctttgttctgccactggtgaagaaaacccatatcccatctcctgatgcctggcaaggcaaataatccatttcacacagtgatccgggaagaagtgattggcgggttcttaaacatctttagggtttatcagatttcactgcaatctaccacatagggtttttaaattattattattatactttaagttctgggttacatgtgcagaacgtgcaggtttgttgcataggtatattcgtgccatggtggtttgctgcacctatcaacccatcacctacattaggtatttctcctaatgttatccctcacctagcctccgacccccgacaggccccggtgtgtgatgttcctctccctgtgtccatgtgttctcatttttcaactcccaattatgagtgagaacatgtggtgtttggttttctgatcttgtgatagtttgctgagaatgatggtttccagcttcatccaggtccctgcaaagaacatgaattcatccttttttatggctgcatagtattcgatggtgtatatgtgccacattttcttaatccagtctactactgatggacatttgggttggttcccagtatttgctattgtgaatagtgctgcaataaacatacgtgtgcatgtgtctttattgtagaatgatttataatcctttgggtatatgcccagtaatgggattgctgggtcaaatggtatttctagttctagatccttgaggaatcgccacactgtcttccacaatggttgaactaatttacactccctccaacagtgtaaaagcgttcctatttctccacaacctctccagcatctgttgttgcctgacttttttatttatttatttatttatttatttatttttattatactttaagttttagggtacatgtgcacattgtgcaggttagttacatatgtatacatgtgccatgctggtgcgctgcacccactaactcgtcatctagcattaggtatatctcccaatgctatccctcccccgtacccccaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacattcatcatcactggccatcagagaaatgcaaatcaaaactacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcttgctgctataaagacacatgcacacgtatgtttattgcggcgttattcacaatagcctgactttttaatgatcgccattctaactggtgtgagatggtgtctcattgtggttttgatttgcatttctctaatgaccagtgatgatgagcattttttcacatgtctgttggctgcataaatgtcttcttttgagaagggtctgttcatatcctttgcccattttttgatggggttgtttgttttttcttataaatttgtttaagttctttgtagattctggatattagccctttgtcagatggatagactgcaaaaattttctaccattctgtaggttgcctattcactctgatgatagtttcttttgctgtgcagaagctctttagtttaattagatcccatttgtcaattttggcttttgttgtcattgcttttggtgtttcagagatgaagtctttgcccatgcctatgtcctgaatggtattgcccaggttttcttctaggatttttatggtcctaggtcttacatttaagtctttgatccatcttgagtggatttttgtataaggtgtaaggaaggggtccagtttcagttttctgcatatggcaagccagttttcccagcaccatttattaaatagggaatcttttctacattgcttgtgtgtgtcaggtttgtcaaacatcagatggtggtagatgtgtggtgttatttctgaggcctccgttctgttccattggtctatatatctgttttggtaacagtaccatgctgttttggttactaccgtcttgcagtaaagtttgaagtcaggtagtgtgatgactccagctttattcttcttgcccaggattgtcttggctatgtgggctcttttttggtttcatatgaagtttgaagtagttttttccaattctgtgaagtaagtcattggtagcttgatggggatagcattgaatctataaattactttaggcagtatggccattttgacgatattgattcttcctattcatgagcatggaatgtttttccatttgtttgtgtcctatcttatttccttgagtagtggtttgtagttctccttgaagaggtccttcacatcccttgtaagttggattcctaggtattttattctcttagtagctattgtgaatgggagttcactcatgatttggctctctatttgtctgttattggtgtataggaatgcttgtgatttttgcacaatgattttgtatcctgagactttgctgaagttgcttatcagcttaaggagatttggggctgagatgatggggttttctaaatatataatcatgtcatctgctaatggagacaatttgacttcctctcttcctatttgaataccctttatttctttctcttgcctgatttccctggccagaacttccaacaccatgttgactaggagtggtgagagagggtatccttgtcttgtggcagttttcaaagggaatgcttccagtttttgcctattcagtatgatattggctgtgggtttgtcataaatagctcttattatgttgagatatgttccactgatatctggtttactgagagttttggcatgaaaggctgttgaattttgtcgaaggcattttctgcatctattgagataatcatgtggttttcgtctttgtttctgtttatgtgacggattatgcttattaatttgcgtatgttgaacgagccttgcatcccaggaatgaaggcgacttgatcgtggtgggtaagctttttgatgtactgctggatttggtttgccagtattttattgaggatttttgcattgatgttcatcagggatattggcctaaaattctctttttttgttgtgtctctgccgggctttagtatcaggatgatgctggcctcataaaatgagttagggaggatttcttcgttttctattgatcggaatagtttcagaagaaatggtaccagctcctccttgtacctctagtagaattcggctgtgaatatgtttggtcctggactttgttttggttggtaagctattaattattgcctcaatttcagagcttgttattggtctattcagagattcaacttcttcctggtttagtcttgagagggtgtatgtgtccaggaatttatccatttcttttagattttctagtttatttgcatagaggtgcttatagtattctctgttagtggtttgtatttctgtgggattggtggtgatattccctttatcattttttattgcatctgtttgattcttctctcttttcttctttattagtcttgctagcggtctatcaattttgttgatcgcttcaaaataccagctcctggattcattgatttcttgaagggttttttggtgtctatctctttcagttctgctctgatcttagttacttcttgccttctgctagcttttgaatttgtttgctcttgcttctctagttcttttaattgtgatgttagggtgtcaatcttagatctttcctgctttctctcgtgggcatttagtgctataaatttccctctatacactgctttaaatgtatcccagagattctggtacattgtgtctttgttctcattggtttcaaagaacatctttatttctgcctttatttcgttaggtacccagtagtcattcagaagcaggttgttcagtttccatgtcgttgtgcagttttgagtgagattcttaaacctgagttctattttgattgcagtgttgtctgagagacagtttgttgtgatttctgttcttttacatttgctgaggagtgtttcacttccaattatgtggtcaattttagaataagtgggatgtggtgctgagaagaatgtatattctgttgatttggggtggagagttctgcagatgtctattaggtccgcttggtccagagctgagttcaagtcctggatatctttgttaattttctgtctcattgatctgtctaatattgacagtggggtgttaaagtctcccattattattgtgtgagtctaagtctcttttactgcatcggttaattctacttcctgacaactgcaattttatttttattctacaagtatcagagacataataatggataactctaacagggtccttgctttcatggagcttatagcctagtgtcagggttactataatcacaaatttagttaaacttacagtttcacctctaaagcccttttcacctctgggtccctaaaagaaaaaaaaaagatgttagttcattgttattgatagttacgtattaaatgtagctgaggtcattatatgtagaaacatgacaatttatatttttgctttttctatatagtaagacctgttttgttaaattgtataagttctagtgttcttttcctaaataaagcaaagcaaacaaaaaacccttagtgattcatgttgtctgctttgctgttcctagttctaaccttaaggtgagactgagataactacttattcattcaattaagtcaaaacagcttatctgacaatcatatacaaagcaatttaaaaaggaaattctaaattcaggttaaattcttctaataattgtttttcttaacttttgaaaaccctgtttctgggatggtttcccttctctttcttgcaaattttaatatgttgtatatgtttccgtgcagttcaaaatattttctaattttcttggagacttgctctttgatccatggattatttagaagtgtgtgatttaattttcaagtgtttggagattttcctattatctttctgttattgatttctagtttaattccattggcaagagaatataccttctatgacctcagttcttttacatttagtaaaatttgttttatggcccataacatcttctattttggtgaacgttccatatgcacttgaaacgaatgtagtttgccattgctgggtggacctactgcttttaaaatgtgttaatattttcctgttcatccttttgaaaattttatatgtatatatatgtaaaaaatgagatactattcatcttttctgtaacctgaatttacaccttcataaatataatatgaatgctcttccatgtcaatatacattcttttagataattaaaatatttaataatcttacctagtatttaatatactatgataatattttaaatttgctattattagactttttgctaatttttgtcattgttagcagtgttgtgagagatacccttacagtctaaaatttttgttaaagactgtcttccagaaagttagtttgaaattacatacacacctgcaaaaatggaagtgtacatttcttctgatctatgtcatgttctttgttaatttgcaagctaagaatactatcttatcatttattcaccatttatattacttctgtgtttctcatcttgtctcaattcattttaaaccagggtattaacttaaaaaaaacttatttatttatttacttatttttttttttttgagaaggagtctcgctctgtcaccaggctggagtgcagtggcatgatctcagctcactacaacctccacctcctgggttcaagcgattctcctgccccagcctcctgagtagctgggactacaggagcataccactaagcccagataatttttgtattttcagtagagatggcgtttcaccatgttggccaggatgatctcaatctcctgacctcgtgatccgcccgcctcagcctcccaaagtgctgagattacaggagtgagtcactgcgcctggaccctgatttttaagatatctacacagcactttaaaaaaatatatacacccttttccacaccctacccagtattaacaacctggtatgtatgttttcatacctttttctaatcaaatattgacaaatacatttatgtatgtatgagaaatattgctgttttaaaatattggaatcatattatatactcttctatgcatcgcacttaacaatacatcatgaaataactgagtcagccaaactagatataataaattcttttaaacaattgcataatattccatgaaatggctaacctataacttactcaatcattcctttagaaatgagtattcacgtaatttcaattttttttccaataaaagtagtattacaaaaaaaagtctttgcaaaatttcattagtgtattgggtgcttttatacctatgggataaattcctccaagtggaactgttttgttaaagaatatgtacctatatttaacaaatctttccataaagtctgtaattcacatttttaccagtgatcaatgagagtactgttttctcctatattcccttctgagaagttaaatgtaatatcttattttactttaatttgcatttctctgacttaaatttaggtgagtgtctttttattataaaacaatagttgaacttttggatttgttctttttttctccgctggctacttttttgatggaatgcttttcatttttctattgaactttctttttcaaactataagagctcttggtatatgtgtgtatatgtctctatctctatctatctatctatctatctatctatctatctatctatctatcatctatctctagatacatacacgtatccatagcaacagataggtagataattttttatttttaaattttttttgcccaggctggagtgcagtggcatgatcatggctccctatagcctcaacttcctcagatcaagtggtcttcccacctcagcctcttgagtagctgggactacaggcatctgccactacgccaggctcattttaaatttttttgtagagatgggatctcactatattgccaaggctggtctaaacttctgtgctcaagcaatcttccagcctcagcctcccaaagtgctggtaatacagccgtgaactactgttcccaactgagctctttgtatattaacctgttatatattgtatgctttgtaaatatttttcccaatcaatagtacttttaaactttattcatggaatcttttttccatacaaaatgaaaaaaaaatttcaagtattcaaatatactttctgttcttttacaggtctccccaatccttaagctacatgttagttttctagattattcttcaattttttttttttttttgagatggagtttcactcttattgcccaggctggagtgcaatggcatgatcttggctcactgcaacctctgcctcccaggttcaagagattctcctgcctcagcctcccaggtagctgggattactggcatgtaccgccacacccggctaattttgtatttttagtagagatgaagtttcaccatgttggccaggctggtcttgaactcctgacctcaggtgatctgcccacctcggcctcccaaagtgctgggattacaagcatgagccactgcgcttggcctcttctaagatttttattgttttattttttacattaaagtcgttaaaagttcatctaggagtaaaatacttttggcaaatggggttccaatttttctttcttcttttttccttttttaaagagatggggtctcactctgtttgcgcaggctggagtgcagtgggtgcagtcaactcactgtagcctggaactcctgggctcaagcaatcctcccatcttagcctcccaagtagctagggcttataggcatgtaccaccacacacagctaatttatttttatatgatgggggtctcactatgttgcccaggctgtgttccaatttcttatagcaggaggatactcaaagtaattccatctctcttccctgtcactgacgtaggagtgaacatctggctgaatgctagacaattagatatgaaaaaaatgtaatcggagacttctaaaaaattcttatttttgccacaatagtactttatgtcattttttttttcctttggataattatatctggatgtagttcttgagaagttgtagtcatcttgctataagcctaattatgaagccaacattcaggatattagagtagagacatagagatataagagatacataagaacctggtcttggatgagataattgagtcgccaaattaaccaaatctgaaggctttcctataatgtgatacaaattttcttattgctaaaagtactttggttcagggttcctattatttgcagccaaaccttcctcaattatatgccatttttgttgtaagtaaattcctatatatacttaagatcaaattctgggctctagtctgttacaccgatctgtttatttctttgtattaccatatagtttcatttacaaatttccaagcctgtcacccctcactggtattttttttcccaatgctttcaccaatctgaaatgcttattctttcataatgaacttttcttctcagaatggaaaaaattgaatatggaaaaattgatgtacatgctgaatattataagggtctttaagaactatctataaacaaaacacagtaagatattttaattaagtaattttaaaattacattttccttgaccaattaatacatcatatttttgacagaggagaaaaatcattctgtaatcagaacagtatgtgtcccttagcttgctgaagaaccactcactgaaatatgagaattctcccacttacaatcttatatagctccgagtggcaaatgttgaaagtctacagaaatactgagttatacattttacttcttttgtttacatatccagtaactttggtggtttcttctctaaatttatcaaagagaatagtggtactaaacacttgaagcattctatttttatattttttaattgtctgtgtctataaataactttcaaataattcaaaatattaattccctagatagaatgaatctttcctctctaagtctcaatttgaccctttctactgtgctccttgcttgtttatactattatcaatattggaaaactttcccaacatcacttgaccaatcattgtctcatttttatgttttatttcatagccaaatttcttaaagcactggcatataatacctcaatttcctctccagacacagcttgaatggagtggaaagagcgctggtcttgaagaaacaccagctatgtaatccacgaggtctatcaccttgaatgactagatgaacctccataaacctcatctgtctcctcatctgttaaatgaaaataatatctactgcaaaagtttgttgtaagaatttaaggaacattattattaaacattttcccctacttccttcatcactgtaacctgtactgtatcttctactgcaatttattctctcaaagattactgttgactactcctttcttgaaacacttgctattctctcgaacgattctttccttcctttatagtgggtacttccaaaaactcaaatgttggatgtctgcacatcttttgctatctatgttctttccttcagaagaagaatttatttttattgctcaggagttcatctctatgtttataacactctccccttcctgactcagttctattttcttttctcaactccaattataaacacttacctacttagttacactgtcttcattacacatatggtccctaacttctcaggaatcattttccagaagaaaatgtatatctattttttccattttcttctcaaatacccaggctaattctttgtagaatattctagaaatagaattaaagaaaaaaaagagtacaaaagacttgtattatgataaacttacagttctacctgttgggcctattataccttctctgccaaggggaccagtgtttccctgttgaggtaaaagaaaaacagtctcactgttagtataattaaaaaaaaaaaaactccacagaatctcttgtacaatggtaaaagagccatgtctacataattatcctttttagtataaaagcttacagtattagcataaattacaataatcttggttaacagtatgtgacacaattctgcatattattaaagtctcttatcaggagagttgcatctgtataatttctaaaaaactgatgaattagcattatgatttttatgtggtgataacttcaaagatgcattttacatgtatgttatataacaaataaaactactttatataaaaaagaatagaatgatgaactaggttttgaataaatttctgtgcagatgttgaaaaagtagatgtttgggtaacatgaagcatgaaatagagaaaaagtacagtaaggaaccagagaacagcatatgtgaccaactaaacttcagttcttcatctgtaaaacaggaataagaacatctacttcatagggccattgtgagaattaaatatgaaaagtgcttttaaaactttaagctattatttggttatgaagataaccttgaataagctggatttctggtcaattcctcccaaagtaggaagagagtctataatttctcagtgaatacaaaatgcccattttagttttttcctacaaacttcagcttccgtggttcttcagaaatcatgaaaataactaatatatttatagctgaagaaatattcagaaaggtctttaaacaattaccatgataatactcctctttgcattattttttgaattagtattgttttaactgagatggagtcttgcttcttgctgtcgcccaggctggagtgcagttgtgccatctcggctcactgtaacctttgcctcctgggttcaagtgagtctcctgcttcagccttccaagtagctgggattacaggcatgtgccaccatgcccagctaaatttaaatatttttattagagatggggttttaccatattgatcaggctagtctcaaactcctgacctcaagcaatccacccgccttggcctcccaaagtgctgggattacaggtgtgagccactgcatctggccctttttgcattttttaaaattatactttaagttttagggtacatgtgcacaacgtgcaggttagttacataagtatgatagactggatgaagaaaatgtggcacatatacaccatggaatactatgcaataaaagatgatgagtttatgtcctttgtagggacatggatgaagctggaaaccatcattctcagcaaactattgcaaggacaaaaaacctttttgcattattgacaacaatttattgtaagagttaggaaagcggtataggattttagaagtttgactttcatttaatagttatttaagatacctttatcctacatctgcactgcttccctttttcctctctctgctctttcaacacttgcccctgcagctgctattagtcatagagatgctactaccacagccaaaccattacttgaagttttaaattttttttcagctttttttcagttttatagaacatctcatcaattagaaagctttgattaataaaaactaaaaacaaaacaaaaaactaaaaacaataatcagtaagcactggtggcttatttgtcctatttatattctctacaatttgcaattacaagcactcattgctaattggagttcttcagaccctgctttttgcaactatttaagcggttcctcatcactctcttgggatacctgcccctgagctgggaaaacacagctattgggaaatattttcagtctggtctgaagagctctggtcatacacaagcttcttccaggtggtgcatggaggtggtctctggttgcattaatgcttataacgtgaaattgctgtatgtttttgttcctggcgtgagttaatacattatccagtcttcacagtaattctgatgattctttttttttttttaagtaagactaggaagtacgggtggtctatgaggtattttgctcaaactaatatatgaactgcaaaagattgaattctgcatgtgcccttatgagtttctaccttaaaagtcatttcattaagttatttacttgaagtacattacatttagagctcttaagccctgcagtaagcaaagaaccacaatttctggtaggcagaatgactttacacttactctgtgtccaataggacctttaggacctgatatcccaacaatgccagcatccccttcaggaccctagacatacaataagaaacaaaaagataaaatttgtagctctatatgaacattttacaaaactatataaatctatcaagaattgctcttttaaaaatggaatataatactgttgtgcatgctgaagaattcagaaggaagtgtactgaggcctacaatttacttagaaatacaccaatgaagggagagagggatacgtagatggataagcacaataatgccagcagggtaaaatgttaatggtaaaatttaggtaatgggtataggcatttactgtaaaattttctcaacattgctgtatgtttgaaaattttcataataaactgcttgggaaaagggatgaaagaaaacaaaatcatatcatatactaaaatttctgggaaaatgtatagttacataattttaaaaacagatgtattcgaaactcaaatatataaatatgtaccaactgaaattttacagatttaaaaaagctcaagttacagactatattatttcaacagctcttttatttctagatagctagaagactagaagaaagtatgtaaacatactttagggcctgggaatccttggaaacctgtcaaaccttgaacaccatattctccctgcaaagtgaattgacatgataataattattgtacaatggcagcctgctctgtagaataaatgcttggtgaatttctgaggtggtacatacaggctgccctttcaggccagggtctccacatggtccttgatcaccttgtgctcctcggtgacctcttttaccttgaattccaggttgaccaggtagcccttgttcaccctatgggtagaacaaagaaaagcgatctttacatcagaacatataaacatattggcttttgaatgaaacccaaatacaggcccatccttaggcccattccataaatacaaggcactggggaaatcaaattttgcatgttcatcttgttcaccaatattttccacacaagtagtatttaattataatgtaccagaagagtagcagtgggaaaaggaaattccagagattgtggtgatgtgtggaaagaagagggaagggggaacctataaaactagtaggatagtaaggcttgagaggggatagtgagggtgtggtatgtgtgggtgtgtttatatgtgatggaacttatattttgtttatttatttattttattttttattagagatggggtcttgctctgttgcccaggctgtagtgcagtgatgtgatcatggcttactgcagccttaaactcctgggctcaagcgatcctcccaactcagtctcctgagtagctgggactacaggcacacatcattgcacctagctaattctctatttttttgtagagacaggatctcactatgttgcccaggctggtcttgaactactagcctcaagtgatcctcctgcattagcctcccaaagtggtagaattacaagtgtgagccactgtgcctggccagaacttgtattttgaattgatatcatttttctgtgttttccctaccatccagagatgattcagctatctaataccagaaaaagagtagtctcctgaagtgtaaaccctggttttagccatgattatctttttaattccatcaataaaaaatttccattatctgtctccctagattcctttgatatgaactgtctttatcccctaaaagtcactttaagtacatacttaatcaacattattgaatttctaaaagtcaagtcttttttcattgatttttatttttgaaatgagagttgaaatatctttcacaccatttctaaaagtaaatttaggaatcaggtggattttagagataggttaatgaaaaacgatgcttggtagactttggccaaagcttctttaagattaacaaattatctctcactgtcttgagacaaagctatacaattttggggtttgacaaatatggatctttcttattgcaaattcaagcctaaaacatgggatctttacttcttttcctggctttagcatttgcttagctgctttgaattttagcacaaaggaatattcatggtataaacattaacagaagactaatattgtaaacagtaaacaagtaggtcatgattttcagtttacccacatgggtcagaaatctgaaaattctttagaagtggaactgggaaaatcaggttaagaggtaataatggtaagggtgccaatgtcttagtcttaggcttttatgaaagagctttagatgttggactaatttctaagttgtctgggtcaatcctgtatgagatatttctaaaagaggttttgtctggaaagtctattgacatgtgacagactccacacaataaatgcaatataagacttagttactgtcacattaactctaagaaacagtctgtacggttatcagattaattaattggttggttaggttcagagtcagaagaaaaggaattgtatttgagaaagtatttatctggaagtaaataagatttccctgttttggaggagaagacagatgacagagaaggaaaaagaacaaaaatgagtcaaagacatagcattttttaaagcatcactagtcctgggtcaaagagttgttatgacaaattacaggcactgtggctatcatgggagatggatatgtcaaaactacatactttctcttttcctaacgtgcttttactattagccaaattctattaaaaactattaatcttaccattctgtgatctagccaatgaactcagggccagaaaggatggccaatactgcttacccattggaacaaaatattaaagtacctttgggccttgaattcctgggcttcctggcaagcctgatgaaccctttactcctggaggacctggagccccagcaagacctgttcttcctgggccgcctctgatgccctaaataacacagataagaaatgaaaactgggaaagtttctaaaaagtcagtttagaggctcaataaaatgtaggaagagttgtgccccgaaaggcgtctgttaacatactgcccaggagttatcctgggcttctttcccagaagatgaaatgtttaaatacttttttaggaatactcaccactcacttgaaatttctataatttatgcaatgatcttgggtttttaaaatgaaaacactaaagcaatacgaagtccaccagtaccttcttacttataaagcctaggtgtgaagtatgtttgttgtgttctaacttttgtattatactctggtgtacatggcaactctaataactgctgaaagtctccttaagaagaaaattctattcctcaaccatacatgattccagaaaatttgctaaaaattgtttaactggaaataaagttaagcaagcaaacagtatatccttaaaactaaatcctaaatcaggttggcaaactacactttgcaaactaaattcagtccatcacctgtttttgtagatctcatgaactaagaacagtttttacatttttaaacattgaaaagaataatacttaaagacatggaaaaattctatgaaattaaaatttcagtatgtattaagttttactggacagtcatgctcattcatttacatattgtttagggctgcatttgcacaacaatagcagagctgagtagttatggcagagtttttttttttttaatttcattttaagtttccgggtacatgcgcaggatgtgcaggtttgttatgtaggtaaatgtgtgccatggtgatttgctccagctatcaacccatcacctaggtattaagtccagcatgcattagctatttttcctaatgctctccctctgcctctgtcccacctccaccaacaggccccagtgggtgttgttcccctccctgtgtccatgtgttcacattgttcagctcccacttataagaccatgatatgtttgattttctgtttctgcattagtttgctgaagataatggcttccagctccatctatatccctgcaaaggacatgatctcattcctttttatggctgcatagtattccatgctgtatatgtaccacattttctttatccagtctatcattgatgggcatttgggttgattccatgcctttgctattgtgaatggtgctgcaatgaacatacgcgtgcatgtatctttatgatagaatgatatatattgctttgggtatatacccagtaatgggattactgggtaaaatggtatttctggtattcctggactttggttccttaaggtcttcgaggaatcaccacactgtcttccacaatggttggactaatttacattcccatcaacagtgtaaaagtgttcctatttctctgcagccctgcaagtatctgttgtttcttgactttttaataattgccattctgaccggtgtgagatggtatctcatcgtggatttgatttgcatttctctaataatcaatgatgctgagcttttttttgatatgtttgttggctgcatgaatgtcttcttttgagaaatgtctgttcatgtcctttgcccactttttatttttttaattttaattttattttattatgttttttggagacagagtcacgctcagtcacccaggctggagtgcagtggtgcgatctcggctcactgcaagctccacctcctgggttcatgccattctcctgcctcagcctcctgagtagctgggactacaggcacctgccactacatccagctaatttttttgtatttttaacagagatgtagtttcaccgtgttagccagaatggtcttgatctcctgacctcgtgatccgcccatctcggcctcccaaagtgctgggattataggcgtgagccaccgcgcctggccctttgcccactttttaatgaggttgtttttttcttgtaaatttgcttaagctccttgtagattctggatattacacatttgtcagatggttagattgcaaaaattttctcccattctgtgggttgtctgtttgctctgatgatagtttcttctgctgtgcagaagctctttagtttaattagatcccatttgtcaatttttgcttttgttgcaattgcttttgatgtttcatcatgaagtctttgcccagcctaagtcctgaatagtattgcctagattttcttctagggtttttatagttttgtgttttacatttgtctttaatccatcatgagttaatctttgtataaggtgtaaggaaggagtccagtttcaattttctgcatatggctagccagttcccccagcaccatttattaaagagggaatcctttccacattgcttgtttttgtcaggtttttcaaagatcagatggttgtaggtgtgtggtcttatttctgagttctctattctggtccgttggtctatgtgtctgtttttgtatcagtaccatgctgctttggttactgtagctttgtagtatagtttgaagtcaggcagagtgatgcttctagctttgttctttttgcttcagatagtcttggctatacgggctctttttttgcttcatatgaattttaaaaaatagttgtttctaattctgtgaagaatgtcaatggtagttttatgggaatagtattgaatctataaattactttgggcagtatggtcattttcacaatattaattcttcctatccacgagcatggaatgtttttccatttgtgtcctctctgatttccttgagcagtgttttgtagtactgcttgaagaggtcctttatttcccttgttagctatattcctaggtattttattctctttgtagcaattgtgaatgggagttcactcatgatttggttctctgcttgtctgctgttggtgtatgggaatgcttgtggtttctgaacattgattttgtatcctgagactttgctgaagttgcttctcagcttaagaagcttttgggctgaaaagatggggttttctagatataggatcattcatctgcaaacagagacaatttgacttcctctcttcctatttgaataccctttctcttgcctgtttgccctggacagaacttccaatactatgttgaataggagtgaggagagggggtatccttgccttgtgccagttttcaaggggaatgcttccagcttttgcccattcagtatgatatcagctgtgggtctgtcataaaaggctcttattattttgaggtatgttctgtcaatacctagtttattgagagtttttaacatgaagggatgttgaattttattgaaggccttttctgcatctactgagataatcatgtggtttttgtctttagttctgtttacgtgatgaattacatttattgatttgtgtatgttgaaccagccttgcatcccgggggtgaagccaacttgatcatggtggataagctttttgatgtactgctggatttggtttgccaggatattattgaggattttgcattgatgttcagcaggaatattggccttaagttttctttttttgttatatctctagcaggttttggtatcaggatgatgctggcctcataaaatgagttagggaggagtctcttcttttcaattgtttgaaatcgtttcagaagaaatggtaccagcccctcttggtatacctctggtagaattcagttacgaatccatctagttctgggtttatttttggttgataggctatttattactgcctcaatttcagaactcattattggtctattcagggattcaactgttactggttcagtcttgggagggtgtatatgtcaatgaatgtatccatttcttcttgattgtacagtttatttgcatagaggtgtttatagtattctctgatggttgtttgtattttttgtggggttagcgatgatatctcctttatcattttttattgtgtctatttgattcttctatcttttcttctttattagatagctaatgatctatttcatttttttttttcaaaagaccaactcctggattcgttgattttttgaagggattttgtgtcttggtagagatcttatatggcacttccattgctttgtactgttgcttggtgtactacaaattgcagtgatgcagttatagtgtttcaagtggaacatatattactgtgacactttattttacgtattaccagtgcacatgctatcatatcaaagcaagaaaagaaaagtggacttcgaatattgtatttttaggcaccatggaaaatgaattttcttattgaattagatggcaaagccttgtatttactatgtaatattactatagctatgcttaaaaattatacagtatatatcaacattatcagactaggcacataatataatatttctacctcacaggaatgcaacagtcagaaaaattggaaaatgtaacatggagtattttatcacagcagaatttcttcacaacaaaatgaaaatgaggctgcaactgaagtaagtttctgagtgttcacttcatttgttagcccaataaggaaaatcccttattgatgacttaattaaatcacatagcaaaaatacacttatttaagattgttagctttttggcaagaatagctgcttgaaatgttgaggacactggtacagcatcaacaatcaattaaaaaagaaggttctttctttttttcttctctccctaccagcacggcctgttggttcttgatgagtcaatagaaattagcaatactgctcagttgctcattcaaggagtcaatgctgagtatgggaaggagtcaatgctgagatggaagaattgtataaatagtctgtggggtaactgcaagtgagaatattttcaaagaagtttaaaaaaaacactaaatcagtacaatcttctgtggattctgctaagatacaatacaactgacagctatggatcaaaaaaagaattattggataaatttggaaagcatatggtgggtagattttctgaactcaaacagtttcagtagcatatcttagacctagatgcaataaatttccatatttcaaaatcgatttgactgtgcacttgaggagtttccacctagcttacaattggaaatgattaatctacaaggaaatgacatgctaaaaggcaaaatcaagagaacctaatagaattctggatattgttttcaagcaatcagtatattcaatgaaaatcatacgctcatgaattgcagcatttggcagtacctatctgtgtgaaaaaaattttcaaagatgaaatatgtgaaatatgcaaagtctcattacaggccaatattaacagcattaacaagtgcagaaaattcttacaatagggaactgtaataagatcactttacaggaaaggcaagctttaaaaacaaaattcttatgtatagcaccctccccaataaaacagaaacagctgaaaacctaaagaaacccacagagaaagcagattttaataagctaagtgttatcctatacaaagcatgacatttttctcattactagtcttgcattacaaaatttttacttaattatatttttaatttcatgaataaacattttgtgaacagtttctctcttcttacataagttcacaagtaatacccttgagtttgcttcctgcaaatactaaaatttattcatatttatatgaatatttacagaaatatgttttcatatttacagaaaaagtttgttgacttctcttctaggaataacttattttctgagttgattcctaggatattaaattgggttattcaatagtttctccatgtattcaacaaatatttattgaatatcatctatgcataaggaagctaccatgggaatccctttaaaaatatagatataaataatatatggttcttgtttttaagaagcttaaaattaaatgaaaaagatgagaccaggtgtggtggctcatccctgtaaccccagcactttggtagaggctaaggtgggaggattacttgagcccaggagtttgagaccagtctgggtgacacagtgaaaccccatctctaaaaaaaaaaaaaaaaagaaaggaaaaaagtagttaccagggcatggtattgtgagcatctgtagccttagctgcttgggaagctgaggtgagagaatcgcttgagcccaagagttcaaagatgcagtgagccatgatcatgccactgcactctagcctgggcaacagagtgagaccctgtctcaaaaataaacaaataaattaataagaaaaagaaaaacaaaaaacgaaatgtgatggaatgtactatataaataattataatgacagcaaaagttttaaaaaaattcctaagaagagagatgtaatgtaaatacctgagaggttctgaggaggggaagttacctttagtggtaatcagaaaagaaattagtgagaagaaactggatcatgatcataatataaagatattgcccttaaagttataaatgtggtgggagagatgttttggctcaagacagactaaagccatttctgtggaaggtctggttgagagaatggtatttaaaaagtaaagtcaattttgaatttagtaccaaagcattttttccttttttttcaaataacattttcttcatattatgtcatcacatattttattattttcttgcttatggtaaaagataattaagtatatttttaaaaattatcctttctaagtagattttcctcacattccaaaactcactaaaataatgtattttgtatctaaggttcatctccaatcctgggtgcttacagggaggtacatataggatataggttcatgttcctcagcttgacctttaagtctttttttgtcccaactatctctcaccatttatctgcgttagtggggctcaatattttaaggaacaaattacaagggcaaaatcctcacagaaggagaaatagaggaagagagaggaaaagaaaaagggagaaagagaaggaaagagagagagagagaagaggagggaaggaaagagaggggagagagagagcgagagcgagagatccatgctgtggacttaggattcaggtgatgtagttcttccaagttgcttgtgcctcatcctaagtgtattatcttatcctgtttctttcccctggtttctatgtgttttatatttgttttaattttccatgagcctttctgttccatacctatgggatacattatctggtagtgtactttgcacatgaatgatgagaaccctggagtcatgagatggtgccattttagagatcatcaatacaaatgatagtcatctgagactttgggatttaaattttcaaaaatgttcagaaaagacataggtgttataccaatgaccaggtctctaatggggatatgacttaacaggaaaggcaaattttaaaaacaaaattctgatgaatagcaccctccctaataaaaacaaaaatagtataaagacctaaagaaacccgaagagagagcagattttaaaaagtcatatatacaagatgaaagaaagggcatgtaagcagcaaaaaaaataaagtaaaaaacaaagtaacttcagagttaaaccaactgaaaagttaagttatagatgtagatcgtgtgagaatttttttaaaaagcattaggttgtcttgcaagtttgtgagcctcttatctccagatattttatagaggtaatggatattttagggagacgcatcattagaactgattatcctagatgattttaagatacctcaaaattgcataattctaaaatagaaccattttgcctcactttacttataattctaggcaattttaaagttcttcattttctaatataaaaaatgtatctttcaggtgatacatgacaatggacattcagaaactactgaccactcttgaagtcaagatgtacttttgactgagaataataaggagcacaaaacttgtcattagggttaactgtaaactagcaacttcattttacttgcagtgccatcagatatttaacccagtagaatgaatatagtccaagtcatttactatgcttgttggtttcttagagagaaatttgaggatgatagcagagtgttctgttcaacgttccaaacaatgtttcatacaagtaaagaacaaacatttcttattacacagatggctgattaattttgtttgcaagagaaacagatgctaaccctaggcattctttccagtgtcttctaaatgatttgtctaaaacaattcagcctatgttaaatcattctgggtaaattttaaaaagtaaatataattataattattattaactttggtcagagatgccaaaaatcaatgaacagcttacatgtgtattaaaaattaatataattataagagtacatggtgtcgcatgaccagagacttcctttattctcagataggagccagtctccctaccgaaataagttttaaacctagcaggaaagtgttgtcagttttgacaggactgaaacccatggcttcctaagcctttggactctaaagaaacaagtacttcgatcagtaatgacaacaacaacatcaaccacaactgcaagagttgctttttattgagtgcattccatttgtcagaaatgaatagcattatggtttgtattattttatttgatctggtgtcagttaaggaaagaaggcattgcttttcactttgacttccctctgggaaaaggaagaaattgttttagtgcaagtctgccttcattttagaactgaatggaaagatctgggaaggaaaatggtgctatatgcacacatttagaaaaaagatacagagacaaattttggaatgatgattacttatttgtacataatagtgaaacataccaaagaaagtgtcactctgttattcccccagctccttggcttagccgtcatattctcattaggattgaaacaaatatattaaaaaataagcaataaaaaataaaatttgttaaatccaggcaacgataaaaatctacattctaaaaatagctaaaaatattatatttaaagttatgctgagtgaaattacaaatatttcgaatatcaattttattgatttctcatagtagaatgacaaaatgacactgaacttcatattggttgatatttttctttaaagtactaccttaacatttttctaaaaaaagttttttcctttctcttctgccaggcaccttatgtgtacagagcattatgtttatatagttattaactatgtgagaagataataagaaaaattaatttaaaattaatttactttctgtagtacaaatataatatcctagattattaggcaatgtaagtactattttttttcttaagccagcaaacccagaagttatataaataatactttacttcctttagtctgagcaactcaaaacacttctgtttaagtaggaatttctcgttttatttggtttactaaatatatcccttcctgcaaaggattggtgtttaaaaatatgtgggatggtaattattaggtgattatatgcaaggctacattttacataaataatgtagcattcataatattttcctgccgtgccaatcataagtaatgtagccaattgctagaaataagatttatgaatgagctatatactaaagttaggaggtaattttagttttgaatttctaaacatattaaagcttatggaactgagagtacagctgaggcaggtcgtaaggtagtgaagacaggtctgtttgactcacatcaagggtatacaatctcttgctcaaccttaatgaatacaggtatttcaacattgttttacttcacagaaattatttacaactgatgttttatcaatcctaaaaaatagtgcaaatgtcactatgatatttgacaaaataaaggtattttatgaaatctcctttacccaggtcttgacatccaatcacaggactaacagggactgaaagaagatgtttcatctatactttgactcttagatatgtctgggttcacatcattatagagaaataaatgtctatccttttattcaaaaaattacaaataatctactcatactatcttatttgattctcccacaaccctgtgaacacaccaaactccatgagggcagttttttgaccatgattaactgctatattccctaactcctggctcttagtaggcacgaaacaaattattttttgaatgaatgcatgtaagcttaaccatttatatttattattatgaaaagatgatacccaataaatacatgcagtgtactatgcattttacatacaatatttcatttgattcttataaaaaccatatggattaagtataatactattgtactcattttataaatgctgcttaagatgtcaaatacctatcgcatctagattttaaacccaggtctccaagatcctaacaactatgcaaagaacattcaattcctggccgggcacggtggctcacgcctgtaatcccagcactttgggaggctgaggcgggtggatcatgaggtcaggagatcgagaccatcctgggtaacatggtgaaaccccgtctctaccaaaaatacaaaaaaaaaaaaattagccaggcatggtggtgggcgcctgtagtcccagctactcgggaggctgacgcaggagaatggcgtgaatctgggaggtggaggttgcagcgagctgagatcgcaactactgcactccggcctgggcgacagagcgagactccgtctcaaaaaaaaaaaaaaaaaaaaaaagaacattcaattcccaaatgtttattgatcttctcctatgggcctgacatggtgctaggtgattctacaggactctttggagagaaagaaagacaacatccatgctctgatggaggcagtgtactgagcatccaaaagttcagagcagacaagctcaactccgactagaaaggtgagtgaaggaggtaatagttcagttaagtcctaaaagatcaccataaagttagagggaaaaatggaagagctttctaagcagtggaaataaagtacacaaaggccagaaagtgggggaaataatagaattttgggggctaagtaaataggcatacttgaagaagcatagctctgaaactaagatgcctggtttgaattctgattggattacttgttgtctgtgtgaacctgcggaagttatttagtctctctcggtctcagcttccttttctgtaaactggatataacagctgtctctacttcatggaggttttgtgagggttaaatcacttaatacacatcagcacctggaacagtgcctgggatacagtaagcgtttaataactgttagctgtgattatgactgaaatgcacagcacacatcagaagcaaggtagaatatatgtctggaaatgtcaacagaggctagaccacgaagaaacatcattccataaaaagtataaaccagccgagcatggtggctcatgcctgcaatcccagcactttgggaggccgaggtgggataactgcttgagctcaggagttcaaggctagcctaggcaagatggtgagatctcatctctacaaaaataaaaaacaataaattacggaatgtggtggtgcatgcctgtagtcccagttacttgtgaatctgaggtaggaggatcacttgagcctaggtgttcaaggctgcagtgagctaagatcacaccactgtactccagcctgggtgacagagagggaccctgtctctattaaaaaaaaaaaaaaagtatgaactttatctgatcaggagtcatggaaaattcaactaagaaagttaaatcctttagcagatatttcgttttgttgccaatacgctgccaaatacactgaactttgttgctctggaagagttcctaatgagtagaaaatgggccaaaacaagcggcggggttgggggtcggagggagggaagaagtaccaatcaggataagccataactgaataatcaacctcttaataatgagatgacaggatttgctaaatgtaggtctggacaaagaatgtaggtctctttctccaaaatactgtgaagaaaaaagtgtatcttcttagaaagaaaagtttctttcgtgtgactagcctatgagaacacacagcccagatgggtggcagggtagctggatttcctaatagaagcttcgatggtggtcctactacaaaggtgctgatgaagtgtgtttttcttccttatactggacacaatccacaaatggaaaattcaggattttcaatgttcctttaagacaagaaactcattttagacaacacttatgcttgtgttcacctggaaaactgcaaagtcaagattgaaaggccttgatttgtccttagtcaagtcgttagttttatttctttccctcttttccaatgaccagttttattagttacagcaataaaaaaataaaaagactggtaagcattccttttggtgataaatggatttatgatatttgcaaggaaaagttgttttgctttttcctaaatgactgaggtactatgcttgtacagaagttgaactcgatgaaaacatcatggtagactcatttactacagatgtgctaagttgactggcctcaaaacactcattttcacagaaggaaattcacacaggcaacggtgagcctcccctgtactgtccctcagttacagtcacatgatcttgaaaaaacattgaaactgcagagtgaatatgccaagaattctttaattccttggccacataaaagaaagaaagaaagaaagaaagaaagaaagaaagaaaagaaaagaacattgtttaggaaaatcaggcagttgcataatgctaaaaatcccagaataaatatttttctcagtggaaaaacccagcagtctttaaaggtaagccaaggaacaccatggtgccatgactaaaaaaaaaaaaaaaaaaaaaaaaaaaccaatggaaagatgtccttatcctcggttgaaaatattccaaggaacttgctagtatttagaaatggtcttatttcctcttaagtagtttttctattaccacagtaggtttgagaaatacttctcttagaaatcactttccctaatgcccagttagccattactaccttgtttcactgaacaacagaatgattccttataaagcactataattctaattccatatcaaatattccacagagagcagagacatttatagaaaagatttccatgtacataaataccaactgcatgtgcaaaccttggggttacaaagggatcctcaagagaaaattattttatttttattttgatggatacaaaacatttcaacacatgacatcctaatattctaagtatgcatgtaaaatttgtctaacttgttctgtgaaaatgctaaaaagtagcagatgatgacttatgatctggtagttaattgcttgctaacggcaacattagttaccattcaacttcatggccctaggaggtatgttgcaacagtatttaacattactgtaatccatttgtttctttcaaagtgcaatgagctttctgtaccagtcgtacataaagggacagaatctgttctatggctcagaatctgtttttataaacaatggttcccaattagagtaacttaggaagaggagctagaatatgcaggttttgttgtctaattcatactcagattttcccttcccttgactgtcttcaacctctccatatttactaggtccttctgatgagcatttaaatgtcaggattctcacatttaaaaataactttctactttaaatttattctctggtcattgccctattttctccttcagaaccaaatgtctccattgagtggtttgaatatcctgattttctcactgtccactctctctcctcaggaacgtcaatcctattcctgcccccaacctgacaagattctttgctaaagttactgatgacctccacttactaaaatacatgaacataatttcattttattagatctgcatattagtcagagttcttacttgcaaataccagaaactaatactggataataaaggcagaacagacattgaaaacacatttggtagctcatataatcacagataaacctggagaatcaggtttggaaaatgagcagaattaaagtgatgtcaggaagccagaatttgaacactacagcgtgtactacatctgctgttggacattgaacactattactgatgcaaccgtcatccctggaaactgggagctgttgatgttactgccactgccaccacaacagactctccactgtccccgcctctgtgtatcactaaatccccatttgaagatgaatataactaattgatcaggcctaggtcagagcatgcatccttgtttcaagtgacaaggaagtaaaagtttggaacttctggctactgcagtaaaagctggcctttcaccaaaactcaaaaagagggatttttaaattaaaaaaatgggataaagatgctgagtagcaaaacaaacacaaaatgcatctacaacatcaacacaaaaaccccacaaaaaacaaaattaataaaacaagtgtccaacacagtttctcgagattattagatatgttgatgaggttctcctttttgaaatattctttcttaagtctccatgacaccacattcatttttttcttacctattataatcactcctttcagtctttttcctcctgtatctgactgttaaatgttagagttcctcacagcttggttctggacctccttcccactgttcaacaaaatttgtgtttgttttctttcatttgctccccagatccatttaccaccccttctctatcttgcaacttgtcctgcgaatctgactttcaatgcactgcatcgctggggttctcttgacctctggcttccagttggggttggccagtgtgatgcaccactaggatattgaaaagtgagaggagagaaaggtaatatatttatttctcccatttccttctgtctttggcattccataagtggttgggttattctcaactatagctcctgtcagatgcctctttccagcagttcctgatctcaacttgattctagtaacatcatttcttccctttaccatttcaggtctaaggacagtaatggcttcctactgttgacagtctctgggtttcccagcactctttgttgacttttttaaccctttctacatttctgtaggtagtttcctcaaaattccaattgagcattccatctgcttcctaacaggactctgactaaagcatgcatgtgctgatgactcacaaattcatatttgacctcctctctcagctctagctgaggatatttaattgctaacttaatatctccacttgaatgtcataatcttgctcacaaaatttaggcctcctataatatttgctttttcagtgacgggcagacatcacaaggtattaagttggaaacttgtgcaagttagaaatttggaagttacccttgatatctctctctctccctcatgtctcccaatcaaatatcaagtcctactaaagccacctcctaaatagtacctaaatccatccacttctttccatttacacttcaccagtctagttcaaaccgtgaacacctatagcctggagtactgcaaaagtagtcttattagtcttctgcatcttgtcttgtccccttccaatccatttactatactgaagccagagggaatccattaaaaatgtaaaattgaattggataatgtctctcctgagcttaaacctcaatgaggtctactctctttagataatgctcaattaccttaatacgtccttcaatagcctccatgatgtggtcattgtatacctcaacagcatcaaaccatatcactctacaccttgctcaccaaactttagccgtactggtctttttttgattctttaagcacatccagttcttcctaactttgcatatgctgtggtctctgcctagaatgtttctttcctgctttctccacctataattattattattcccaatttacaaactccagttatcttttggtatcatctctctcctcctccccactcatataatatatgaatttatatatgtagataagatatttatctctatatacctatttcactgagtataattgacacgaagtaaatttcaaagtatataatttgataaactggcataataaatatacctattaaaccatcaccactatcaagataacatatccactacccctagaagtttttcctattcctttgtaaaccctcctttccacacctccccacatgcacttctatctcctgaaaacccgattagctttttatcattacagattattttgaaatctctacaattttatacaagtggaaccaaacagcatgtatctttttgtctgtttttttccccactttgagattcattcatgttgaagcatgtatataattctttttcactgagactaatatttcattgtatacatgtactagaatttatttagccattcactttttgatggacatttggttcattcctagttttgggctattacaaagaaagctgctatggccattcatgtgcaagtttttgtgtggatatatgctttcatttctcttggctaggaatagaatggctgggttatatgttagaaatatgttaaacatttttagatactaccaatatataagataattgacatcttaacaatatagaggctgggtgcagtggctcatgcctgtaatcccagcactttgggaggctgagatgggtggatcaccaggtcaggagtttgacaccattgtgaaaccccatctctactaaaaattttagttagatatggtggcatgcacctgtaatcccagctactcaggaagctgaggcaggagaatcacttgaactcgggaggtggaggttgcagtgagctgagatcatgacactgcactccagcctaggtgacagagcaagactccatctcaaaaaaaaaaaaaaaaccataaacaaacaaaacaaaacaaaacaaaaacaacaatatagagtcttatgatccagagacatagtatatataccatgtatttaggacttctgtaatttccctcagcaatgttttatagttttcaggatataggtttgcactttttttttttggtgagaattatccctaatatttcacattctgatactactgaaataatactgctttaaaattttccatttctgattgttaattgctagtacatagaaatacaattaattttgtatattaatcttgcaactttgctaaactcagttttccgtagattttggatattctactagacaatcatgatttctgcaaataaagacagttttacttcttctattccaatctagacatcttttatttcttgttattacactggctagaacctcattgaattggctacaacctcattgaattgactagaatttccagtacaatattgaatatgtcatataaatatgagaaggtaatacatatatctgtgggcatataagacatcagaatgtttgcctcacaaagacctacattaaaaataatttttggagaaagcattgaaataataatagaaaaaattcaggagattctgcaaagaatattgaaagtattggttatcaaatagcttaattaagtttactatttaaaaaggagtctagaaataacagaaataaaaggagaaagtaaatgaataaagactaaaagtgaaaaattgaggcaaaatacaaaaatgatgaaggagaggagtggtctataaaaacaaagggatatgagaatatgtgaaagtgttttgttagagggaagatacaggtagtgatacgttcaacaaatcaatagatttaaataaatacacacttggttattatgttcagcagaactgcacaagaggaacaacaaaagaagtaatttttaagccagcagaagaaactttagtcatccaatggaaatgaggaaagaaggagaaataaaccccaaaaggatagtacaggtgcattagtccattttcacgctgctgataaacacacctgagactgggcaatttacaaaagaaagaggtttattacagttccacatggctggggaggcctcacaattatggtggaaggcaaggaggagcaagtcacaccttgcatggatggcagcaggcaaaaagagagcttgtgcagggcaactcccgtttttaaagccatcagatctcatgagacccattcactatcacgagaacagcatgagaaagacccactcccacaattcagtcatctcccaccaggtccctccaacaacatgtgggaattatggaagctacaagatgagatttgggtgggaacacagagccaaaccatatcaacagggcaaaggaaatacagatttcagatggcaaatactcttttttttttttttaggattttgttttgtcacccagtctggagtgcagtggcatgatgatacttcactgtagcctctaactcctcatatcaagcaatcctacttcttcaatctcttgagtagctataggcacatgctacaacacccagacaatttttaaattttctgtagagacagggtcttgctatatcgcccaggttggtgttgaagtcctggcctcaagaggtcctcttgccttggtctcccaaagagctggggattacaggcatgagccactgcacctgggtggcaaatattcttaatgaagaaattttagatgtattccctgtaacatctggagcagtagaagaatttctacgattgctgctattgtttaaaataatattcaaggtcacttgcatggaaagtgaaatggaaagaaagaaatacatggaaagaaaaataaatgaatctaaggaaagagataatgtaaggaaggaaataaatctgccattatttgaagatgatattatctacctaaaagcccaatagaatcacaacagcaaattatttgaaataaaaaattcagccatattagactataactgatacaaatcagtagtgcttctttaaatcagtaataactacctagtaaatagaataaaaataagaatataaaaagcctttactgagtggcaatattgcagatttataaagacaaaaaatatggagttttagactgcctttgtcgttatgtgactgtagaaattacttaatttctcagtgcctcaatttctgcatctacaaaataagaaatataattatgcctacctcatggggttgtaaggattaaatttgttaatacattaaaacacttatggtacgtgggcaagttctaagcattgtatgaattttgccatgactattatgaagaaattctattagaaaatgatagaaataggccgggcgcggtggctcacgcctgtaatcccagcactttgggaggccgaggtgggcggatcacgaggtcaggagatcgagaccatcctggcgaacatagtgaaaccccgtctctattaaaaatacaaaaaaattagctgagcgtggtggcgggcacctgtagtcccagctactctggaggctggagcaggagaatggcatgaaccaagggggcggagcttgcagtgagcggagatcgcgccactgcactccaggttgggcgacagagcgagactccgtctcaaaaaaaaaaaaaaaaaagaaaatgatagaaatatatatttcctccttttatattaaataactaaaatgataagatacaaattttctccaactaaatctataaattcaagacaaatctaataacaattcaacctttgttttatttttagagaaactcaacaaactgaatctcaaattatgtggaggaataaaagtctgtaactagctaatcaaccttaagaaaagaatttaaataagggagacttgcccactacatataagaacatactacagagccatagtaataagaataatgtgatgatacaaatagaccagaggtcagccaatgttttctgtaaaagggccagacagtaactctgttagactttgcaggccatatggtctctgtgtgaattattcagttctgctgttgtagtgcaaaagcagccatatgtaaataaattactgtggctgtgttccaataaattaatttatgaataccaaaattcaaatttcatatgtttttcacaaaacattcttcttatttctactttctaccactaaaaaaatgtaaaaaccatttttagctcatgggccatacaaaaacaggctgatttgttcaccaaatgtggtttgctaatactggaatggactgctgatattgactcatgcataaatgagaactgttaaacaagttggctggattttatctgtttgccttttgagatccagtctccaccctgctctacgacccagcaggctcctttactctagctgttggccagtgccttaccaaaggggtatgaatgggaatgaagtcccctgtagtcacaaggcagatatgactgagaacccaacccactgtaaggcttgcagaatttgcatattaatacatcttcatcttcaactagccagattctatgctaagataagagcactggtggagaaagagaagaactccaagacaagaaatggggacatttgaacagacatgggcaagactaagaactctgaacctctaatcctgcttaaccttcctggcttgtggaggcagcccctactcaagtgcctgggaacaccattaatagtccagtagattggcaatttgaagcctggactcgattgtggcctacagtcaatgaggttgaaatgctataacttccctcacaatagaaaggggttcaaaggcccaggaagatgaaaatgtggagataactctattattgcaatcgaatcagctaccctctaaccacagcccctggaagggctcaaagagcattctttaccacagagttaagaaacatcattggaaataggttctctgatataaatgggaacactggaatccctgagtggtagaatccaggtcatagtgctttgctatcagagaaaaggtaggagcaattatcacaataagctacaatgatggagtggaatcagactgttttgcacagatctgtggtgatggttaattgaacataggagacataggaattgaatataccatagtgtactagaatatattaatatacaggtggaaaaattgtaggtcttatagatataaatcttacttaagtcactgtgcttgggattcatgtactctcactcagttctcagactcaagccagttcctagatcagaatcccttgattgagaaggaggtaggttctctttgagaaaaaacactgcaatgtggtcagagatgtatactacaactcctcccctaagtattcttgagagagacctatggtcatttactaggtgactgaacactgggaaaagacaaattccaagtctttctagagctgttaagatactagttataacctgatgataatccctggaaataaacactgtggtcagagtggaagcttacgagggtcaagtgataaatggagttttcatccaattccatttccaagtgggtccaataaagactgtgagctcagtttttattttctcccctccaatctcagagcatagtgaaacttcctaactataaaggctactactatggtaagatgggaagacacaaatgaatgttcctacaactatcccttcctgtcccctcctcaccaatataaatctaatgtaataacacatccttgtgaaaaactgtacatattactcccatccctgtggaaaattgtacatattattgccataaaggcctgaaagatacaggggtagtgattcctactatattccctatctgttttactcatgtgtttggctagagcaaacaacaaataaacctgaagaaagtggtagtgtattacaaacttaacgggttgggggatgatgccaattacagctgcaggttctgatatggtatctttactaaacaatatagccactggcaacaacagctactgacctagcaaaaatatttcctatccacattcttatcagtaaagataattggaagcagttttcttgccttcatgtggcaggaaaagcagtatcccttccctgtcttagctcagtgctatgtcaactcaatttgcttctctgtcataaaacagactgagcagatatctttatattctggatatctcacaaaatatcattcaggtccattaaactggacttggagagtagaaaagaacaagcaccctaaaggtgtaccagaggatagaatttaaaatttcaggggcttgataaatgggtgtaatcacccaatgggttctccctgcccgttgcacagacaaaaataaattcactgagactgcagcattgcagtagagtttaattgatgcaaggctggcccacatgggagaactggagttatcattcaaatcagtctccctgaaggcttaaaggctagggtttttatggacaatttggtgggcaggcagctaaggaatgagtgctgctgattggttggggatgaaatcacaggggtgtggaaaactgtccttgtgtgctgagtctccctctggatggggccacaggatcagttgagtcatgattcatgagtctggtggagtcagtcagaaaggtatctcaaaaaacccaatcttatgttctacaatagtgatgttatctatagaagcaactgggcaagtcgcaaatcttgtgacctctggccatataactcctgagcagtagggattatagaaactatacctatcttgtaatcttggccacatgactcctgagcagcaaggaattagagaaactaaacctacatgttagtagagttcaggtctctcccataatcctattcttgtgggctttaattagtcttacaaggcagttttcattccctgagcaaggaaggggttaattttaaggtgggactattgtcattcttgctttcaagttaaactataaactaaattcttcccaaagttagcttggcctttgcccaggaatgatcaaggacaacttggaggtcagaagtaagatggagtcaattatgtcagatttctctgactgtcataattttgaaaaggcagtttcatgggtgaagttccaggaataatagtttgggggcacatcaggatacctcctccaaagtagagataaattgttgtactttgcactgactgaccatcacaataaaaggggcacagttctggtgagcctctgtggactttggagtcaacttatatcagatttgggtgttctgctccaatccattttcttagtaacctgtaaggttgctgttttttttgtttttattatggagatatatatatatacacacacacatatatatagtatataatattatatatagtatataatattatatatatataatcattttaaccatttttaggtatgcatttcagtggcattagtacatttacattattgtacaactgtcactaccatttatctacagaatttttatcttctttaactgaaactctatactcattaaacaataactctccattatccccttccaccaaaccctggcagccccattctactttctatctctctgaatttgattatcctaggtgaggaaggaggtcagcagcacttgttttccaagaactggctatgacccctgctgatcaaaacaggatctggctaaaatagggtgcagtaaagaaactgaccaaatacagctaaaaccaaaatggtgaaaaaagtgacctctagttgccctcagtgctcattatacactaagtataatatattagcatgctaaaagacactcccaccagcaccatgacagtttaaaaatgtcatggcaatggttggaagttaccctatatggtttaagaggggaggggaacccttccttggttcctggaatgccccatcccttttctagaaaattcacaaataacctgccccttatttagcatataattaagtagtagctataaatatagctagccagcagtctatgagggctactctgcctatggggtagccctgctctatctatggagcagccattttcctatactctgttgctctgataaacttgctttgtgacatagtttggatatttgtccctgcccaaatctcatgttgaattgtaatccccagtgcaggaggtgggggctgggggagttgtttggatcatgggggtgagtccctcatggcttggtgctgtctttctgataatgagttctcacaagatgtggttatttaaatgtacatggcaacaccccctctactctcactctttgtctctcttgcttgttactgctttcaccgtgtgatgtgtctgtccccacttcaccttctagtctccttaaaagctgaataggttccagcaccatgcttcctgtaaagcctgaagaactgtaagccaattaaacctctgttctttataaatcacccagtctcaggtatttctttatagcaatgcaagaacaccctaatactctttgccttcactttactctgtcagctccctcctgaattatttcttgtcttcctggaagacaagaaccctccctggctgagccacagttttggggtttgccagtatcataggtctttcatataagtgagatcacaatattcatccttttgcgtctggtttgttacatttagcataatgtccttcaagtctcatccaggttatagtgtgtcagactttcattcctttttaaggctgaaaaacattccattgtcaattattccaatatattccaaaaatattccaatgtcacattttgtttattcattcaatcactgatagacatttgggttgtttctactaactattatgcataatgctgctacgaacattggtgtaaaaatacctttaatgatgaatacattaatttgcttcactctagtcatctttttactatctatatgtatcccataacttcttattgtatatcttaaatttatacaataaaatttatttaaaaaaatcttttacattcctgccgtcagttcttttgcatatatatatacccagaagtggacttgctggattatatggtaattcaatgtttaattttctgaggaactaccatactggtttttacagtattgtgtcatttaccttcccaacagcaatgtgcttgtgttctaatttctccaccatcttgctaacacttgttattttctgtttttgtttgtttgtttatgtttgttttataatagcatcctaacatgtgtgacgtgatatctcattttgcttttgatttgcatttccctaatggtagtgatgttatatatccttccatgggattactggtcatttgtaaatcttctttggagaaatgtctattcaagtattttgccaggttgccagttttgagtggaccctgaagtaagaaaaggctctgcagcagattcagggtgtaagttacaatgctattaatatttggacctcatgactgagaaactctaattatatcagaaggctctgtagctggtagagatgccatatgagccctttggtaatctcccataagagaaaccctgcttatatctgtaagattttggagacaggccatgccctctctgtcaaatgcaatttaccatttggaatacagctatgagcttgctccgattgaaactgaatgactgaacctggaatgtcaaatggctacgctctcgttctctgttttgcccattatgaactcggtaataatcgaattcactgaaccataaaattgaatgtataccgcagcactctattcttaaatcaaaatggcatgtattgaaactgggccctagcacgtctggaaagcacagacaaaatgtgtaagcaagcaattcagatttccatgacacccgttcccattgctttgacattgctccttcagctttcctagagaattccctttaccagttaatggaggaggaaaaacctcaggcctgatttttggatagatctgcattgattgtcaacatcagccagaagtgtacagtttcaggctgcattagagcttgaaagatgttagtaaagtgaactctttccagtaggtagaacttgaggcaatacatatagttagaaggagagatggcttgagatacggatctacattaattcagagagcactggctaagagtttggccagctggtcaggcacttggaaataatgggtttgaaaggctaatgataagaaggtccgaggaagataaatttagatgaacttctcaaaatgaaatcaatgtagagttaattatattccatgtagatacttaacagacagcatcctctatagagtaggttctcaataatcaggtaaacaagatggacctttagtggatatcagtcaacatttttccatactaatcatagtggttgctcaatgggcccactaacacaaatccaacaatatggacttttcttcaccaaggttgatctggctaccacccctggtgactgccaaacctgccaaacgtagaggccaacattgagctcccaacaaggcaatgctccctgggagataagttggagctataatagctgcaattgttctcacaggggtagatacctattctagacatagatttgctattctaccaaaagttcttctggtagttaaaatgtagttgatacacagcacgaattatatgtcagaagagagagagctgatatacctatagcaatatgaatgtatctttaaatcccagtgctaagtgaaaaaaaaaagatgcatggtctaatatcatttccataattaaagatatgcataaaaacctgtagtatatttttgggacagcatacagataagaatatacattaaaacatataaaatagtggctattttagggggaggggaatgagagtggggataaaaagaagtcagcctaagagtaggtccatgcaaaaactgaaggatgacaatatgccataaattcattaatatgattatcccaacaactgtgtacctaaggtaaaagacagagggagtggaaaaccttaaagaaaaaaaaaaaagaagccaaagctgaaagacctttttttttgcctcctttggcatccaggactctggcaggtgacttaggtcaaattactagaaaatctcattcaggtcttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggacgacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcctcattcaggtctttgaatcttgaaaaagtggcatgaagatgcatgacagtttagaaattattcatagtgcagtagcattggcactgagagtccaatggtggccatgttgactggtgccaatgtcattggtggcaccctaactagactactctttgcttggggtgttctgttgcaagaaatccttaatttcagactgttttctgaccctggattttgagctttttagctgattctgtaagcaacccagtcactatcttataatttgttttctgcttaggttagccagagaagatttttgtttaaaaccagtcagacttggctgatatcccaaagtcctaattgggttatagaatgcaaatagcctcatcatctggccttaagaccccttcattcttgtgtattctagatagagccagtgtttcgatttcaggcatgagcctttgcccacacagaaaataaaactagcatgacagattctaggaataaggtttagagtggcattgaacggaatcaacattttatttgtgttaactcagtattttttgtattggctttctcttagccattaaattactatcctttaaatattacctcaatattgaagaaaaatgtagagttgttagaaaacgtctattttcttgctagaaacaagcaacagataatcagtgccacattgcaattttcctaaataaaaatggcatatattgaaactgggccctagcaggtccagaaagcacagacaaaatgtgtaagcaggcaattcagatttccataatatctgatctcaagagaaaatggtccataattttataatccatatcaatgttttcattccttaaaattttctgtccttcctgagggatctctaggtattacatattgctagaaagaagttgtttgtcataatgaaccagtaaatgacttgagtaaaaagtaattaatgactttgatatgtcactaatgtcctgacgagtatctcataagctgaacatctgaaattgttcttaaactcatatataggatactggtttctattatccacatagggaactaatatctggattagtagtattttagcctgagaacaaatgacttcctggtcctattaataagttaattactactaatatattattaaataaattcatttgctactactagtacttttacaattcactatttagccttataaactattgggtccatccaccccacctccatgattatacctgtgtatagcagcaacaaatatgacgtattttcacatgtggttttccttgtttgaattctcaaaaatcttattcaaagcaacaggaaaagattcactacaatatttcccagtaaaacttaatccacaaaaatacagactctcaaaccaattcaaagggttttactgttgtatttttaaaatttcacaatctcattataagactatcacatggtgagtccggagattagcatgaagatggaagcccagtgcatgagctccctttaagactgggatctcaaatgagtctcttttaaccagactgatactactagcaaaagtctatacaatatttattttaattaaaaactttggcctggctgttaaagtttcgtaggccgtaacctgatgccatgaggctctgatatgtttcttccaaaacaaatagaaaccatgttaggacttcttaacagccttcatattttcagagaatctgactagatatttattagtgacataattatattggttaagttatcatttcatttttttaaacaaatgagataactcattgtagtgaaaaagaatattaatttgtatttaagtttaggtatagcaccatactagatttgaataaacattagaattgacttattacctaagaaaagagcaacaaatcaataggtaaccatatccaaatagcagaaatttaaaagggtaagttttactgtattcttaaaagtgtgtggttaattcgtctaatgtttaaagtaaaaacaacctgtggtaaaaatgtctcaattaggatgacattagggaaggaaagcgggaaaatggttaagcaaagacaaaaatgtgatttttaaatttctgatcaaataagtaagatagaaatctgcataaaaataagaatgaatctacattattgcattacttttttcccataactatcacggtggttgctcaatgggcccactggcacaaatccaataatgtggacttttcctcaccaaggctgatttggctactacccctggtgactgccaaacctgccaaaagtagaggccaacactgagctactaacacagcaatgctccttaggggattagttcgagctagctgtgattgtcctcacaggggtagacacatattatagacatggatttgctattctaccaaaagttcttctggtagttaaaatgtagttaatatatagcatgaagaattacacatcagaagagagacagctgatggacctattgcaatgaatgaattagatgaacacagagaaaatattcacacaattcttgtaaaatactgaggctataaaagtaaagggaaaatgatttttcacagaacctaccttgagttactgccaagacctaaatgttccaaaggtggcttaaaacatttgatgaactcaaagtacagccaggttgtgtagtccttaagcttttgcttctttataggtcttctttaacagattttatatttttaaaatggcatgaattattaacactatgagttattagatataaaatactgaagagaatgtacctattgacagttcctggaaatcctaaatacaactgcataatagctattagagaaatgaactggcttaatctgagccaatgccaaagctaaaatagatagccaaaatatctatggtctagcaaggagacacatgcataggaaataatgagcaaagagatatccgtactactcacaggaagtccctgttttcctggtggcccaatttttccagggtttcctgaaatgccatctgctccatggtatccttgtatgccttttggcccaagtaggccttgaagtcccttgataattaaaaattatttggattgtagagatgctgaaaagatgttaagatgacaaatacttttttatttattgagctggagaagtttacatttttatattttgttctaggacaaattttcctgtttcctggattccttaatgatttactatttggattcaacagataactttaaaagtttaaaagcctttaaaagttccccaaacaaaaatgccaagctgatcagcaatttactgtgtaacttttgcgccttagtgtaattctctggtgtttcttattgtgtcaaccaatattttatataattgtggagaaaagatcagctatatgcacctgtcagcttaggatagaggttatcatttcccatctgccaaaccttgtattgtgttattttcccaagaaataaattatggctattcagctgccactttgaatcagataattatatgactgaagtaaggtctgaacattttgtttctacacttgggcaactaaatttcatatgcaaggatctctgatctgaatgtgcttataatttacattcattttctctatttttttttcaagccaatacaagtcacccaaagcaggcatctaatccttggctaggggacaccagtaaagtctttgctaaagagccagtcaacacttatctgcctggccaggagaggaaactgatggtgaggtaaaagttaatctttgtgatgaaaagattaaattttttttcctaagactttttatttgtctagagaatgagaggctgagtcctctaaaatctagctcatgtcattttaattatgcttgaatatctctggcctttgtcaccattcattttgttacgattctaagttctctgtttttcagtggttcaccgtcagaagcatgagtccaccgggagggcttcataaccaggaaaatagcatccttcaactgcagggacttatatttaaacagcaagtttggttttgagttaatggtcatattttgttccctctgtgttccagcatgggtttaatttttttaaaagacaatctgatttatccaacatgatgacacaattggccccaaacttttctgcttgctaaagttgccagttccatttagaaaagcaagaaagatgaaagaggcctgttacttacaggaatcccaggtttcccagaaggaccaggagctccttttttccccttattaccctaaagatggaaagcacagttgtcaattgactgtaataatcttacttaaactgaagccatagaaaaggacactgagacctggacgctgcagcaagaactagcacgaactagttgtatatcattaggattgccatttaattttcctgggagtcagcttcttcatctgaaaatgagaaactttgacaagatcatctagtaatttccttgtagctctcaattatatgatttaagaatttaaactgtacttctaaaagggacctgaatagattatttaataaatgtccctactttcaggaagggccttgatctccttttgaaaatgctacatatttacttaattcagtaaacatttattgagtatcatgtatcagggactctgtcatgcgcttggaaggcaaaggcaaagttcctccttacaaggcacttacagtgtggtaagaagaacatgaactgatagcctaaaatgtgcttttctggaagaatagagaagagcatacttgtgattcaaggaaaagatatttatttcccacggaactgtttgtttttccatgtgtgagatgttttaaatcataattgattcagcagtaatgggtctgccaggatagttaggaactttgctcttgcaaatcatgccattgttctgatgacattctaaaagtatttaaagaagaaaatgtggaaaaggtgacttggttcacaaataagaaaaggaatcatgttgtcattaccagacacatttctcagaaatcatcagaagttctcacaaacaggataatcccactaaaatgggatgttaaatcattcaattttgaagacaaattgtgctaaagattcagtttaataataacaacaaagaaacaacttcaaaagatgttacttttttgacaaccagcttaaacattttatgaagaaatagtatatgttgtcacagagaaaaagagcatcttctctaagagataaaaatccaacttttgcaggatttgacaatggggagatataaggatcatgggttgtacttccaactttgaaaactattgtacttgtcttagaagtcactaatgcaaaatgtttctaaagatgaggaaaccagaaaatgggatagttagtgacctgggtttaattaaagtatacacatttctagagcatatgatccctataagtaaaatatgtttttcctaacacaataaaaaagcaaaataaacaaagactattttaaatagtggaaaaaagttgtgatttcagtcatcttgaaatacttattaaatagcatatgaatcataatatgcaattatgttaatcagtgtgttttttcctttacagtatttctttttatgcaacgagatatatctgttctatacttttgatttttcaaaatagacttttccttggcttttgaattttaaaatagtccaatgaaactcatggtgggggtaacagtttgaaaaaaatatgttttcagtttcaaaatcatgttttttaaacacaaaagcctgactcttaaatattaaaagtctatctttgagttaaaaaccaaggtttgttataaaggactcaagtcataaaatttatgctataaagaacagatttaaaataataataataatgtaacaaagagtttttcccatgaaaggggataaagatcctcaagctggggaaagggaaaagaagaagaaaaagagaagcgggactgttagacactgacggcaatctctgaaaagagccccttgcccctcatcctacccttgagtctttctcttttcctttttttttttttttttgagacagagtctcactctgtcacccaggttggagtacagtgtcatgatctcggctcatggcaacctccacctgccaggttgaagtgattctcctgcctcagcctcccaagtagctgggatcacaggcatgcaccaccacacccagctaatctttgtatttttagtagagacggagtttcaccatgttggccaggctggtcttgaactcctgacctcaggtgatctgccctcctcggcctcccaaagtgctggaattacaggcatgagccaccatgcctggcctgcccttgagtctttcttagggtggatagaaacactaatgctcccagataagtttggggatctgggcacaaagatgatgcctagggagactaaagtcctcattgagaagtccacataaagtacatagagtaaaaatctctgcatgacatgtctaggacagtgggattaagaatgtctttctgagtcctccaagtaccctgtatggtgtggggagcagagaatgttatttatatgtggccaagaacagaagaagatggccctgagaggcctgaggaggtcttgtacctgagatgagcaaatagctgcacatgccagcataggtcaaaatacttctggcaggagggccaaggtagatgccaatacggtgagacaatagcaactgtgggccaaaagtgatgatgtgcatttcaggggacactagtgtgaacagatgatgactgaagactaaacttattttccacctgccttccctaccatctgtaactccaaatttgaaaagagtgagtggggaaaactctaaatcaaatgtaggatatttgagtgaatggggttaaaggcagtcaatggattagatttacagtacatataaaattgtgctttctttttgcctggccagcactgaaaaataggtagagtggcccatttgaaatcagatccattttgaaaggcttctgttcattgggactgtgctggttcacagactactagagaaagcagtctgattcttttgataagggaaatattttttaatatgcaacgttaatacaaacgcttgttttttgtttgtttaaatgaggctgaaggacagttatctagatacttcactagttctaacactctttaagaaggcagctttataaagcaaaaatagatttagagagttaagcaaaaattattctttcttttttcaccaagaaatttcaattcattgaaatctggaattttgttttgggagaacaaatattttggcttgagtcttggtctttgagagtcattataggacagttcactcacatttgcattacaaaagtcttttaaaaaatgttggttctgcaattggttttgacttgctctaaatttttctttatagctgcccacagtcttatgcccaatgaatgaattggttggttaggttaaattaatcatattttacttaatttttaaaagattacaagtaataggcttcttcataataacaggagctaggaaataaagtttctagtgttgtttctgttgctaattagttctgtgattttaggtaactcataatctctctgggattttaatttcttcatttgaaaattaagagggttatccagataattttaaagggtcatttccaaatctaaaaaataaatttaaagctttgcaaaaacaagatgacagcaattggacaggacccatctggccactgaaggtgtccctagtgaataatacacagtcagtcattattcttgtagcaattaatactattttaaattctaagaggctttttaatgtgcccttgggttgtatgccagcattacccaaagcagggaagaactagcttgcctggattatacagaatttaaactatggcttcttagcaccttttagctccaacacgcagggattgttgaccatgtaggctagagaggcagttgactagtaaaagtatttgatattcattagcctaattttaacatatactaataagcatcagaaaatgtcttactcctgagacctctcaagatggaaaaagaaagcctgcaaatatgaaagtattaattgtaaaaaagtagatactttcggatcaaatgttggacagaacttgcattcttaggcacttactgcaaatataaggaagtagcatgacagcagtagcagtattctaggttcccaatgttttctatgactttttccaatttgagtattaaaaattctaagtgaatgacttaactatcttctttctctgcttgtttaggcttatcttcgatatgatatttttatttattaatattatttattggggaacctaacagaaagttactgaatagatgccaagactatacaaaatgggttctaggtaagtgaatgcctatttaacatatctgattcaaccccattttattacttactcccataagtggaaaacacaaatatgggtgaaggctgcttaacaaatcaggagaaacacaatctcaaatcattactttttattcattctcatctaatttattattaacagtgtagtgcattttcttaagaatttaatttgaaatcaatagcatgtgaagtcagaatgcctgaaaaacagggcagcaatgaattgaaggtgcaaatgacaaagttgcttgctatttaaagttgaggcaatgtctatctggccacatggaaagagaagactaaattcagtaaaccaacagatttttagtttgcttgataagatttgccttatgaaaaaacaactttcaaaccaattatgagcctgtgttacatagtcaaactactttttcctctcttatcctatgacaatgattctttgcttggtcaaactttagtcaggctcctgaaccttctaagccctccgtgtacttccttgtaaaatccagttttagcaacgaaccctgccaagtcggtttagcaagaaccttcacccttgatatctgatcacccttgatatttgatatctaactgggttcctcatcctctaccatcccccagttgatgtctgattatcccacagttgatgtctggtcaccttggcctgtcttcagcaaaattcttgttaggtcagtttaaccaaaattcccctggcccctggtgtttcctcttaagtaattttccattcactcatactcaatctgctcctttgttataaattcctacttgcccatgctatatttggtgttgagtccaatctctcttccccattgcaaaatcccattgcagtggtcgctatacctattgtaatagtcatgaacaaagtcttccttaccatgctttaacaattatcatttaataattttttctttaatgctttctacaacaattatataggtttgactgattttttttaccttataatactagttttaaggtttgctggtatttctgtttgaaacctcaagaacatactattaatttgagacaactgaggcaattttcacaaagctagaataggcttctggaaaagaaaaatttggataatagtcaaaacaaatgactcaatcaataattttgtattagcacaattattgaaaaacaccctacttagaggcccatagtgatccatattctacagtgataaatgataatttgaattacaataaatagtaactccttgtgctcctgctttctaaaattgctaacaatacatctcaaattgccttaaataatttcaacttacttcagatcctctctctccttttagtccttgttcaccctggtcacctggttcgccctttagtagaaaccaaaataaaaatcacatatgaagcagagaccaaataagttatattaatgttaatttttagaaataatgctttcaaaacatactgggggtccttgttgtccagtggcacctcttagtcctggtacacccacatggccctagaaatagaaaagattacattattagagtaagtagagacatgtgacttaagagaataggatactatcacttaaaatggtagcaaagtgttgcaaagctcaacttaaatgtcgtagagattatgattcttcttggaaatagaaaagaacataatagctgttggatattatggtagctgaaaacaagttagggttttctttctttctttctttctttttttttaatgtgaattaatgtagcaggctgaatggtggcctcccaaatgttcgtctatgtcccaatccccagaatctgtgaatgtgatcttgtttggaaaaagggtctttgcagatgtcactaagttaaggatctcaagataagattatcctggattatccatgtgggccctaaatccactaaagagcataagtgacacagaggtagactgacacagacaacagaggagaaggccaggtgaagacagaggcagagattggagagatgcggtcataggaatgctgacagccactagaaactggaggaggcaggagtgtggccctagagcctctagagggagcgtggccctgttgatcccttgattttggatttctggtctctagaactgagaaaattacatatctattgttgtaagccacccattttgtggtaatttgttatagcagcctcaggaaactaatatagtcaataaccaaaggaacagagtttgagaatacatttctttttcaacctcttcctcctccgaaagtgtactatggtctccatttttacaaactaacttcacaactatttggacggtagatttactgggctgaagactgggagcagttactgggaggtattactataataccaagaaacaccacatgactctgacattcggcaatctgtcgtcaccttagttctcctaagaaggaatgctgacctaccacatttcccttttcaagtgtgtaaatagaaactagcaacaacccagaagcgtgtcagatgagagttatgcaggaataattctgcgtgtaaattcttttatcccttttcctactcaatcagatttctttctccctattttcatacgttacagaaagaatgccttaggaaagagttatcagtcccatctcctgggctagaagaagagattgcatacataggctaacaatatttattcttttattattattattattattattattattattattatacttgaagttttagggtacatgtgcacaatgtgcaggttagttacatatgtatacatgtgccatgctggtgtgctgcactcactaacttgtcatctagcattaggtatatcccccaatgctatccctctcccctccccccaccccacaacagtccccagagtgtgaagttccccttcctgtgtccatgtgttctcattgttcagttcccacctatgagtgagaatatgcggtgtttggttttttgttcttgcgatagctgactgagaatgatgatttccaatttcatccatgtccctacaaaggacatgaactcatcattttttatggctgcatagtattccatggtgtatatgagccacattttcttaatccagtctatcattgttggacatttgggttggttccaagtctttgctattgtgaataacgccgcaataaacgtacctgtgcatgtgtctttatagcagcatgatttatagtcctttggttatatacccagtaatgggatggctgggtcaaatgatatttgtagttctagatccctgaggaatcaccacactgactcccacaatggttgaactagtttacagtcccaccaacagtgtaaaagtgttcctatttctccacatcctctccagcacctgttgtttcctgactttttaatgattgccattctaactggtgtgagatggtatctcattgcggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacgtgaagtccttgcccatgcctatgtcctgaacggtaatgcctaggttttcttctagggtttttatggttttaggtctaacatttaagtctttaatccatcttgaattgatttttgtataaggtgtaaggaagggatccagtttcagctttctatatatggctagccagttttcctagcaccatttatgaaatagggaatcctttccccattgcttgtttttctcaggtttgtcaaagatcagatagttgtagatatgcggcattatttctgagggctctgttctgttccattgatctatatctctgttttggtaacagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgcagttctccttgaagaggtccttcacatcccttgtaagttggattcctaggtattttattctctttgaagcaattgtgaatgggagtccactcatgatttggctctctgtttgtctgttgttggtgtataagaatgcttgtgatttttgcacattgattttgtatcctgagactttgctgaagttgcttatcagcttaaggagattttgggctgagacaatggagttttctagatatacaatcatggcatctgcaaagagggacaatttgacttcctcttttcctaactgaataccctttatttccttatcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaattaatggagagtttttagcatgaagggctgttgaattttgtcaaaggccttttctgcatctattgagataatcatgtggtttttgtctttggttctgtttatatggtggattacatttattgaattgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccatttcctccttgtacctctggtagaattcggctgtgaatccatctggtcctggactctttttggttggtaagctattgattattgccacaatttcagctcgttattgatctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcagtggtgatatcccctttatcattttttattgtgtctgtttgattcttctctcttttctttattagtcttgctagtggtctatcaattttgttgatcctttcaaaaaaccagctcctggattcattcattttttgaagggttttttgtgtctctatttccttcagttctgctgtgattttagttatttcttgccttctgctagcttttgaatgtgtttgctcttgcttttctagttcttttaattgtgatgttagggtgtcaattttggatctttcctggtttctcttctgggcatttagtgctataaatttccctctacacactgctttgaatgcatcccagagattctggtatgttgtgtctttgttcttgttggtttcaaagaacatctttatttctgccttcatttcgttatgtacccagtagtcattcaggagcagattgttcagtttccatgtagttgagcagttttgagtgagattcttaatcctgagttctagtttgattgcactgtggtctgagagataagtttgttataatttctattcttttacatttgctgaggggagctttacttccaagtatgtggtcaattttggaataggtgtggtgtggtgctgaaaaaaatgtatattctgttgatttggggtggagagttctgtagatgtctattaggtctgcttggtgcagagctgagttgaattcctgggtatccttgttgactttctgtctcgttgatctgtctaatgttgacagtggggtgttaaagtctcccattattattgtgtgggagtctaagtctctttgcaggtcactcaggacttgctttgtgaatctgggtgctcctgtattgggtgcatatatatttaggatagttagctcttcttgttgaattgatccctttaccattttgtaatggccttctttgtctcttttgatctttgttggtttaaagtctgttttatcagagactacgattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgctgttagctggttattttgctcgttagttgatgcagtttcttcctagtcttgatggtctttacaatttggcatgtttttgcagtggctggtaccggttgttcctttccatgtttagcgcttccttcaggagctcttttagggcaggcctggtggtgacaaaatgtctcagcatttgcttgtctgtaaagtattttatttctccttcacttatgaagcttagtttggctggatatgaaattctgggttgaaaattcttttctttaagaatgttgatattggcccccactctcttctggcttgtagagtttctgccaagagatctgctcttagtctgatgggctttcctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaaattctcctggataatatcctgcagagtgttttccaacttggttccattctccccgtcactttcaggtacaccaatcagacgtagatttggttttttcatatagccccatatttcttggaggctttgctcatttctttttattcttttctctctaaacttcccttctcgcttcatttcattcacttcatcttccatcactgctaccctttcttccagttgatcgcatggcctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatttcctcccatagctcggagtaatttgatcgtctgaagccttcttctctgagttcatcaaagtcattctccttccagctttgttctgttgctggtgaggaactgcgttcctttggaggaggagaggcgctctacttttcagagtttccagtttttctgctctgttttttccccatctttgtggttttatctacttttggtctttgatgatggtgatgtacagatgggttttcggtgtggatgtcctttctgtttgttagttttccttctaacagacaggaccctcagctgcaggtctgttggagtacccggccgtgtgaggtgtcagtctgcccctgctggggggtgcctcccagttaggctgctcgggggtcaggggtcagggacccacttgaggaggcagtctgcccgttctcagatctccagttgcatgctgggagaaccactgctctcttcaaagctgtcagacagggacatttaagtctgcagggttactgctgtctttttgtctgtctgtgccctgcccccagaggtggagcctacagaggcaggcaggcctccttgagctgtggtgggctccacccagtttgagcttcccggctgctttgtttacctaagtgagcctgggcaatggcgggtgcccctcccccagcctggctgccgccttgcagtttgatctcagactgctgtgctagcaatcagcgagactccgtgggcataggaccctctgagccatgtgcgggatataatctcctggtgtgctgtttttaaagcccgtcggaaaagcgcagtattcgggtcagagtgacccgattttccaggtgccatctgtcacctctttctttgactaggaaagggaactccctgaccccttgcgcttgccgagtgaggcaatgccttgccctgcttcggctcgcgcacagtgcgtgcacccactgacctgcgcccactgtctggcactccctagtgagatgaacccagtacctcagatggaaatgcagaaatcacctgtcttctgcgttgctcacgctgggagctgtagaccggagctgttcttatttggcaatcttggctcctaacaacaatatttattcttacagcaaagtcagttgaaggcttctttgtttgcattctgaggcaaatgtttacggtttaagtttcaacttcccgataaagaaaatgaaatctgtttaaggaagtgaagagtggcaagagagaaaggctagtcttgagagcttctatatagcccatgaccacactaacggaaaaaccatgatcacacacgagccttagcaaaacatgagcagagccagcaattaacagaatctggtcaatcaagacggagtgtggtacaagtaaatgtgactacttgaaggtcacttatcaaacaggattcaggaaagaagtggctggtgaaaagctggaggtgaagtaagagtgagaatatgagcaaactacaaaactctaaaccatcatgcccaattatggcttttccaccatccctgtatgtagttctacagaaatattttcagagtgatcatagaatagccaactgcctctcctggctttgtgaagtatgactgtaaatctcaccaagacaaacctgcattctaagagttttgttacaattactttggtttatcactctaaaaattgactatgaccatttttctgtattggtaaaaattaaatgtgccatagaaaatgttattacaaaattattcaggagaggttatggaaagtgatggaacttgtcagataatattagtggtgggatgagttgaatggccaaaggaacttacagaagattttataagggaagtgataagttcaatcttgaagaatgagtgttccgggcagtaaagtgaggacattctggcagaggcaatagcatgggaaataaagggatgcatctgacagaacatgttaggtagaaaatggatctgagagggctatgactggagacaggaagtctagttgggaagctattgaaataattttggcaaaaaatgatgagagcctgatggtagtttcttttgctgtgcagaagctctttagtttaattagatcccatttgtcaatttttgcttttgttgacattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcctagcaccatttattaaatagggaatcctttccccattgctcgtttttctcaggtttgtcaaagatcagatggttgtagatatgtggcattatttctgagggctctgttctattccattgatccatatctctgttttggtaccagtaccatgctgttttggttactgtagccttgtagtatagtttgaagtcaggtagcgtgatgcctccagctttgtccttttggcttaggttgacttggcaatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattgttgtgtaagaatgcttgtgatttttgcacattgattttgtatcctgagactttgctgaagttgcttatcagcttaaggagattttgggccgagacaatggggttttctagatatacaatcatgtcatctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatactggctgtgggtttgtcatagatagctcttattattttgagatacgtcccatcaatacctaattaatggagagtttttagcatgaagggttgttgaattttgtcaaaggccttttctcagagtgaacaggcaacctacaaaatgggagaaaattttcgcaacctactcatctgacaaagggctaatatccagaatctacaatgaactcaagcaaatttacaagaaaaaaacaaccccatcaacaagtgggtgaaggatatgaacagacacttctcaaaagaagacatttatgcagccaaaaaacacatgacaaaatgctcatcatcactggccatcagagaaatgcaaatcaaaaccacaatgagataccatctcacaccagttagaatggtgatcagtaaaaagtcaggaaacaacaggtgctggagaggatgtggagaaataggaacacttttacactgttggtgggactgtaaactagttcaaccattgtggaagtcagtgtggcgattcctcagggatctagaactacaaataccacttgacccagccatcccattactgggtatatacccaaaggattataaatcatgttgctataaagacacatgcacacgtatgtttattgtggcactattcacaatagcaaagacttggaaccaacccaaatgtccaacaacgatagactggattaagaaaatgtggcacatatacaatatggaatactatgcagccataaaaaaggatgagttcatgtcctttgtagggacatggatgaaactggaaaccatcattctcagcaaactatggcaaggacaaaaaaccaaacactgcatgttctcacttataggtgggaattgaacaatgagaacactgggacacaggaaggggaacatcacactctggggactgttgtggggtggggggagggggaagggatagcattaggagctatacctaatgctaaatgatgagttaatgggtgcagcacaccagcatggcacatgtatacatatgtaacaaacctgtacattgtgcacatgtaccctaaaacttaaagtataataataataaaatttaaaaaaaaagtaaatacaaaaaaatggtgagagcctgaactaaagtaggacaaagtaactagattccagaaacatttaagaatcaaaagaagtggctgactgtgagacatgagtaggggtatggggaagaaaaagagattcatagagacagagtgagtgagtgagagagagagattgagagagagacagagagagggagaaagaaagagaaagaaagagagacagaggattcatctactggtttagacatctgaatggctggtgatactattcactgaattgaggacataacaagaggaagatcagattaaatttggaaaggatgaggtactatggtttggcacttactgagtttgaggtgcctgtgatgatgtccaatagctatttagatgtgtatgtctgatgctaaggagtgaaggccaagttgggatttagttatttcattgtgtgtaaaaattctatgaccattgccagcccccctccgcccacagcaaaaagaactttgagatgcaacataatttattcaaagtatttctgggacttcatctctcctaagtttagcttgagttaatcttggctatttatgtttccatttatacctttaaataaagtgtttccatttatacctttaaaaagtggctgttgccaggataatacatttattccctccatgtcctctggctctcaagcgtcaaataaatttatcttgatctatgtgatgtacagttttagtacagtttatagcaggatgacagctataattgcttttccttttatgaaataacatgaaatagctgtacatattttatagctaaaattcactatgtttatttttatactgattaagtgttcttattctccatgttttttatatatatgatgtccatgggggcagagactgtgtctgggatgtccaatgtaatatccatggcccctagctcttctcctggcccatggcagacactcaaatacaagcttaatgaccagagacatatatatatatattttttagatggagtcttgctctgttgccaggctggagtgcagtggcatgatcttggctcactgcaacctctgcctctgcctctgcctcccgggttcaagtgtttctcctgcctcagcctcccgagtagctgggactacaggcatgcaccaccacacccagataattttttgtattttagtagagatggggtttcactatgttgggcaggatggtctcgatctcctgacctcgtgatctgcccacggtggcctcccaaagtgctgggattacaggtgtgagccactgcacccggcccagagacacagtttttagaaatgttatcatacataacacataaagtatgtcagtacaactaagtattcgttaataataatgagcaggacccttgactttggtcaaagatgtttgtgactataaacatgttttttaaaagccaggtgattattcagtcataaagacaataaaatattgatatattttataacatggatgaacttttaaaacactgtgccagacacaaaaggctacatgtataattctatttatatgaaatatccagaatacagaaatccagagacaaaaagaaaaaggtttccaggggcttgggggaatagggagtgactgcctaatgagtatggggcttccttttggaagtgttgaaaatgtttggaactagacaatggtgatggttgcacatgatggcgttcaagacacactaccccaaaatatggcatctcggaatattgaatattttaagctgaagcaatctgaggaatggcatgtgcagagaggactttcttaccttcctttgatgcaggtcataagacacatgtgagaggtgtctccctatacctggaggaaaggagcatcctcatctccaaaaacgaagggacacagagaataatctgaatgaacagtccttgctaagttttccccagtttactaatcttaacccatacctttgccctatcacattcttctaagacttcctcatcaaacctagcataaaagtattcaggtttaactgtttctttggagctttatttctttatgaaggctcccgtgttacgtataatttatatgaaattaatctgtatgcttttctcttgttaatctgccttttgttaccaagtccccagccaagaattcagaagggcagaagaaaagatatttttcctcccttgcccactaacaatgtgaatgtactaaatgtcactgaattgtaaagtttaaaatggttaaaatggtaaattttatgttacatgtattttatcctaataaagaagcttggtgataatgctaaccatcagtttagcagagtgaaatcatagcatatacaatatccatatagaaaagcaaacattttaaaatatcacctgaagctataataagataacctaattctaaataaagcgtggttcctctgtataaatcaaacttgtgctaggagaaaacttggtgagggagaaaggtggatatttcatgattttgagctaagcaataaaagtagcatggttgtctggcacaagatggctaactgtttagcatagaatcatcaataaataaaatgatccctaaagcctaaggacttaggaagaaataagacagaaaggaagacatggatcaaactagtttatacaacatctacagttgaaaaattatcaggggtatacaaggaaggggaaggagaagtagattagacagtgaacctagggaaaagtgaatgactgattgtccagaaaacgccggcagggcttttctttggctagccaagtgaggaaattcttgtctcctttcaagcgaatagttaactgctcatttgctggtaaatatactgatttagctactgaatgttctgtagctggtagaggccaaaatgagatattgcaggaatctggttttcccgagactgtgtgaagaagtcatgcacagaaaaagctgaggaactttaagaggcttctcaaattatgctggaagcagttgggttggcttctcaactcggagaaaagtaaatttcaaataaatccactcaattccttgggttaggaaacacttgtagatacaaatgttatgtaaattggaaacagaacacatataacctgctaaaaatgtttctttgaaaacagaaaaaaaaatggtaatcgcaacaatttcacaaatatttagaactattctcaacatctgcttcaaagagagttttagggagtgaaagttaatttttcagattcctctggcttgagaaaaatcaacttattaatgatagttatctatctatcatcttgtccatttagtttgggtaatataaatctgcatttcagacatgaccacaggaatttcatcttgacagagatgtatcagattaattaacccatcaactcattattaaaagcttattatgtacagggattagaactagacgttgtacaagaaagaaagaagacatatgccaagtgggggagctaagacacctacacattaaaaataattagcaaaattagcaaaaaaagaatagcaacagaatgtggtaaaatgtttgtactgaatgacttaaataaataatattattacaagactacaggagagagcaagattaccgttagtgggtcaggggaaaagggaatttgagtgaaattataaaggatttatgtaagcaaagattacataatattataggcaaatagagaatgctatgagcaaaggaataagacaggaactatagggagacaggagacaacctctaactctgtaaagcaattggcaatgtaaatagagggaagagatataaggcaggaatacagaacatcctcaaaaacaaatgtgatattaaaaaatgacactgaatacgttctacacacagcctaattttagctaagttggtcagataatgtccctctcaggaatggaagaggataagaattgacttaagccttgagaatataaaggtatttagccacctacttgacacctctttattgaattcctactatataccaggaactttgtgttctagaaattgggggtataatgatgaaaatgagagacaagattttttttctcatggatcccacattttgttgggggaagacaaacaataaacaaggaaacaaatatatttaaaaagtgacaagataatatagcataaaatgtcatgaaggaaatcgagtaatatggtccagagtgattgttctagatctattttagatagggcagttagagaaggcctctcaggaggtaacatttcagttgagatctgaatgatgagaaaaagcagaagtaagaaaagacaaagatgattctaggaaggaggaacagaaagtagaaagacgtctcttctaggattaaaaacataagacattactaattatctcaataatggaatggaaaaaatggaatagaaacacagagaaccctatttaaattcattagtaaggggtataacttgcaattaccttatatccctctgctccaggctctcctctctctccttggtcccccactggaccctacagagaccacacacaaaacaatcagttttacagctggatcaaagtatatgcgaatgcaggtgataagattagtgttgtttattcttttgtcaaaaatataaaaccaaatatatgatttgtttagttccattaaataatttcaaaatattgaatttcaatgataccaagaacaacatcaaaatacaccaaccagtgaattatataaagagaatctcataatgattctactaggaaaaatattgaaaactgaagcccaattaaaaatatgaatattttcaccaagtgtggtggctcacacctgtagtcccagcacgttgggaggctgaggcaggaggatcccttgagcccaggagttcgagaccagcctgggcaataacgtgagaccctgtctctacaaataatgtaaaaattagccaggcatggtggtatgtgactatagtcccagctacttgggagctgaagcagggggaacacttgagcccaggaggtcgaggttgcagtgagtcatgtttgcaccactgctctccagcctgggcaacagagtgagaccctgtttcaaacaacaacagcagcaacagcaacaacaaaacaacaaaatgtttcaattagtacagtatgttataaatgatgcccaaataacttacttttttactaaatattaaaatgattgaaaaagatttaagcaggacagttcagtacataattccattaattacaaaagattatatttaagtgatcttttaaaagggatttaaatagtaaatcctactttaccattcttcatgagaaagtctactgttggctgggtgtggtagctcatgcctgtaatcccagcactgtgggaggctgagataggaggatcccttgagctcaagggtttgagaccagcctaggcaacagagagagaccctgtctctaaaaaaaattaaaaaataataaataaaaattagctggccctggtggcacgagcctgcagtcccagctacttgggaggtgggaggatcacttagcccaggtgtttgaggctgcagtgagccagcactccagcctgggcaacagagggagacacagtctcagaataaaagtctattgtgaaatttttaattttcaagacataaattaacctaaaaaattatacttattaattttaatccttaagccaaaaattatctaataaactcagacttacttttcctgaatatttctaatagaaaatctttaatataataaatcatcaaattatctactataaaatgaaatagaaatatcagcacccactaggacctaccatctgaacaaaaacttaaattgaaattagttggaaaagcataggatttattatagagcattaattgacaaattttaatttactcttacgtggacaaaggtaagagacatgtcaacactacaatctctgactctgctttaattatttagaatctttgtggtttaagtttcatgcctgtcccgtgtctactggataaaactactattgttatgctagtcttttaatatatttattacattttaggtggcattctttgatcctggcatacctaaatctgggaaaaacaaccactactatactccttttgccaagttttttccatttgctttaagatttttacattatttccatatatttccctctcttagtggtttagagagactagaatattatttaataaagaaacttacatattcctttagatacctatatatctattgcctctatatgagatggcttgatttaatcagaaaaattagaatctttcttgtctatttctaaaacaaagtataactttcaaccatctccaaagagccaggtcaaaatatcaggagtgactacatattctgatccttgtgccttaagattgttttactctatataatactatgtgagaaatggaaaatatagccaattatataatatttatttctatggactaaaaattttcatttaatccatttaatttacatatggtctttagacattgttttagtcaaacatgaacacagagacagttattcaaataaagctataatagctactttttagagaccatggttatagttaacccttaaaatgtttaataagaaggctatagatcagtaatctttaaaggttattggttctaataactccttagaggggttttgaaatcacttggcaactgtgtgtaaactgctataagaagtatatagataagatttttttaatatttagaaataaatctgaatgtgataattacagaaatatgtatcctaaaatgtctagagtgtataagttttctgacaatctttgtaaaagttgttatcatgccttcaatgcagaaagttagatttgggaagtcactatattaaccctatatattatgctaaaatatgacctgcatatttttcatattaaagactttaatatcatttaaattttgtgaccataaatatcaccctcctatcaaaccatgttataaaactaacaaaagaaaactccttgaaaagatttaattggtgttgtgaatctattatataattgtgttttatcttgaataaccagaattatttcagaaaaagacctactggttcacctcgaggcccaggtggtcctaggactgtgctatcttctcctgggtagccctaaaatgaaataatgatttataaacaaaactcaataaataaaataaacatcaaaaacacacaacctactatttttaagtatattagaaaatgcagtttgatgttatctttttttaagtggaaaactttgatgtaagaaactaagcctatgatattttatacagagttgtaatttgtacagggttcttcttggaggtatcaatctcctttaattatataagaagcagctcaggaattttcttaaagtgtcagatttcaatgatattgtaaattaagaatactgctgtagttattcctaaatcatcaaaaaattttaatctttaatataaatgagccaggtgcggtggtactcatctgtcatgcctgctacttaggagcctggggtgggaggattgcttgcttggtttgagtccaacctgggcaacagtcaagatcacttgatcctgactctcctgccccaaagactttaatataaatgtactataattaatcatttaatctagagccttacaatttctttaaataattaattttactcttacaaagctctacaaatattttcacatatattatttcagctcagtcttgaaacaacccatggaagatattttaataatttatttaaattttagctccttgatatttatttttttcttccagaattagtaaaattttcaactttaaaagtgcttcttttattccttgaaaatttttccatgcagtctttcaggaataattcatgaactcaatgtttaactttaagattaaaaagccaatatatacacaaaccttttctcctttaggtcctggcaatccagagggtcctggttggccctgatggccctacgaaaggacaagtagacatttatacatgctctacctagatattagatattgcattattctgaaaggaaaaataggattcactgtctaggaggatgagacctaaatatgttagaaaggtttatcagagagatttcatcttaatttgaatatttgggatatcatctttaataaaaatgttttcatgtgaatatattttttcaattataaatacttaccctgtaccctggaattcctggttctccatcaggtcccatcaatcctaaatgtccctgaaaaacaaagtaaatattagtgagagagagaaagtaaagaattgtttaaatcattagacttctactcctattgtttaaattgttacctttagatttttcatggttgaaatttacctagtttgaaataggaaagcaaaaaataaccccccaacttttgtctatttttttttctgaaacacaaaaagttctgcaacaaatgtctttttggtttacttctgatataaatatccttaatcatattaaaaaaaatactttcagttgtcagaatcctgctgctccctaacgaattattggaaatgtggtttacatctgtcaaagtttgtgccagatgtgggtcactgaatattagagagtgcaacctgagagtttttgacattgtcactacgggatccagaactccatactcattgttagtttcagatgctatgatgaatatggttttagtcctggtcaaagttattaaaagggaaatggttgacaacttacatgtaatagttaccctatgattactcttattatcaatattttatagatggtgaaaccatgtaagccaaagactaatcagcaaatgcccttagcctactgaatagattgctcagacaattgaaaaagtaaaacaaacaaacaaacaaaaaaaacctgaaaaagtcctatatttcatattagcaaaaagattccatattgactctcctatttgagtctcaaaacaaatagaagatgggaaaattaaggcacagaataggtatgtgacttgccaaatgtcatactagaactaagtctcttgattctgcatatatagtatttcccatttaatcatagtgcttcactatatttgatgatttctttaaattcccagctctaaaaatgttcacattgcaactattaaccattgattagtaaatttagactcatccagataagaacaagtttcagtctaaaaaaggaattgcacaaaattaattttaaaacatcaataagaattcagccattacctaggtgaataatctagaatagaatgtaactactcagtattcattagctcaagatggctgaatgacatatgcttgcttcaatagtctcatccaacaaaaaagagagagagaaaagaaaggtatttatttgtaataacaacactggaaaataagtaaacatcatcagtggaccaaaattttgtaatttgagacagaaaattagggctgaaaatatgcaaagaaaaaaatcattgcagatgtgcaagtagtctcaaggaaatttcaaatgctgaaatcaagacattgaaggggcaggataggttcaggtgactaactggggaaaggagtcaggtattcctattctacttgtgctgggtaactgatgattgcatttgcctagaagataagtgaatgcgtgtggaaactgttgccccaaaagcaggcaatgctaaaggctgctgctgactcaagtgactctagagccaacataacaagaaataaaatatgcaattcataaaagaaaaaatgaaccttaatgtacctaaaatatatatgcaaaatatgtaacctcccaaaaataagtggggagaaaatgtgatgaacagatctcaaaatctgttttcagaaatcaatgactcaaatagcaagaaaaaaaacagtaagaaagctataaggatttaagtagcttagctaacaacttgatttaacagaaatacttaggactgtttattagccccaaaaaaggaaaagaaagaaagaaagaaaagaaaagagaaaaaggaatcttttgacaaaatttgaatatagtagtcctcaaagaaaattttagtaaatttcctcaaagcagaaatcatataggtcacatcctctggctataatgcaatgtaattaaaaatgagcaataaaaattaaaaatctacttaaaaagaaagatcctttaagataactcttgttcaggagaaaataaactctgaaattgcaagctatttataagtaaatgatggtaaaaacacaaacataaaaatacgggaatatggccaaagtggcactcaaaagggaacaggtagcttcataatgcatttattaaataaataaaataaatgggccagacatttaattcaagaagagattaatactgaagcagaaattagtgaatcagaaaaccattttaaaaagttgagtgaaaaacaaagtagacactttgaactgactaataaaagagcaaaatatttggcaaatctgatcaccgcaaagagtaaacacgataaaacaacattagaaacaagaagaacataaccaaaggaaaaaaaattaattataagaaaatagtcatttcaagtttcacttactaaatatgaaaatctagttgaaattgatactttttgagaaaaaatttcaaaaatttattccagaagatacaaaatttgaaaagaaagccaaagatctactgctaataaaataacatttggctcagattgttttaatagcaagttttataaaacctttggagaacagacacaatatctatgttccatactgttacagagcacagaaaaatatgaaaaatttaccaacccattttatatgacttgcttaacacttatgcctaaatccaatcaatgatagcatacattaaaaaaggatggaatgaagaacgatggaatgaagaaataggcctactttgcttacaaatacaaatgcaaaactcttaaggtaaactacattcaataagctaaaataaaactcttaaataaaatgttaaaaaatgaaatctatttgcattaaaataataatataattaaacctaagtaagatttatcctaggaactcatggttgattcaacttttggaaatctatgaaggaattttcttatatttacaaacaaaggagagaaagcatgggtttatctaaacaaatgttgtaaaaggatttgataaaattcaacatctactatgggattatctaaaaaaatgttgtaaaaggatttgataaaattcaacatctactcttggtcaaaactctcatttaagaatgaaaataaatttctttaaacaaataaatggtatatctaaaaaacaactgtaaacaacacttgatattataagcattagaagcattttcactaaagacaggcccacaagacaaggttttcttcatcatgacttctattcactgctatagtagaagttctaatcaatgtagtaattcagagaagcaaataaggggaggcaatattatttacctgaagaatccctatgagaatcatctacattcgttaaagtggatataagatcaaaatataatagcaccaacagcaccactaagttgatgtaacagaaaaaggattatattaacactgagaataaaactcaaaagcaaagcaaaacaaaaaaacaaaaatactaagaataaacttaacaagaaagattaaagaacagagataagggaaatattttattgatgaatatgtaagcagatttgagtaaataaaaagacatatggtgtttatagaaagattcagcattgaaggaaattgaaagttcacatgaaagaggaaatcatagcaagagtcaaacttttttgtaaaatgaattatgaagtatttgccctaacagaaggtatcacaatagtatagtaagtaaaatagtgtggtattgacccagaaatagactactagattcagagaataaagtagaagaaaaacagactaatgaatatttgagaattcagtttatggtaagggaagcatttcagaaaagcagaaaacagactgaccactcaataaatagaattggaacaactgtctataagtttggaaaaaataaacttagtcttctacaccttatataaaaaaatacccacaaaaaaaccaaaaacctccatacatcttaaagagttaaggtaaaaataaagttataaaagtattagaagaatatggaagaatattcttatatactttaggtaggggaggcatttctaataaaataaacacagaaactgaaagggaaaagactgacaagtttgactatataaaaattaaaatgatctatacagcaaaagatatacaaaattaaaagataaattgcagaaagaaaagcatttgtaatatattttgtaacatatttaacaaaaatatattaatattttaagcatataaggagtgattgcaaatcaataagaaaaaggcaacaatctaatgtgcagtatatatgaacaggcaacttccataagaaaaaagtgcaattgggaaagtgtaaatagaaaaaatgcaatacacattctcacttatcagattggcaaacatcaaaagaagtaatatgaaatgttgatggtgggagtgcaaatttgatgaaacctcttgggaaggtaggttgggaacgtgtcaaattaaaaaattaataacattataaaatgtttttgtatacaggtcaaagacagagaaatgctagtaatttaaatgaaagaaagtaagaaaggcctagatcccagtaaggaatagaataccgaaaataagcctgaggcaaactttcctcagacaacaaatggattatgcaatgatctctaaaaagccttagtgaaaagtctagcacttgtgacatttaaatggagactacactaaatggaaatacgcatgcattttgtaaaaaagcctatgaaacagaagactcaattagataatcttttaaatattttgcatctctttcatgctgactttcagaacaggtctaaatacattcgcaatataattttcctaatataagagttcataagtatcatgctacacttgttcctaacatcatgcaaagttcctgagaaagatgaaagataaaattagatgttagatttatcacaattggttagaaaaataatatccaaataaagcaggtttgtttccaaccagagaaagaaaatccatttcaagtaaacctaattttcaaagcaatttgtcaaccatgacagcatagttttatacagatactaaatcccaattttaagtgctggccatataaaatttcctagtttggttaggagttataatcttactttttaaaacctcatttcatattttatttccattttcatttttttctctttcctttttcatgtccagaaaccactaagccgtttaagtactgtggaatgcttacaattctccacatcccatggaggtagattattttcaatggaactattgctttgtctgtaaagctaatcaagggatgaaactttaagggcatggatacgtttctttcccatccacagtgactcaattctggaagcaagtcaaatactgaccacagcacctctagttcctctggcacccttaggaccacttttcccaatttttccaggaggacctctgcttccaacttctcctgtgggtcctatttgtcctttatcaccctgtggatgacattattaagagagaaaagcaagaaaaaaatttatacttagattaattaactatatcatattcctgaatagctcctgaggattatctggttaacagtattacagatcactattaacaacaataacataccatcactatataagttattttaaaaataaaagtaattttggaaaaagataaaataaaaattttgaccaaacaagcagggggcatctggtgctcatgttgaatccaaataaccgttttttacttttgaattttgctatatatgtatgtaagtatgcatgtatgtgttgttactataagaaatcataagctctttggaaagtctgtttctatagagaatttcaatgcaacaaggtctgttcaatacaaaaagagctccagtgtgcagttctgtacattcaggatcatcactcattggcttggagtatgccttgaaaaatctgcaacatttttacatcactttacatctttcagaaaactaattatcttctgttttctattagacacactgacctttcttttttgttgttgttttttttgagaccaagtctcactatatcacctaggctggaatgcagtggcaagatctcagttcactgcaacctctgcctcctggattcaagcgattctcctgcctcagcctcccaagtagctgggattacaggcacccatcaacacgtccagttaatttttgtagttttagcagagacagggtttcaccatgttggccaggctggtttcgatctcctgacttcaagcgatccgcccacctcggcctcccaaagtgctgggattacaggtgtgagccactgcgcccagccaacaaactgacctttctttagcaccaaaatatagctgttcttaaacaacattgtgttattcttcattttcctaagtgagaaccaacctgttctattattgataaacaagaagatacaaagaaaaactactgtgaacacagttggacaggaaatttttgggattcataacagctaagaggctttattttatttttccaggggtgcaggttgttattatacaaagacttgcactgtctcactatgaatgttgattttagtaaaatatttttagtaaaatataaagtaagcaaataaaaatattcttgatttgtagttcttcatatatggaaaaaataaaaccaacttagaaaaacacattgacaacaaataattatagttacattctcttccctcaaatactttactaaagttgtcattgaaaagcacaaatggtatagtattttccttttatctttcttcttgcccatggtctactaaaagaatttttggcaaacaagagaaagaaggaaaagccaagattttttacaaactacaaaatggaaaatttgccttcaaataatcacgataataagtactcctaactgaaattaaatattaatttatataaatgtatcttttaaagcaacatttataattctttactactttactatctagtccaaattaaaaacattacagcagtctatggagttctgggcacatcagaagaaagaaaacctgcataagaagatgtaaaaaattaccttttttcctggacgacctctttgccctggaattcccacaattccttcaggtccctaaaatattcaatataaaaaaggaaataaatggttaaagaaaagatgagatggagtatttgaatacttctatcagataatcactggattggattggacgagaagtaaaaatgagggttaattttcacattattaggtttgtatcatttaaaaagaggtcacaatgacttagaggtgtagctgttattagctataaagttcacatgcacaaactggccaagagagtcttaattacactgttcattattctaggtggaacattacttagattcagtatacccattttaattagagagaatgtaattaaagttaacccatgccttctacgtcacaggctgtaaaacacgtttaactaaaataaaaaagtataaacccaaaggcatccatctcagcatttctatcagctactgggagctcagcatcttgtggaaagtacaggacttctgcctatccaatgaagtctccacacacatatgaaagaaagtacagagtataaaatacatctagtacatggtcaaggaaaatttcaatgtgtctagtacgtggtcaaagaaaatctcaaaatctcactggagtagaaagagttaaagagatattcgttgatctgtgggaaaaaaagaaggaaatacagagagaaaaaggaggtaatcatataaaacttaaaaataatattttcatttcaatttgtcctttgtgtagctaaaagtatattaaaagttttcaatatacacttttttttaagtaaaagtggggcactatatgaattttcaggtaaacaatggttaggcttaagtgagttccacagtaagccaggttgcaagttctaaaatggctaataattaatcacaacattccctgcattcgctggaaatgaaaatagaaatctcaaatttgtgtcccaaaagcttggcaaattgcaaaaatgatgtagacaagaaataacttgtggtttaccactgtgctatgtaggctctagataaatatttgttgaacgaataaacagatacctaaggaaatgactcataccctatgctcctgagaaaatgctcttctagcctcagaaaatcactgaatttagaggccaaagctgttgtgctctattgctgtagttatagctgcatccagaggtagaaatggtagttgcactaacctgaggacttctttgaagttaatgaggcctttcaaaaagaggctgattaatcttcatagagattaaaggtgtgagcttttaaaagtcagactgctcccatttcatattctggctctggcacctaacacctacctatacagccgtaggtagattatttaatttctaaaggcctcagattcctgttaaataaaagaggtataaaagaacatcttcaaagactaagagcaaataagagaatgcatgtaaactttagaaaggactagacttatgatgaagagctcaaaatatgctagtcgttattaacttctgctgtttattaaaagtgtattacacaatatttaagtacatgtaaagatgttaaaaggtacaatgaaagcccgtttacctacatctactttaagaaatagaaccaatatatgtgtatgtctatgtgtgtgtgtgtgtgtatatatatatatatatatctacatatatatatacatataattgaagccccacattaaacatatacttatccaaactcatcaccctttttccctactcaggtgcaatcattgtcttgaattttattgttcctacacatttcttaataattttactccatttgtatccccaagtaatatgtattttgtatctttaaaaatttttaaaaagcagtatcatactttatgtgttctcctgaaacttctttttaacacatttttgttttgaaattactgtgtctttaattcatttacttaaaaaaatgctacaggattccatgttattatcaaaccacaacttaagtatttttcccgttggttaatgttttggtggctttcttttgctattacagacaatgctggaataaacactctgtacttgtctctatgtgctcatgtcaagagtttttatagggtatgtaccctggaattgaattgctgggttgtaggatacatgcatcttcaagcatatcagatattgtcaaattgttctccaaagtgattttgccaatttacatcctcaatggcaatgtttaagagttccacttacttcatatttcctataatgcttgatcgtatgagacttaaaatgggtgcagaatgatgttatcatttcaatttatgttattggttattatggaaaaacgtatagctactcataaagttatcggacatctatatctctatgtgaatttctggttcctatcttgtgcccgttattctactgggctgtcttatttagttacatgtatatgtttttatacatacttatattttgttcattccatatatcacaaatctcttctcccagcttgtatcttattttctcaccttgtttattacgactttggactaacacaagtttgcaattttaatgcagtcaaagtcattaatattttctttctgtttcttttagtgctttgttttaagaaatctttactgcttcccctttccttataaggtcataaaatattatcttaaatgttctcccaagagttttaagattttgattttaacagttaagcctttaatcaattggaatgtaattttgcggggtgtgtgtttgtgtgtgtgcgcgcacgtgcgcatttgtgtgagggagagtattttttttttcatttggataaccaattgtactggtatcatttattaaattgttcatttccttatagatctgtagtgcataatcaatttatcaaaaatcaagtttcaaaatatacttatatctgattctacattatcttcaatttccattggtctgtttgtttatttgtgaatgagtatggcactaactaacttaattactctagcttcaataataagttatatcagataggtcagattctctcttccacctcctccacaaccatcccacctctgcacaacttattctttaaagttgtcttaatattggccctttggttttccacacaaatttttaaatcactttttatcaatcaagttttattaaaaatcccattgggattttggttgaaattgtattaagtgtattcattaatataggagaagattgataattttataatattgagttttcctatcatgaatataaaataactgtccatttatttagttctttaataaatgattataatttctttaattgcaaaaattttccacaccatttttacaaatattttgtttagatgtattgctaggtacttaattttgtggctaattgtgttggaaattgcatttaaaaatatctaactgctcattgctggtgaaaaagaatggaacctatttttgtatattacttttatttatttatttagagacattgtcttgctatgttgcccaggcgggacttgaactcctaggatcaagcaatccactcacctcagcctctcgagttactggaagtacaggcgcatgccacagtaaccacagtattatgttttattttttctatctaacttttattttaggttcaaggggtacatgtgcaggtttgttatgtggataaattatgtgtcacatggatttggtgtacagataattttgtcacctaggtaattggcataatatctgataggcagtttttcagtcctcaccctcctcccacccttcactctcaagtaggtcctgatgttaattgttcctttctttgtgtccatgtgtactcaaggtttagctccaacttaaagagaacatgtggtatttggttttctgttcccacattaatttgcttaggataatggcctccagctgcatccatgttgctggttaaggacatgatcttgttctttttctatggctgcataggattccatggtgtatacataccacttttttttttatccagtccactgttgatggagatctaggctgattccatgtctttgctattgtgaatggtgctgcgctgaagataaatgcgcatgcatctttatggtagaacagtttatattcctttgggtatatacccagtaatgggactgctgggttgaatggtagttcttttaaagttctttgagaaatctccagactattttccacagtggctgagctaatttacattcccactagcagtgtataagtgttcacttttctctgcaacttcaccagcatgttattttttgactttttaataaaagccattctgactggtatgagatggtatctcattgtggttttgatttgcatttctctaatgattagcaacattgagcattttttcatctacttgatggccaaatgtatgtctttttttgagaagtgtatgttcaagtcctttacccatttttaatgggtttgtttgttttttgcttattgatttaagttctttatagattctggatattagacctttgttggatgcataatttgcaaaaactatctcctgttcttaggttgtctgtttactcttttgacagtttcttttgctgtgcagaaactctttagtttaattaggttcatttgtcaagttttgtttttgatgcaattgcttttggaatctttgtcatgaagtctttgcaagggctgatgtccagaatagtattccctaagttctcttctaaggtttttatagttttaggttttatatttaagcatttaatccatcttaaattgatttttgcatgtggtaaaaggtaggggtccagcttcaatcttctgcatatggctagccagttatcccagcaccatctactgaatagggtaaactttccccattgcttgttattatcggctttgtcaaaggtcagatagctgtagttgtgtggctttatttctcggttctctaacctgtttcattggtctgtgtaactgtttttgtaccagtacaatattgttttagttactgtagccttgtagtatagtttgaagtcaggtacttgtgatgcctccagctctattcttcttgcttaggattactttggctacttgggctcttttttgattccataagaattttagaatggcttttgctaatgctgtgaaaaacgttcttggtaatctgataggactggcattgagtctttaaattgcttttgagaagtatggccattttaccaatattgattcttcctatccatgagcatagaaggtttttacatttgtttgtgttgcctctgatttctttcagcagtgtcttgtaattctaattgtagagatctttcacctccctggttactgtattcctaggtttttgttttttttttttgagataaagtctcgctctgtcaccaggctggagtgtagtggtgtgatcacagctcactgcaacctcacctcctgggttcaagcgattctcccgcctcagcctcctgagtagctgggactacaggtgtgcaccaccacgctcagctaatttttgtatttttagtagagaaggggtttcaccatgttggccgggatggtcttgatctcttgacagcgtgttccacctgcctcggcctcccaaatattcctaggtattttattctttttgtggctattatgagtggcattaaactcttgatttgtttctcagctgggatgttattggtgtatagaaatgctattaatttttgtacgttgattttgtattctgaaactttgctgaagttgtttatcagatctaggagcctttgaacagagactatagggttttctaggtacagaatcatataatctgcaaaaagagtttgacttcctcttttcctatttggatgccttttatttctttcttttgtctgactgctgtgactgagagttccagtactatattaagtaggagtggtgagagttccatctctcaaggggaatgcttccagcttttgcctattaggtataacattggctgtgggtttgtcatagatgacagttattattttgaggtatgtactttcaatgtcaagtttgttgagggttaacattgaggcacgttgaattttattgaaagctttttctgtacctattgagatgatcatgtgttttttgtttttagttatatttatgtgatggatcacatttattgatttacatatgttgaaccaatcttgcatcccaggaataaagcctacttgatcatgatggattagctttttgatgtgctgctaaattcagtttgctagtattttgttatcgattcttgcatctatgttcaacagggatattgacctgaagtcttctttttttgttgttgtatatcagaatgatgctggcctcatgcaatgaataagggaggaatccctcctattcaattttttggaatggtttcagtaggattggtaccagctcttctttatagctctggtagattatggctgtcaatctggtcctgggcttttctggttggtaggtttctaagtcactgattcaatttcagaactcattattggtctgctcagggtttcagtttcttcctggttcaatcttgggaggttgtatgtttccaggaatttatgaatttcttctaggttttctggtttgtgtgcagagaggtgttcataatagtctctgagggttttttgtatttccgtggtattgatggtaacatcccctttgtcatttctgaatgtgtttatttggatcatctccctgcctgtttttctttattagtctagctaatggtctataaatcttatttattctttcaataaatgaagttttggttttgttgaccttttgtatgttttattctcatctccattttgttcagttcagctttgattttggttatttcagcttttgggtttgttttgctcctgtttttctagttcctctaggtgtgatgttatgctgttaattagatatttttctaactttttaatgtaggtaggtatttagtgctataaacttccctcttaacactgctttagctgtatcccagagattcttgtatgttgtatcactgttttcattagtttcaaagaatttcttgatttctgctttaatttcattgtttacccaaaagtctttcaggagcagactgattaatttccatttaatggtatagttttgagaaatttgtattctaatgattccctaattatatcacctgttctcactccatcactgactttctgattaccctacctaatgatagctctttgcatttgtatttggtatgttaaactttacgcgtccaaaaccaaagtctctaaatccctcctcctaaccctaaactgctttcctcctactcttccccacctccactgtaataaggcaaaatttgaaaattagtaaaatggttttctttcttgcctctttgaatatgaggagtttgcctgttcagcctcaggtgtctgtacgcccaaaggctgaatgccttaaaataatatttttctgttttccttgtttccaacttttaacatttcatgagttgagtctggagcacctagcacacaaagctgtcctgtgatagagaagacactttccatgtattaccataaggcttttactagatgatagaaggatgaggatatgacataggggaagtaaagagaagcatggaggttttgtttgtctgtttgttttggctccaggagaatgtgggaaggcaaaggaggagagagagacatattttcctttttctgagttttgtcagagagagatcttttttgcaattactcatttggaatttgaaaggtatcttttgtagatatcacctggtgggtagccctgtcaatatggttactcaacaacaaagtcaaaatgaggaagaccatatggttaaattttcctgagctactcttcgattcctatatgatgtagatggcaactcagaaacagctgggaagtttgtggcagggacagggtgatcactactctaggaatatatagctctacaataagggctggagagcaggtttccttggctagtactgaataaggaccacaacagacctcagagacatctatagaaattagtgggacctgatgtgagaccagttcagcaagggaaccctcttctccaaaaaaaaaaaaaaagaaaaaaaaaaagacaaagaaaaaaatgaaaattactagatgtaaacatcatcagcagaaaccatcagggtaggcggtgagggaagattaccctgtcccaattagcacaaataacacctgcatcaatatccaaggcatcctcatccttgcaatcacaagacacacagactcaatgttggaaaggagtaaaagagagaggtcaaggactgatacacttgagagactaagcatcttgatagtctgagcacctgaagaaactactactttatatgattagattaagtttaagcattcaactgagtcagattttaaattttctctttgcctgctgccatcccccgcaaccccaatgcattccactaatcagtaagtaggagcttgtgaggaaaaccagatgagccagaaataaagaagttacatatttgcacatctgtaagtacaaatttgttgctctgttacacatttaatggcatgattatccactcagttgctcaggctaaaatctagggtttattatttattactttatcccatcttctcaacatctaaaccaggagcaaattcagttagctatgcctctaaaatatgtcttgaatctgatcattattcactatcactgtgttttctcattccaagccaccaacatttttcatctagactactgccaaagctttataagtggtttggtccacttttaaccccatagctcacttcttcacaatagcccaaataatcactaacaattttaatcatacccttctgcctgttcaaaaccttccaaatgactgtccattgcaatgagaataatcaccaaacctcttatcatggtctataattccctatgatctggctcctaccatttctctgacatcatgttttccaattatttactataatctagatacagggctctttttcatttttttcttttctttttaaaaccccttctgccttagggcctttgcgttagatattccctctatttagaaatctcttttcctcagataatcacataggtggctttctctatgcttaggtgcctggctcaatgcagcctcaggtagtacttctgtgaccaccctaaataggtaacccctttacctggtcactccacatcccaataacatattttctccttattttctccctccttccttccttccttccttccttccttccttccttccttccttccttccttccttccctccgtccttcttccctccctccgtccctgcttcccttctttccttctttccctttcctttccttcttttcttttcttttcggacggtcttgctttgtcacctacgctggagtgcagtggcatgatcatggctcactgcagccccgaccttccagcaatctcaagcagatcctcccaccctagtagctgggaccacaggtgtaagccaccacacccagcaaattttacaaaatttttggtagcgatgggggttctttatgttgcccaggctggtcttgaactccacggcccaagtggtcctcccgtctcagcctcccaaatgctgggattataggcatgaatcactgcactcaatctttatttccttcacagcacttatcactaccagaattatcactcatgttgaaattgtcttcccacattagaatacaaattcctacaaatttcatgacagcatgaaccttgtctgttttgttcactgctgtaacattaacattcataactgtgcctggcttaataaatatttaatgaatgaataaatgaatgacagaatgtatgcccaaaattgaaaataattagccctaatcagacagtaaggtagtctattaggtattcacttgtaagaaaataacattttaaagaacatgcattaaatgttgaaagtaaaaccaaagtttatgagtaaaaggcaaagtagagtgagagattttcataatattttttagcttctagggaacagaacatatgaatctattaggaattttttgcacagtaaacttctgcacatatttaaagaacccattatatgtgagaaaaggggttgcgttattctatattgtattttcttgttattataatcagaaaggtcccccctggttatttgttcagtatttttctcttcaaggatatgttgttgttatattttttttaggaggaagtgtaaatttccactgctagtaggctggtttattttagtgcttttcctgaaatgtgtaagtaatattttgctccaaaatgttggcttttaaaagttaacattgcccactgcaacccatttgtgtatctagaggtttgcagggcatataggaaaaatagcaacttttttttactatgtacatgttaaaatggatttattcaataattacagaaagaagaatgctatttttttggtgtgtgcctatagtcccagctatttgggaggctgaggcaggagaattccttgggtccaggagtttaagtccagcctgagcaacatagcaagaccgcatctctttaaaaatgctattttatacaatttatatatgtcatttatctatgtcatgttgattgagaatagtcagcttggtgttgcttactaataaaatagaggaaccagttgggattccctattttagactttgtgaaagtagctattttgtctcagaagtatcacatcatatctatttttaaaacagatttattgaggaataattaacatttacatatgtgatagttacatgatactatatactcatacatgatatccacgtatcatgtatatgaattatgtgcccatttaatgtgtacaattagatgatttttagtatattcacatagttgtgtaaccatcaccaaaatcaattttagaacattttcgtcacttccccccaaaatctcattatcataagaagtcactccccatttctttccaacccctctagccctaggcaaccactaatccactttctgtatgtatagatttgcctatttaggacatttcatataaaagtacaatatgtgggccaggcacagtggctcacgcctgtaatcccagcagtttgggaggcagaggcgggcagatcacgaggtcaggagattgagatcaacctggctaacacggtgaaatcccatctctactaaaaatacaaaaaattagccaggcgtggtggtgggtgcctgtagttccagctactcgggaggctgaggcaggagaatggcgtgaacctggcaggtggagcttgcagtgagccaagatcgtgccactgcactctagcctgggcgacagagcaagactctgtctcaaaaacaaaaagaaataaacaaaaaacaattcaatatgtggtttctagtgaattgcttctttcatttagcataatgttttcgaggttaatccatgctgcaccatgtactcgtacaccattcctttttattgtcaaataatatttcgcatgttatttattaattcatcaggtgatgcccatttgggttgtttctactttttcgctcttataaatcatgtgctgtgaaaattcatgtacaagcttttgtttaaatgcaattctcttggacatacgtacctagaagtggaattgctgggtcatatggtaagtccatgtttaacattttgcagaaccgccaaactggtttacgaagaaactgcagattttatatctcatcagcaatgtataagggttccaatttctctatatcctcattaacactaaccatcctagtaggtatgaagtggtatctcattgtggttttgatttgcattttcctgatatttgtaatgatattgagcatcttttcatgcacttattagtcatttgtatatcttctttggagatatttaagtctgtccatttttcacttatgttaattatcttattatcagattgttaatatattctggatacgagtcccttatcatatatgattttcaaatattttctcctattatgtgggttgatcttttactttcttgattgtgtcctatgaaccaacaatcttttaattttaatgaagtccaatttatcttagaagacgtactcccatgttttcttctaagacttttacagttttagctcttacatttaggtctatgactcatttggagttcatttttttctgcagtagaaggaagggttcaactttattcttttgcatgtggttatccagttgttccagcactatttggtgaaaagaccattctttctctcactgaattgtcttggcgtatgatgtgcttttctaagtgaaatttattttgttcttttcctgtaattcgtttcatttcttgagatagccaataacactaaccacactttgaataaaacccaaatttcttatcatagcttaaaaagtccttcatgatctacttcctacctatttcttcaagctcatctcaaacaacttttcactatttattatgctgcagctgtaatacccttttagttttctaaaaatactcagctcattctcacctctatatcttggccattgctgcttcatctatcttgaaggatcttcccacagttctttgcttgatgggttcctttttactctccatgtctcaatgtaattgtcccctattcagagaagccttctctcactaccctagctgatatatgttctctatctttaactagttggcttttctacccataatcagttattctctttcattagtatgtttatttccattattgcattatcacaatctgcagtgatcttttaatctttcagtcttcttcattagattataacatttgaggatcaggaaacttggtagtcttgttccccactgtatccctaatgtttagcagagttcttggctcatagaaggtactcaaaaacttcatcgaattcacaaatgaacacaaatattttatagaatcacagtctgtaaggctgaataaaagtttagaaaatctaagacaatgaatttttttaaagccttagaacctttacttccaaagaaaatctacgttaaaaatctatgttaaaaagacatacaaggaccattcctgactgatacaggaatagaaaaaatggggccctgctaacttagcatccctcctgacacaatcatcttgggaagttctgcatagctccaacccgtttgttttgtgtcatgtgtgaacatataaatcaaagaatgactcactcaacaatgtacagctctttagtgggagatgagggacacagtggtcagtgcagggcttgctatttgtgttgctttatgatgaaactgttcagaataaacaagcctaacaccagagtcacagaaaccattcagatgataaagagttagataatcatttactccataatgccacttaatgctgaccctaaattcccaactgattgtttccaaggaaactatgttagaaacaagaaacacttctgtgaagaaagtcaatggtagcttgatggggatggcattgaatctataaattaccttgggcaatatggccattttcatgatactgattcttcctatccatgagcatggaatgttcttccatttgtttgtgtcctcttttatttcattaagcagtggtttgtagttctccttgaagaggtccttcacatcccttgtaagttggatttctagatatttgattatctttgaagcaattgtgaatgggagttcactcatgatttagctctctgtttgtctgttattggtgcataagaatgcttgtgatttttgcacattgattttgtatgctgagactttgctgaagttgcttatcagcttaaggagattttgggctgagacgatggggttttctaaatatacaatcatgtcatccacaaacagggacaatttgacttcctcttttcctaattgaataccctttatttctttctcctgcctgattgccctggccagaacttccaacactatgttgagtaggagtggtgagagagggtatccttgtcttgtgccagttttcaaagggaatgctagacttcaatgttagatctaaaaccataaaaaccctagaagaaaacctaggcaataccattcaggacataggcatgggcaaggacttcatgtctaaaacacaaaaagcaatagcaacaaaagccaaaattgacaaatgggatctaattaaactaaagagcttctgcacagaaaaagaaactaccatcagagtgaacaggcaacctatagaatgggagaaaatttttgcaatctactcatctgacaaagggctaatatccagaatctacaaagaactcaaacaaacttacaagaaaaaaacaaacaaccccatcaacaagtgggcaaagtgaacagacacttctcaaaagaagacatctatgcagccaacagacagatgaaacaatgctcatcatcactggccatcagagaaatgcaaatcaaaaccacaatgagataccatctcacaccacttagaatggcaatcattaaaaagtcaggaaacaacaagtgggggagagaaggatgtagagaaataggaacacttttacactgttggtgggactgtaacctagttcaacaattgtggaaatcagtgtggcgattcctcaaggatctagaactagaaataccatttgacccagcaatcccattacgggtatatacccaaaggattataaatcaagctgctataaaaacacatgcacacgtgggtttattgcagcactattcacaatagcaaagacttggaaccaacccaaatgtccatcaatgatagactggattaagaaaatgtggcatgaacacaccatggaatactatgcagccataaaaaaggatgagttcatgtcctttgttgagacatggatgaagctggaagctatcattctcagcaaactatcgcaaggacaaaaaaccaaacaccgcatgttctcactcataggtgggaattgcacaatgagaacacttggacacaggaaggggaacatcacacactgtcgtgggatgggggaggggggagggatagcattaggtgatatatctaatgtaaatgactagttaatgggtgcagcacaccaacatggcacatgtatacatatgtaacaaacctgcacgttgtgtacatgtaccctagaacttaaagtatatatataaaaaatagacattataaacatttgctattaaaaaaagaaacaagaaacatatatcttatcattcttttctaactattgataatcttctcatctttatgacttcacttttaagatcttatttaaaaaacttattggagaaggtcactttatttcattttatcttcccttaagatatttacctctacctaatatcataccaccttaaacagatagtaaaaaccacatttcaataaatccaaccaaattttgtcctaaacatataaaacaggacaatttcattttaatacatccaactttggagtttatagttgcaaatctgttcagatcttagataacacagtggtagattttttagcatagataacagaccgtaagtcaggcagatgtttcctttcagatgcttcccaattcttttctcatgcagagttatgcatttaggcaactgaacattttagcacaagattcaagcataaaatatacaatttttttttctgtttaaagaaatctaactcctggatttggaattcattactgatgcttcccttgctttatttttcaatccagatctcattctgcagtcctctaggaagtaaggagatcttttcttttcttgaaaaaaaaaaaagttttatttctttctctcactctctttcttatttattttgtaggaatccaaggtagcatctttgtgacactgtctaaggaagaatttttaaagtgcaaaaataaatccagcattagggtgcctgattaagcaatagttccttggattgcaaaattcttttgaaaaaatatgccatggtatttttattgagtttacaagctgaaagccatttaaaattccaaggagaacaacaaaaagaataaaaaaacacacatgtggtgttactaaaaaaaggcaccaaagatgtgtactaggcatgatttttcctgggaaaaattatgaagcagatgaaatctgtgtttatcatttttccatgccttgttttgagtcccatttccatctctgctctactcgtcaccagctgtcatactgtatcattcctctttgggattccttgctgtggtattctacggtatatgtttagactttcccttttcttaattctgttttttccctctctacaaactcttaggattctgctagagaactatgctagttgattttttaaatatacatactaaagtatgaataactgttggtggttttttaacctgaaaacaaatttgacaagaatgatcaggaagataatcacactttcttggcatttgttacttggcttctctgtgggtccaggcctgacactaatggaagagggatgagtcctctaacaaagatgaaaattattaagaactctagaaaggaaaaatatggggccaaagctggttaacccatgggtaagcgaggcttagaaaataaagaaatttctttaatggctgggtgtagcggctcatgcctgtaatcccagcactttgggaggccaaagtagggggatcacttgagttcaggagtttgagaacagcctggccaacatggtgaaaccccatttctactaaaaatacagaaattaggtgggcatggtggtgggtgcctgtactcccagctacttgggaggctgaggcaggagaatcacttgaacccgggaggcagaggttgcagtgagccaagatcgtgccactgcacttctgggtgagagtgagactctgcctaaaagaaaagattctttattaataatttctttagtgattattctttagtaaataaataaagcagtgccatctgctatattatcttgtacaaatctcttagctttttctaagttttttcccagttgtaaaatagggaataataacatctataggttattgggaggattctatgacagtatataagtgaaattatattgtttaatgtttggactaatgatgtttaagataattttgggagctgggcatggaggcttacacatgtaatcccagcactttggaaggccgagtccggtggatcacttgaggtcaggagtttgagaccagcctgacccacatggtaaaaccccgtctctactaaaaatataaaaattagcctggcatggtggtgcgtgcctgtagtcccagctactctggaggcagaggtaacagaatctcttgaacccgggaggtggaggttgcagtgagcctagatcatgccattgcactccagcctgggtgacagagtgagactctatctcataaataaataaataaataagataagtttttgggattcctaagtactttgtatttgctgtgctggaacacccatcacagttctccaggtctgagggaaggacagagaagaaatgggcacttaccactgctgtaaaactgaaaagaaaaaagttgccatttgccagtgctcaaaaataatcttatacttctggtttatcttcattcttcaaatgttactttgaaatatgctattatttgggggtagatgtgttataatattattttaattgctgctaaaggaattatagtcattgataaaaatgaatggtaagacagctagtttgtgtttcatttaagatatttgttgttttcttccagatagagctttcctcttagtcctgcaaacctaattgagctgattggggcagggcccattcaatgatctgcaggttagaaaccagaggaaaagagaaggacagaaaaaaaagctgaaaattataaacactgtaaaccactactttgtcttccagcctgcctgcatgatcagtttactcataattagttcctcagtctttactgagccccaatgtggaaatactggagcacagaagcactgtggtttatgggaaggagtaaagacagagcatctggttttgaagagctatgttttctcttggggaagagacccacatgcttaaatgctgtaatctttaaaaggcagaataaaactgccagagtacagaagaaagagaaaccattttctggtagggtcaaaagggatgactcccaagataggacaatacctccaaaggcatgaacatttacagaagtaaagacaataactttgaggagaacccacgtttaaagatatgagacaagaaaaagggaacagtaaaatgaaacaatagaatgaccagataggctgtatctggaagactataataaattaagcatttaagcaaaaaagatgctattttctctctctcagtctgtctctctctctctttttgagatggagtctcactctgtctcccaggctggagtgtagtgacacgatcttggctcactgtaacctctgcctcctgggttcaagcgattctcctgcctcagcctcctgagtagctgggattacaagcacgcaccatggtgcccagctaatttttgtatttttggtggagaaggggtttcaccatgttggccaggctggtctctaactcctgacctcaggtgatccacccacttcagcttcccaaagtgctgggattacaggcctggccattactcttattatttattcacatcttccacttgtcttgaggtgagagaatttgttcaaaatgatgtttagaacttcctttgaagtaataacaaaattcaggatcagatctgatagctcatattatgcttgcaaagaatttcttgtttcatcctggagctgcgatattactctacaacaataatgtcagttataggaataaagatccaaaatatttaatcaaactcagtttgagacaacataaaacattcctttataaatgctttatgacagaagttacatggcttatggaaaaagtatctttcctctttggatcttaggagggctgataatcagtccttgacttttccttctctctagccacagtttcacatatacaattatccactggatatataaggaggtcagagtgtgtgtaggtttgtgcatgtgtacacatacaggcagtgaattcacttagtatttgaaagtgaacccagcagtacttaccggaaggcctgtttggcctgatctacccaagggtcctataattcctggtaagcccatctctcctttttctccatcctctccaggaagtccccttcctcctggtactccctgtaatgcaataaaaaagttttctataaaggaatacagtgaaataattatgccaataataaacaggtttttgtcacacaaaaacaatgatgtctaatattttaaagattttacaaaacatctattttatatataatcttaaaagtataatttacctttaacccatcttttccctggagaccttcttctccaggagctcctggttcaccctattttgtagcagaaagagtatgattgagtttttttttgctatatcatttatcttattttatttttagcccatagtatatatggaaaatagcaaatttgtgttcacttatttctactactttatttctaaagaggatttgacagtaaaatgagaatgatttaatttgccttgaatagctctgaagatgatttcatgattcagagtgtcataaattcaaatataagatgattccagaatattaataaattttagataattaaagtaatatatatccatttggtagctctagaattttacatagctagacttgtgtttctgagttcaagaaatgtaaatactgcatctcataaagttatagtgctttgctatattgtatttacatgggttaataaaacttgattcagttatgaccactctaccagatttttagagtttccatattttctccctttaagtagagaggtaaagattaaggctctgcaacgtacaaattcaggaaatacagagaacaccacaaagatactccttgagaagagcaactccaagacacataattgtcagattcaccaaagttgaaaagaaggaaaaaatgttaagggcagccagagagaaaggtcgggttaaccacaaaggaaagcccatcagactaacagcggatctcttggcagaaactctagaagccagaagagagtgggggccaacattcaacattcctaaagaaaagaattttcaacccagaatttcatattcagccaaactaagcttcataagtgaaggagaaataaaatcctttaaggacaaacaaatgctgagagattttgtcaccaccaggcctgccctacaagagctcctgaaggaagcactaaacacggaaaggaacaaccaggaccagccactgcaaaaacatgccaaattgtaaagaccatcgatgctaggaagaaactgcatcaactaatgagcaaaacaaccagctaacatcataatgacaggatcatattcacacacaacgatattaaccttagatgtaaatgggctaaatgctccaactaaaagacacagactggcaaactggataaagagtcaagacccatcagtgtgctgtattcaggaaacccatctcatgtgcagagacacacgatggctcaaaataaagggatggaggaagatctaccaagcaaatggaaaacaaaaaaaggcaggggttgcaatcctagtcactgataaaaagactttaaaccaacaaagatcaaaagagacaaagagggccattacataatggtaaaaggatcaattcaacaagaagagctaactatcctaaatatacatgcacccaatacaggagcacccagattcataaagcaagtcctcagagacctacaaagagacttagactcccacacaataataatgggagactttaacaccccattgtcaacattagacagatcaatgagacagaaagttaacaaggatatccaggaattgaactcagctctgcaccaagcagacctaatagacatctacagaactttccaccccaaatcaacagaatatacattcttctcagcaccatatcacacttattccaaaattgaccacatagttggaagtaaagcactcctcagcaagtgtaaaagaacagaaattataacaaactgtctctcagaccacagtgcaatcaaactagaactcaggattaagaaactcactcaacactgctcaaccacatggaaactgaacaacctgctcctgaatgactactgggtacataacgaaatgaaggcagaaataaagatgttctttgaaaccaatgagaacaaagacacaacacaccagaatctctgggacacatttaaagcagtatgtagagggaaagttatagcactaaatgctcacaagagaaagcaggaaagatctaaaattaacaccctaacatcacaattaaaagaactagaaaagcaagagcaaacacattcaaaagcacaccgaaggcaagaaacaactaagatcagagcagaactgaaggagatagagacagaaaaaacccttcaaaaaatcaatgaatccaagagctggtgttttgaaaagatcaacaaaattgatagaccgctagcaatactaataaagaagaaaagagagaagaatcaaatagatgcaataaaaaatgataaaggggttatcaccaccgatcccacagaaatacaaactaccatcagagaatactacaaacacccctatgcatataaactagaaaatctagaagaaattgataaattcctggacacacacaccctcccaagactaagccaggaagaagttgaatccctgaatagaccaataataggctctaaattgagtcaataattaatagcctaccaaccaaaaaaagtccaggaccagatggattcacagccgaattctaccagaggtgcaaggaggagctggtaccattccttctgaaactattccaatcaacagaaaaagaggaatcctccctaactctttttatgaggccagcatcatcctgataccaaagcctggcagagacacaacaaaaaaagagaattttagaccaatatccctgatgaacttcagtggaaaaatccttgataaaatactagcaaattaaatccagcagcacatcaaaaagcttatccaccatgatcaagtgggcttcatccctgggatgcaaggctggttcaacatatgcgaatcaataaatgtaatctagcatataaacagaaccaaagataaaaaccacatgattatatcaacagatgcagaaaaggcctttgacaaaattcaacagcccttcatgctaaaaactctccattaattaggtattgatgggacatatctcaaaataataagagctatttatgacaaacccacagccaatatcatactgaatgggcaaaaaactggaagcattccctttgaaaactggcacaagacagggatgccctctctcaccactcctgttcaacatggtgttggaagttctggccagggcaatcaggcaggagaaagaaataaagggtattcaattaggaaaagaggaagtcaaattgtccctgtttgcagatgacatgattgtatatttagaaaaccccatcgtttcagccccaaatctccttaagctgataagcaacttcagcaaagtatcaggatacaaaatcaatgtgcaaaaatcacaagcattcttatacaccaataacagacaaacagccaaatcatgagtgaactcccattcacaattgcttcaaagagaataaaatacctaggaatccagcttacaagggatgtgaaggacctcttcaaggagaactacaaaccactgctcaacgaaataaaagaggacacaaacaaatggaagaacattccatgctcatggataggaagaatcaatattgtcaaaatggccatattgcccaaggtagtttatagattcaataccatccccatcaagctaccaatgactttcttcacagaattggaaaaaactactttaaagttcatatggaaacaaaaaagagcctgcattaccaagacaatcctaagccaaaagaacaaagctggaggcatcacactacctgacttcaaactataccagaaggctactgtaaccaaaacagctggtaccaaaacagagatatataccaatggaacagaacagagccctcagaaataacaccacatctctacaaccatctgatctttgacaaacctgacaaaaacaagaaatagggaaaggattccctatttagtaaatggtgttaagaaaactggctagccatatgtagaaagctgaaaacggatccctttcttacaccttatacaaaaattaattcaagatggattaaagacttaaatgttacacttaaaaccataaaaaccctagaagaaaacctaggcattaccattcaggacataggcatgggcaaggacttcatgtctaaaacacaaaaagcaatggcaacaaaagccaaaattgacaaatgggatctaattaaactaaagagcttctgcacagaaaaagaaactaccatcagagtgaacaggcaacctacagaatgggagaaaatttttgcaatctacccatctttcaaagggctaatatccagaatctacaaagaactcaaacaaacttacaagaaaaaaacaagcccatcaacaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaaatgctggagaggaggatgtgtagaaataggaacacttttacactgttggtgggactgtaaactagttcaaccattgtggaagacagtgtggcgattcctcaaggatctagaattagaaataccatttgacccagcaatcccattactgggtgtatacccaaaggattataaatcatgctgctataaagacacatgcacatgtatgtttattgtggcactattcactatagcaaagacttggaaccaacccaaatgtccatcaatgatagactggattaagaaaatgtggcacatatacaccatggaatactatgcagccataaaaaaggatgagttcatgttctttgttgggacatggatgaagctggaaaccatcattctcagcaaattatcacaaggagaaaataccaaacactgcatgttctcacttataggtgggaaataaacaatgagaacacttggacacaggaaggggaacatcacacactgtcgtggggtaggggagggggaagggatagcattaggagatatatctaatgtaaatgagaagttaatgggtgcagcacaccaacatggcacatgtatacatatgtaacaaacctgcacgttgtgcacatgtaccctagaacttaaaatacataaaaaaaaaagactaaggctccggtacattaattagttgtcttttagatatggaacttgcagaaatgtagagccatactttatgaagctattaaagtaggactggctctcttgatactaaaattatttaaaagtaaattaattagtgcatatttatagttgctccatctttcccattcaccccaccccacccaaaaaagagaaagtaaaaaggaagaagccagatgcaaaatatatctccctactttgccttttagtgaataaatgtctgttaaaattatcttgggccctattatcttaggaaaaaactccttaccacagctcaaaataaaggctgtctatattagcataacgtctcaaagctatctaattgcaacaatttacaattatgtccttgcatcttgttaactttgcatgatcataggtttggtttttttttagagcaagttaaatctataaattagatttcaatcttgttaggtcaggaactattctgagagttgttcactggtatttgtgaatttcttcttaatgctaacattagtgacaatcacagtgactccacatttttggtaagggttctgcaaagtatacctgattttgagaaaaggacatatgaggttaagactgtaaatactactaaattagaatagggacaaggtttgggatgcagcttttgaaagtatgaaatgaaaccaaacattttctataatgtatcagaaaggtttattatccaattttttgagtgtttcgaataataagttttgagcctctgaaagaagtgggttagtgtattaaaagagtttcaagggggcactcacccgtaaacctggttccccagttcctccaacactgccagcagttccaacatctccctgaagaaacaaagggaaagattaaactcttttctactaagactgcatggctaattatggagggcatgccatacggcacagttccccaacgcctgggccgtagagggtacctgtccaaggcctgttaggaaatgggctgcaaaacagcaggtgagcagctggtgagccagcattactgtctgagctccacctcctgtcagatcagtggcagcattagattctcatagaaacacgaaccctattgtcaactgtgcattcgagggatctgggttgctcagtccttatgagaatctaatgcttgatgatccgaggtaggacagtttcatcctgaaaccatcccctgctctgcttccatctgtggaaaaactgtcttccatgaaacttgtccctggtgccagccaaataggttggggactgctgtcataaggaataggagttccaaaacatttcctgtttttatctgggggcttccacctgctttcaagttagcaaatataggggattcaatggtagcaaatgtagggggttcaatggtgaaagtttagagattctcctttattttttagaaggttacctttgcacctggttcaccttgcagaccagactctccctcagtgcctggaggtccctacaagagaataatttaacacattacaaaggcaatagcaatctcatgagaagatggtggtaacactgaactcaagggtgagatacctgtgtccaaaagggcataattgctgtccctttataaacttcatagcataagagcagattctttctgacaccctttaattgtttaaatgtcaagacaacttcgtctaaaattaggacttttaagatccatttcttctaatcctttctctcatcctttaaacctcatctaaagggatttgttcttcctttccctttctgtagtgccttcaggaatctacttacttaaaaaattcacttttccttattggtttcataaaaatatcatgcaaataagagataaatttattcacattataaaagacacacacacacacacacacacacacacacacacacacacacacacacacagagcttcttttccagccttctttcatggtgggtccatttttgttgggaagctttcagttttctttactttgagaacatagaagttcttgcaacctctggctatttccaggcctaaagttcctactattgcttgatgttacaactatttttgtctccaagagatatttaccttatttataaacatgctatgtgtgcccctcccttccctttagggaagagaagagttttattggggacacgggtgaacaggtctgcagaaattaaatcatgtaaaccattacttatcatgttaagaaattggcattttatcctaaaggccatgagagctcttgaaacatttaaaggaaacgaatgatataagaatgataaaccggcaacaagtagaagatggaattataggagttggaggagacatggcatgagagtgtaggggctattacactggcaatagggataaaaaggaaagggtagatttaagagagaatgggcaggggcaggcctattcaaaaggaaatggtcactgatttgagaggattaggtagaagaaggagtctaggatgactcttagttttgggttattgggtataagggatatctttcattgagatgggaattaaacagaggaagaacagtgggacagtaatggatttggtttagatattttgaattgtagatgtctgtgggatatctaggtggatgtttaaaaagataacaggaaatcaataattggatctgaggagagaggtataaaatacagctaccaagttgagagctatcagagtaatattggtacttaaagtcactgtgataatatgatcactaagccaaggaagtaaaagggcaacttcaggtcaagactgagaaaggctaatgagaaggtgaagtgacaacaggagagagcagtttcacagcagccaaggaaggaaagaatttgatttatttagtgctaaagttacaaacaatggaaataaaataattggatatttataacaaatttggcttataattccaaaatatatcccaaattgggtaatgtctcagtattcttctatacagggcatataatatcttaggatgaaaggttatcaagtcaactttaaatcagtgaagggaaagctctatctactttttgttctgtcatttcaatgaggtaattattagagtagaactttatatgtataaaattagacatataataatcatctctgcttttaatggaattttagtttttttctgaatatgaaacaatactatagaattattcctcatagtatatatttaattattaattttaccttagagtcttacaaaaagtagaatatttatgaagaagaactagccacaaaaaatttacctccatgcccatttctccaggaggtccaacatcaccttgcagtcctcgcagtccctatattaaaataaaatttaagatatgagaataaaagtttactctatgtcagtaaatgtattcatctggatatgggttttataatataacacataacacatgattatgtaaatacataatacatttatcagcatattactttactctgtataaacaaaattatatctttaattgattcatgtatgtgtgtgtgtttttgtttttgagactgagtttcactctggttgcccaggctgaagtgcaatggtgcagtctccactcactgcaacctccgcctcccaggttcaagcgattctcctccctctgcctcccaagtagctgggattacaggcaattgccaccacgcatggctaattttcatatttgtagtagagatgggatttcactatgttgaccaggctggtcatgaactcctgacctcaggtgatccacctgcctcagcctcccaaagtgccgggattacaggcatgagccactgcgcccagcttcatgtgtgtttttaaaataaatttactaagctatgcttatattaaaaagaaaagagtggcattcattcttttattctttaatgcactcattcattcaacatttattaagcacctcataagtatcatatattgtgctaagcattttgacaaggtatcttatctaatgtatgtgatagtcattcatctacttaaaattcctagcaaatatgtgacaaacaaatttgcatcttaaagaagtaaatatatgatctttttttttactgactgtacagttttacccctcaagagtgtcatatagttggaatcatacagcatgtaaccttttcatactgacttctttaacttagcagtatgcatttaaagttcctttatacatttttgtggcttgatagctcatttatttttaatgctgaataatattccattgtatggatataccacagtttgtttatccatttattcattggacattgttttagttcactcaggattctataacaaaatagtataaattaatagcttataaaccacacaaatttatttcccacagttctggaggctggaaagtccaagatcaaggtgctggcagattcagtgtctggtgaaggcccacttgctgcttcatagatggtgccttctagttgtgtcctcacatgttagaagaaatgagctagctctctcgtgcatcttttacaaagacactactcccaatcatgagggcacagcacctcaaagatcctgccctataataccattaccttgggaattgggatttcaacatatgaattttggggaaacacggtccaattatagcagacatattggttcatattggttgcttcaaattttttgcacctataaataaagctgctataaacattcttgtacaggtttttgtgtggacataagttttcaactcatttgggtaaacactaaggattgtgatcactggatcatatgttaagagtatgcctagcttcttaaaaaactgccatactgtcttccaaattggctgtaccattttgcattctcaccagcaatgaatgagagctcctgttgctccacatccttgccaacctgtggcattatcaaagttttagatttcagccattctaacagatgtatagtggtatgtcattattgttttaatttgtaatttactaatgacatatgatgttgagcatatttttacattcttctatgccatttctatatcttctttggtgtggtgtctgttcagatttttgccaacattttaactggtttttaaagaaaattgttgagttttaatttttttttctatattttggatacaagtcttttatcagatatatgttttgaaaatattttctcccagtctgtggactgtctcttcattctcttaacagtgttttttcaaggcagatttaaaaagatgttaatgaagtccaacttaccagttttttctttcatgggttgtgcttttggtgatatagctaaaaactcatcaacaaacctcaggtcacatagattttctctatgtttatattttaggagttttatggctttgttttttacatttaagtctatgattcattttgagggtgtgtgtgtgtgtgtgtgtgtgtgtgtgtgtaaggtgtaagatctgcatctagattcacgttttgcatgtggatatctatttgttccagcataatttgttgaaaagactatccattgtattgcctttgctcctttgtcacagatcacttgattttatttgtgactatatgttgtgtatattgtgtagaacaaagagtataactgttctatttctgggcttaccactctgttccaatgatctacagtcgacacttaaaacaacataagggttacagtgccaacctcctgcagagttaaaaatctgagtacaacttttgactcctccaaaatgtaaccacttatagcctactgttgactggatgccttactaataacataagcagctgtttaacacatattttatatgttatatgtattgtatactgtattttaaagtaagctagaataaagaatactgtattcttaagtggaagtagagcatcatcaagatcttcatcctcattgtctccatgctgagtaggctgaggaggtggaagaagggaaggggttgttctcactgtctcaggggtagcggaggtgaaagaaaatccacaaataagaggacctttgcagttcaaacccgtgttgttcaagggtcaatcgtacttgtctattcttttgccaatatcacactgtcttgattactgtagttttacagtaaatcttgaagtcagtgtcagttctccaagtttgttcttcaatattgtattggctattctgggtcttttgcctttccataggaacttcagaatctgttaatatctacaatgtaacttgcttggattttgattagaattgaattgacttgatagatccatttgtgaagaactaatatctcaacaatattgagtctttctacccataaccatgaaatatccttccatttatgtagatctttaatttctttgataaaagtttacctcatatagatcttgtatatattttgttagagttacaactatttctttctctcttttttggtgctaatgtaaatagtattgtgtttttcattttaaattccaattgctcattgctgttaatatagaaaagcaattgacttttgtatattaacttataccctgttatgctacaatctcattataactgcttattagtttcgggagtttaaaaaatcagttcttgaagattttttacacagacagccatgccatatacaaagaaagacagttttatttcttctttccaaatttgtatactttttcttttcttttcttattgcactagctaggacttccagaactatgctgaataggagtcaaaatttaacaaaggaggaacatgttttccttattcccttgttcttaaaagaaaagtatctagttttctcaccagtaagtataatgttggctataaggttttttaaaaaatatgtttttcaaaaagctgaggaagtgcccctttattccaagtttgagagttttttttttatcttgaattgttgttggattttgtcaaattatttttctgcatcttttcatattacattttcatttagcttattgaggtgatggattacattaattgacattctactgttaaaccagccttgtatacctggaaaaaattccactgggttatgatgcataattctgtttatacattgtttgattcaatttgctaatattttgttgaggattttacatctatgttcatgaatgatattggtctatagttttcttgtgatgtgtttgtctggttttgtttttaaggtaatgctcacataatggcctcatgtgtgtggcctcacataattaggaaatattctattgtttctattttctggaacagcttgtacataattggtatcatatgttctttaaatgtttagttgaattcaccaatgagataacctggaaccagtactttctgttttagaaggttattagtgattgattctatttctttatcaatacaggttgaggaagatattgatggatatcaaatcaaatcaaatcaaatcaaatcaaacctattcaggttatccctttctgtttatatgagttttggtaaaatacgtcttttaaggaattggtctatttcatttaagttatcaaatttgtggaaatattgggaggccgaggcgggccgatcacgaggtcaggagtttgagaccagcctgaccaacctggtgaaaccccatttctactaaaaatacaaaaaaaaaaaaattagccaggtgtggtggtacgcacctgtaatcccagctacccaggaggctgaggcaggagaatcacttgaacccaggaggtggaggttgcagtgagctgagatcacgccactgcattccagcctgggtgacagaacgagactctgtctcaaaacagaaaaaaaaatttgtgaaaatagaattgctcataatatccatttattgtcattttaatgttaatgagatcagtagtgatggcctctctttcacttctgatattagtaatttgtattttctcctttttttccccttggttagcctggcctgaggttgattaattttggttgcattgatgttctctattgttttcctgttttcaatttcactgatttctgctgatttttattacttattttcttctgcttactttgtatttaatttgcttttcttttatagtttcctaggatggaagcttagattactaatcttaagtatttcttctttcctcttattcagtgctataaatttccctctaggcactgcatcccacgaattttgacaaactatattttcatttagttcaaaatatttttaaattattcctgaaactccttctttgaccaataagttattaaaagtgtattatttaatctccaaatgttttgggattttccagccattttctgttactgtggtgtgagagcaaacattgtatgatgtctagtcttttaaatttgttgttggccgggcgcagtggctcacgcttgtaatcccagcactttgggaggctgaggcgggcggttcacgaggtcaggagatcgagaccacggtgaaacccgtctctactaaaaatacaaaaaattagccgggcatggtggcgggcgcctgtagtcccagctacttggagaggctgaggaaggagaatggcgcgaacccgggaggcggagcttgcagtgagccgagatcggccactgcactccagcctgggcgacagagcaagactccgtctcaaaaaacaaaaaacaaaaaacaaaaaacacacgaataaaaaaatttgttaaggtgttttatggcccagaatttggtctatcttggtgagtgttccatgtcagtttgtgaagcatgtgcattctactgttgttggataacatattttataaatgtaaattagatctagttgacttacggtactaactctctcttgactaattttctgcctgctgggtctctcaattactgatagaggggtgttattgtctccaactataataatagagtcatctatttttccttgaaaattatctcagcatttgcttcatgtattttgatgctccgtcgtcaggtgcattaagtactgttatcctagcttggagaaatgaccctgctatcattgcaccatgtctctctttaccctgacaattttccttgttctgaagtctgctttctctgaaatataaatatttccagctttcctttgaatagcgttagcatggtatactttccttcatatttcacatggatttcttgaagacaacatacaattgggttttgctttcctattcactttggcaatctcttatttcttaagtggtatacttaaaccattgacatttaagtgactatgatatcattgagttagtatatatcaactgtggactgcgttagttttcatttgttgtctttattctttattgcttcttcttctttcgtcttcttcttcttctttttaatgtttttggcttctcattttattttattttaatttttatgtctatttcttttttgagatagagtctcactctgtcatccaggctggagtgtagtggcatgatctcggtgcactgcaaactctgcctcctgggttcaagagattctcccacttcagccccctgagtagctgggactacaggagagtcccaccatgtccaactaatttttgcgttttttggtagagatggggttttaccatgttgtccaggctggtctcaaactcctgaccacaagcaatctacctgcctcggcctcctaaagtgctaggattataggcatgagccactgtgcccagtctggcctctcattttaattaagcgttttatatgatttcattttctttcctggtttagcatacaaactatactacttttaaaactttttaaagtggccactctagagtttgcaatacatatttacaattaacccaagtccattttctttctttttttaaaaaccctacagcacgtggtattcctaggccatctccaatccctgtactaaccagtcctgaccctgtttagcatccaagatcagatgagattgagaacattcagggtgctatggccattgatcaagtccattttcaaataacactataccacttcatgagtagtgccaatactttataacaattcctccctcttgttccttataacatttgacttatccatgagatacaataccgaatacactgttgctattattattttgtacaaattgtctgttagatcaattaagaattataaaaatattttattttacctttatttattccttcgccaacactcctttcctagatgagtttcttacctatgccacttttcttctctctgaagaacttcttttaacatttcttgctggtctgctagtgacaaattctttaaatttttgtttgagaaagactttatttctctttcactttgaaattcccagtttcataattccaaaatgtctgctatccctgagtctgtttctgcttgtctctgtagactgtttttgccttttaccttgccttataattttttttgaaagccagacatgatgtaaatgtaaatgaaaccaaggtgaataggcctttaatgtgatatttgatattatctggctgggggttaggctgtgtttactggttgttgtagctatggtgtctcaggctaaaatgtcctctaatgtcattgttttttactcccctgttttatttagcctttctgagggactctttaaatagggtttgtggcacagttcctttagctataatctgttattgcacaggaaccccactgatttgattgtaaggtatgagtgtaggaagggcattctatagttctacaattaggtctcagtcttttagtgagtctgaattggatattacccttcttccacatcaaaggccagagggggctggagtggaatatttctcttcctccagctgaaggctagagggaggtgaaattaggttttcctttcccaaaggtcagttagtctttggtaaaacaccagtttattctctgataaataatttccctggagggcaagaactgttaaggagatcagagaattctaggtgtttttcaaaatgcttactatccctctccctctgctggaagtcagagggaatttttctctatctttaaagtaagaacctgttagggctctgggaggaagtaaaactcaggaacatgtaggggcctcccaaagactgggccctctctgagttttttaacactcaagctggtctacactgagtctccagtaatttgctaattatagtttaaagtgtccctactgtcccggtgtgggctatgtagttgcctgtctgtctctccattttgggggcagtagtttgtcttgtaaccttaattctctgacagatctaagaagagttgttgattttcagtatgtccatctttttttcttgttttgaggatgggagtgatgacttccaaattccttacatttcataccagaaaacacatttatttatttacttatttagaggcagagtcttgttccgtcacccaggctggagtgcagtggcgcgatctcggctcactgcaacctccgcctcccaggttcaagtaattctcctacctcaggttcctgagcagctgggattacaggcacccaccaccatggctggctaatttttgtgtgtatatatatatatatatatattttttttttaagtagaaactaaatgttggccaggctgatctcaaactcctgacctcaggtgatccacctgctttggcctcccaaagtgctgggtttacaggtgtgagccaccgtgcccaactcagaaaacactttactattgtcaacctaaatgacaaagagaaagaggctctctaaaataaataacgaatttattttggaatagagcattgcaatgggaatatgcatgccatagtaagctatgcacatattcagggagataaaggaaggtaatggtttttaaaggaaaaatgaggattatataattgttttgaaatgattatccttggctaaaaatatcaacaacaatggtgacaccagtccaaggctggacaggctgttgctgggcagatgtcttttcagaagtattttttgtatatgggtgcaaatgtcctttgggcaaggttgtgatttttgcaattttttgtgatagtttttgttatcaggcatctaagaatgagaactctgtctttatggccttcagctctatttgtcaggtttttcttttattttcttaacatcagtgactccattttgattctgacaactttcacattatgatttttaaatcttttttaggggggagactggattcagctagaagccaaattgtgttccacacacaataactttttttttttttgagatggaatctcactctatcacccaggttggagtgcagttgtgcgatcttggcttgcctcctgggttaaagcaattctgcctcagcctctcgagtagctgggactacaggtgtgcaccaccacatctggctaatcttttgtatttttagtagaggtggggtttcactatattggtcagactggtcttgaactcctgacctcaagtgatccatctgcctcggcctcccaaagtgctgggattacaggcgtgagccaccgtgcttggcccccatgcgatgatttttaaagaatcaaaaatggttggctggatgtggtggctcacacctgtaatcccagcactttgggaggcagaggcgggtggatcacaaggtcaggagatcaagaccatcctggctaacacggtgaaatcctgtctctactaaaaatacaaaaaattattggggcgtggtggcatgcacctgtagtcccagctactcgggaggctgaggtaggagaatcgcttgaacctgggaggcggaggttgcagtgagccaagattgcaccactgtactctagcctgggcgacagagcgagactctgtcttaaaaaagaaaaaaaaaatggttgctaaattttagactacttgcttttgtatttctcattatatctgtgatatattaatagatttcttaataacaaacttttccttgattgtaattcttccttttacttcattaaggtggataattctttatatacatggttaaattttacttaattttttgtttagatttttacaattacatttgtaagtgaaattcatctgccactttattttggctgctctctttgtctgactgagatgctgatatagagtactcttatcttttgtttccgagactgttgccactttatctttacaagtgatctaatgaggaactgagtgaagttttattatacacttttagttaacttgagaatcctgttaactattttttgaggtaagtggaaatgacttctggtatctaagaaagagtagctagaaaataatattttaaaatttacaaggggatattataaagcaagcttatgaagagttaattttagagtacagcattccccttgttccctctttaaagtcagttttcaataattaacagatattaactatatttatttaggtcaggagattttttttcaacttgtcttctgaaacggaagaataaatgaacaaaataataaaagagagaatggacaaatatcaccattctcctcttattgaaggcgattgggtacagttgtgcaggttgaacactacataaaccaagggacattatttgttacaaggtttgcattgattagacattttctttctgtacgtgtgtgattaaaatctacatcaggggtcagcaaactttttttttttttcaagggcaagacagtaagtattttaggcttgtgggtcatgtggtctctgtcaaaacttttaaactttgctgttatagtatgaaagcagccatccatacataagggaatcgttgtggctgtgtttcaataaaatttgatttacagaagtataactggactgagggctgtagtttacctatcctactttatgcctacgtacttctaaggggatctaatattatcatgaagattttaagatgggttatgtttatggctgaaactcctaacttacatgtctgattttcctcttattctctcagtttcttgtgcagtttcaaccttttctgccagcgttttgtaaatgttgtagttctttaagcctcagccttagatctttttcttttctcacttctatactctttccataggcaatgaatccaacattttttaacttcagtgtattcctctactctgaagccaactgccaacttcatgtttctcaaagacacctgaaattcaacagttaaactgaatttataatcttccattctcaaacctacttttccgtgtttttttttgtttcagtgaatagtatcatcaactctttaatacaataagccagaaatttaagaattatacttcacatacagagtctttattacctattggttttatctccttttgaattagtctgtccacttcttttccctgctcataaaaaaggtcctgccattttttatctggattattgcaacagccagccattcttggctccctccattttgtaatttgactgatgtttacaaaatagatatcagataataaactaaataatctgataataaagctagcccgagccctttaataacatcctttgttctaaggataaaaattaaaaatgttggcaatagccctcataaatctatgagtgttttgtcacctgcctcatttctatccctatctggcacttacttatatataccagacattataccaggaaaggggattacaaagataaaagaaatggtctctgatttcaagcagtgtacagactttttaggggatatacttaagtaaataatgctaaagagagttgcattattttaggtcagataaatatcagaattgaaatggcaggttaagatatacataatagggagaaaaccaagaaggatttagcttaaaaaatcaacaacatatctaagattctttatttggaaagaactataaatactgtcaaatcttcacttattgtttgagagcttatatcacagattaagtatataaatgaggaaaaagctaaggtaagaatagctcttttagtgttagaattttccatttgctactaactaaatgaattatacaaaagccacctgtaaacctttgtgtcaaccgataataaaatcaatgcagttgtttgaaagactatattgtattgtacatcttagaagcacattatagcacattacatctgacactattaaccagaagaatgacttcattggcaaaaaagaataaattgtaagaaagtaggtgtgacaggtctttccttttcacaacgtaccgtccatggaaactccataattgaatcatatttatgaaactatttcataatgatttcataagtttttgtattgatgcaagcttttgtactgttgatgtaactgcatttctgtcatgtttgcacattttggcccatcagatgtaaaatttggcttctctctgtatggtcttctaattatagaaattgcctcataaatgtgattgtgcgtgtgtggcaacataataattataagaacagcaagccattcagaaagagaatttctgagattcaataaaacagagttttatttgttgaaaatagaaatatgctcagatttaacagctccagaaaaacagcaccatatttgactatatgcaaccagaaaggcactataaactattatttttcattctatgtgattagtctatggtgtctatgataaatgctgctttctaaaacataccagtcacagcacagcagagcaataatggaaatgtaaatgtattttatgagaaagacacaattagaaaagtataaagataaacttactggctctcctggaagtcctctgtcacctgtacttccaggcaatccctgtaaaccctggacaaataaaggcaatacttgtaggaaaagtggtgtgtgaagatgttttagacactttccttaccttagctttcctatggatccttccacccaacttttctgtctattgctattctttttttttttttgcttttgtggtaagatacacacaacataaaatttactattttaaccatttttaaatgtaaagtttgtggcagtaagtgcattcacaatgttgtgtaaccgttaccagaactttttcatcttcccaaactgaaactctgtacccattaaatactagctccccatcacccctttttttctatttcctggcaaccaccattctattttctgtctccatgaatttgactaccctaagtacctcatattagtgagatcatacaatatctgtctttctgtgactggcttatttcacttagcataatgtcttcaaggttcatccctgttgtagcatgtgtcaaaacttcctgctttttaagattgggtccactgtatgcatattccacattttgtttacctattcatctatcaaagaacatggatcacttccaacttttggctattgtgaataatgcggctattaacatgggtatgcgagtatctgtatgagtcccttttttcaattatttgggtatctacctagaagtggaactgatagatcatatggtaattctctgtttaacttcttgacaaaccaccaaactgttttccacagcagttcccctattttatatttgtaccagtaatgcacaagggttctaattcctccacatccttggccacacaaattttctttttttttttttagaacagcattctaatgtttgtgaaatagtatcccatggtggtttgattttcatttccctaatgactagtgatgttgagtatcttttcatgtgcttactggccatttgtatatcttctttggagaaatgtctattcaagtcctttgctcatttttccatcaggttgtttttttattcttgagttgtaggagttctttatatctacccctatttttatttaatcctcactcctatattgtgacaaataattatccaaaattattttaaatctgaatttctttatagttttaatattcatataaagtttcctttttccaaaaataataatccttgtgatgtgttaataagtatgacttttgcctttaaaccctggcaaggcacaggagtcttggaacctagataactggaaataaccatactggacctgtaacttccttttttccccatctttacactctttgtagtaccataaaagagcatctcagatatgaagtagatagaacactaaaccaaattctgagtcttctctgactcagtcaaagatttattgagcatttactgtgtgcgaggcactgatgaccactgacaatacataacatgttgatccttttgtaaattgcatctttttttcttttttttttttgagacggagtctcattctgtcacccagactagagtgcagcagcatgatcttggctcactgcaacctccacatcctgggttcacgccgttctcctgcctcggcctcccgagtagctgggactacaggcgcccgccaccacgcccggctaattttttttttttttttttttgtatttttggtagagacagagtttcaccgtgttaaccaggatggtatcaatctcctgacctcgtgatccacccgccttggcctcccaaagtgctgggattacaggcgtgagcctctgcgcccggccgtaagttgcatcttctacattattgatctcaggaaagctgataactatacagctaatcacaaataccattttaccttaaaaactaaaaggtataaaaatatgacattaaattagaagtaaagatattcaaagttcttagcaacacactatcttctaagttataatctttaatgctatgttcagtttttctggctagggaaagggaaatatgtaaaattatggactcccatctggttgaggccctgtttcagtcatgtaaatgatatggtgcctatttactccaggatccttaattaagagagaggatcattataaggaatctctctgtgcctagtacaccaactgaaatatacagaaaacttcagaactttaaataatgtctgcccaattttctttgtaaagtatgtttagacataatatcaagcttatcatgtacttttaatgctgttgatactgcataaaagctcttttgcaaagctacgaaataatttaagtggactctgtttttattggggataaagaggaaaagcacaagctggaataaaataaaaattatctttaaggcttttcagaactcccttctctatgacttcaacccagtaactatgataatgatgaccatgaggataataatgactattttggttgttatttattagagcctgtgccaggaacataataaatatcatttgttatacatttattatgactatgaaagatttcctatatcaaagatagagaaactgaagcccagagaagttaagtaatttgtacaaagtcaagactgctagtaagtggcaaaaccaatatatgacttccaatatgattgattccaataaaatataatgatacattatatgcaagggattaattttatatatatataactgtggactacttatcagaaataccagcggccaaaagaaaatggcaagttatctttatagtgctgaatgaaaacaaaaaatcccccaaaagactctgtcaacctaaaatctgatatccggtgaaagtatacttcaaaagtaaaggaaaaataaagacattttataaacaaaaactaagagaaatatgtactagcagactttactacaagaaatataaaggatgttctataggttacaggaaaatgacaccatttggaaacacaaatcttcagaaaggaatgaataacatcagaaatggcaaatatgtgggtaaatgataaacattttttccccattaaacatctctaaagtatgtatttcatttacatcatgaaaatattttatttatattaaagcaaaaatcataactttgcaatgcgtagtttaaaatatatgtagatgtaatacataaaataattatagcataaaaaatattagtaaatggacctatattgttggcaagtttcttacacttgtgttaagtatttacataaaatacttattttgtggcacttcacaataaaagtttgctgtcccttgacctagaataaccatggaaaattatgagaagaaatagagctaaaaatccaacagacagattaaaatagaattctcaaaattattcaatgccaacagaagacattgaacaataacaataaaaaggacacaaagaaaaacagatcattaaatgggagacccaaatctaaccacatcaattacgtatcaataattacattaaattgaaattgaacaaatgctcaaattaaaaggcagaaattgtcagaatgaataaaacacaaggtccaactataagatattcactttaaatatcaagacacagataggttgaaagtaaattaaggaacaagatatgccatgtaagcagcaagcataagaaagctggagaaactttatgtgagtattaatatcagataacatatacttcacaacaaatagtattaccaggagtaaaaagtattaccagagataaacaagaatattttttaacaaaaaaaggatcaattgatcaggaagacataataattataaatgtgaataaacttacaatagaatttaaaaatacataaagaaaaattagaaagaattaaagggagaaatagagaaacacaaaaattatagttgaagaatttttacacccatctcacaaactgatagactatctagataaaaaaaacctcagtaacgtatgagttatgatagtttttatattatttagagaacctaaaatagtgatccaggccttaacaccttaataacacaatggattgtggtctttcttcctgattttcttttgagtcagatgtatgggaggcaagtattgtataggaaacagtgttggtccacggacaaatatacttttactagttatctggattaccagagcactatatgttgccagttttcatttaattcctggcttaaaattatgaaaatttagagatggagagggtcttagagctcttatcccaaccattttttaaaattcattttaaaaataaaaaatatgtatttttagagatgggggtctcactacattgccctagctggtcttgaactcccaggctcaagagatccttctgcctctgcctcccaaagtgctgggattacaggcatgagccaccatgcccaggcctaaccaatttaaacaaagttatatggtttttaggagcatacactagaccaaaggacaatctgacctcgaatttatctttctaatatacagcactgcctgtttgttgatagtgcataaatgactaaaaacgctaagactgtgctgaaggatcaagtgaacctttggggcttgtctggcttttttcagttgacttttcccagcttctccaagatgtcaatccaatcccatcatgtcaatccaatcaaggagaaggagacaatgtaggtatagagctaagtaaacctcaacaactattataaattcatatttaatgtccaaccatgtcatacactaaggtaatttaattcttccaggagtctatgagacatgtttgccaggtaaggttacaaaccagggtaaggttacagaatgattctagtatcttttatttaattgagaaagtcaaacatgaaatatcatgtttatacaggcatacattgatgggctgaaaatgaaggtaaaattctagggaaggtcaacaatgaatgacctatatttttacctttattttcagctcatcaatgaatacaaaatgaataagtaattttatttctctgggtctcattttttttttaaatgagagggatgaacttgacctccaaacttttccactcactgcaatgtatcagcactgtataaagtatatcaaagtagtcataatctatacaaacaccatttatatcaatataatagaaactcaggtgatgaatattaaaactcaagtaatattctttgaggataacgttaatcaataatacaatgccacacacaagttctttcctagacatagtcatttgttttctgtcttaggtctctggtattttaggttggatcactgttaaatacaatgttattgtgggaaacagcgggcagggggcagcagatttcaaaaaggaacaagcaaatgcagtgacatttactacatagacaattattaatactgtagcggctaaaacatttttattctatccttttctgtctcccgagctgcaatctatttatattatctatttttataactttatattatacatatatgtgtatataacaaatcaaaatgtcatcattaaaaattaaaattctgaatgaaagtaaaaatatccatatacttaagcttatgtgctcacatacatgtactatcttacatgtctatgtgtaagtatgcatgtgtgggtaaatctttaacatttttttcctcttacttagtgatgataaccatagaacttgttgcctctcagggaaaaaaatgtataattctggtaagatttttgatggtaggaaaataactagtattataaaatattaacaactcttaagcagtgccatgggaaggcatgaagacacacacagctctatactccaaaggcctaaaaggaattcaagttgagttaaaagaaaactaggcaagaggcctgaaaaaagttagttattatgttagctttattaatgtctcattatatttatatgtcacaccattttattttgaaatgggttttacagtaaaagtaatttatcataactagagtgaagtaaaagtaacagttataaccaccagttatggataggtacaacccaggcccagaatgggtaagcaacttgctcaaataaaacaatgacccaatgattaaaggagaaaaagaacttatattcttttagtccaacatattgaatactaaacaatagttgtattagagaataaagcagataaaggtaatcagctcataatttatacatatatcaaaatatcacattgtatactgcaaatatatataatttttatgtgtcaaaaaatcccccaaacattgtttgagcagcccctttcccccaaaaatgcagataaaaatttttcatagcatgattttttaaattacttactggtttcccttgaaatcctctttctccagggtttccagtcttaccctacatgagaaagaaaattcttgagtcaagtagtcccctccaaaaagattaatcatactaagaaaaacaaaaaagacttaaaatgttcatctttaatgtgaaatgttttattacttacaataagaccatgaggccctctttttccttgatctcctttttcaccctaacaaagtatcaaagccaggtgagttagtaagaatgtgaattatggtcttactatgctagcatatgctagcatacactcacatacaaaaaagacagtaagtatatagttcattattgaaaagaaaacatctctgcctgtgtagtaaaaactttatgcgtttcatacttagacaaagagaaaacttagaaccatacttttgtagggaaatatattgttttttagactagtaggacatatgatctcaataaaatttaactacatatgaaatgagaaaaatcaatgattaccttggcaccttgtataccttgttcccctaagagaccatctggtcctcttgatccctagaggtgaaaaaaatatcctgttgttaatttgaaatgttcctttttttttcttaacagttatgtgtcctcacagatgaacatgttgatgattttttttttttgagacggagtctcactctgtcgcccaggctggagtgcagtggcgcgtctcggctcactgcaagctccgcctcccaggttcacgccattctcctgcctcagcctccccctgagtagctgggactacaggcgctcgccaccacgcctggctaatttttttgtatttttagtacagacggggtttcactgtgttagccaggatggtcttgatctcctgacctcgtgatccacccgcctcggcctcccacagtgctgggattacaggcgtgagccaccacccaccgcgcacggccaagatgttgattttatgccctgacaacagaaaataatacagctgggtatatggctcaacctatctgcatgggagaatcagcccatgtttttaagatttaatgacaaatagtaagtcaaatgagcacaaaaatagctaacacagtagttgaggtggttataatataggtgtgttatttgggtatttcgttcactttataatttactcagcagccagccagaatttgttcttaatcaactctaaattaaaagtggctggatttgtttctctaagcagtctccttaagtttaatatttttaaatggtgctcttctcttcacattattagaaaatgatagcaatgcaggaacagaaaaccaaacaccgcattttctcacttataagtgggagctgaatgatgataacacatggacacatggtgaggaacaacacacactggggcctgtcagggggcctcgggggagggagtgtatcaggaagaatagctaatggatgctgggctttataactaagtgatgggatgatctgtgcagcaaaccaccatgtcacatgtttacctatgtaacaaacctgcacctcctgtacacgtacccctgaacttaaaataaaaattgaagaaaaaaaaagaaataaagtttagctggaataaaaaaaaaaagaaagaaagaaaatgagtgctgactgcattgtacctgctatgcaactgcttgtcaggaattactgggagatggcaggggcacagaaaaggtagagaaaatactactgaaaatattcgtgtaaatttaaaacttctcagtgttcattcaataattagttgcaaaaaagccgttgcaaaagtcattctataagaaaatgacagaatagtcttccattaaattataactttctttggaagatcttaaagtccttgttcagggacttgattcaattctacagactctaactgaatacctgtggaaaaggaattatgttaagtgttacagtgatttataattgagagaaagtttctctactatacaaatatacaaaagacaataatatacagagagataagacatgccaaggaccaaaacaagaattcaaagagggagacaaacttcacatttgtaatgggaaataaagatatttttagcagctggaggtcaagttctcatagacttattcaaaatagaagaaactctacaatgagggatagtatgtgaaaaaaatatagaggcatgaaaacagatactcaaagaataaaaaagtagtttgtttggttaggctattgattacatgttgagaaatattaagatgtaagtgtggaaaagaagactgggacttataaggtgaaggtctgaagttcacttacaaataatttggcagaaaactgatgctaaagatttctatacagaacggtgatacaaatctcccaggacaacatacagatttgaaggagtcctttaggcttcagaatcttctcttgtatcccatctgagataagctttggtttagctttatattattaaaagctatttactataataggactctcttcttgggaactcttagggtaactgcattccttgatcctctgaggcacattcagggatttggacagaacacacacttcatggaggatctgtagctccactgatcctgataaagccatagctccggccctacaatttctaagtctatattcaaggtactccataatctattcccaactttctttctgctctattttccaatgaaggactgaaaaactgaactacagtcttactgtgcaagaccttgaagatcaagttgaggagcatggacttaatttcatagatcagtattttttaacatgtgttattcattcagcagatgtataccgagtgcctactataagccagcattgttttaggtccagaggacatggtagagagaagagacaaatccctgaattcataaacaagcaaataagtacgtaaaactaaattataaaatgaaaatatgtagttaagtataatgaagaaaaacaaagaactagagagtatccaaggtggggaggactatttcagatagggtggcctgaaaagtctctctaaagtgacatgtgggtagacacctaaaagaggtaagattgcaagctatacaaataatttggggaagatcactgtagcagaaaaaacagcaagtgcaaagttctgatgaggggtcatgcttagaatattcaataattgagtagccgaagatgaaaaaagaacagtgttcaaaggatgactcaagttttaagcatgaaggtccctcaggaatttgctctaataatcaccctcaaccctcaagatgatcttgaaattttagccgtctctattgattctttttctctagcaccttcaatgcctaattcttctctttttgctccaaaagaaacacagctaatttttttttgagtaacaaaagaagaaggccaaaagactgtgaaaaggaatgagtggtcaacattctaaaatactataaaaaacaagtaaggtctaaattgaaaatgtgtccactggtaattaattgggcccttaaaactcctttacaacctagaattactatgtatttctttgatattttattactgagtaattggtagaagataacagcatcaatagaaaacaaattagaaatgtaggtttgcttagggtggagagggaggagtagtggaagataaggagtttgactctagatgatcaagcccaatgaagtagatatctccaaggctagtgatagagagttagaaagttagaagtcattctaagtttacgtggtggcagccataagcattaagcttcaaaaggcccctggacacatagttgtatatttagaattttatttaaaaagattgtttggtccaaagatagaaaatacatttcatttcttggataaaatcagattaagtggctgcctagatacacgtagaaaaggctgcatctagctggagtaagtctcataattaattgccagtttcttgtttgggcacagaaatcacctactgccatagctgaactagtccaaatcccactttttaagatgaagaaactgaagtctgtagatgttaggtgagtagcctgactcccacgatgtctaactgtacaaagactgaacgactgtgctttattaagtttataatattttttcaaatgttaaaaagaaatgaggttaatcccgtcagcaagtgaattcagactggaagagaggacctgaaatttagaagtttacaaaatgaatattaaacattcacaagtaaagtgctgattggtattgcaaatcaaggaactccctctaaaattaaggaatacatatagtaataataaccactcattttatgttttacatttaaaaaatacttttactactcaaagcaatctagagattcagtgcaatccctatcaaaataccaatgtcatttttcacagagatagaaaaaaaatcctaagattcatatgtaacacaaaaaagaggctaaatagccaaagtaatcctaagcagaaagaataaagctggaagcaccacactacatgactttaaagtacactactgggctgagtatggtggctcatacctgtaatccaacattttgggaagctgaggagggaggatcacttgagcccaggagttcaagatcagcctgggtaagatggcaagaccctgtctctacaaaaaatttaaaaattagccaggcatggtggaatatgcctgtagaaccagctacttgggaggttgaggcagtgggatcatgtgagcccaggaatttgaggcagcaatgtgatatgatcgcgtcactgcactccagcctgggtgacagagttacaccccatctttaaaagataaaataaaataaaatatactacaaaactatagttaccaaaacagcatggtactagtataaaaacagacacatagacaaatagaacagaaaagagagcccagaaataaatctacacgtttatagccagctgatttttgacaaaggtgccaagagcacacaatggggaatggatggcctcttcaataaatgatgttaggaaaactgtatatccagatgcagaagaattaaacccttatttagcaccatatacaaaaatcaacccaaaatgtattaaagacttaaatatgaagacttggaactataaaacttccagaagaaaaaggggaaaagctccatgacattggtctgggcaataatttttgggttaaaacctcaaaagcacaggaaacaaaaccaaaaatagacaaatgggactatggtaaacaaaaaagcttccatacaacataagaaacaatcaacagtgtgaagagacaacctgttgaatgagagaacatatttgcaaactattcatctgacaaggaactatatatccagaatacacaaggaactcaaacaactcagtagttaaaaaataattctattaaaaattggggaaagaacctgagcagacatttcttaaaagacagacaaatggccaacagacacatgaaaaaatgctcaacatcactaattatcaggaaaatggaaatcaaaaccacaataagatatcatcatatcacaggaagaatgactattattaaaaaaacaaaaatcaatagctattggccaggatgcacagcaaagggaactcttatatgctgttggtgagaatgtgaattattactaattccatagccactatggaaaagagtatggagatttctcataaaactaaaaatggagcctgggtgtggtggctcatgcctgtaatcccagcactttgggaggccaaggcgggtgggatcacctgaggtcaggagtttgagaccagcctggccaacatggtgaaaccccatctctactaaaaatataaaattagctgggcatggtggctgagtagcctgtaatcccagctactcaggagtctgagacaggagaattgcttgaacctgggaggcacaggttgcagtgagccgagatcatgccactgcattccagcctgggcaacagggtgagacaacaggatgagactccgtctcaaaaaaaaaaaaaaaaaaaaaaaaagaactaccatacaatccaggaatcccactactgggtatttatccaaaggaaaataaatcacatatcgaagggacttttgcacctatgtttattgcagcactattcacaatagcaaagatatggaatcaactaagtgtccttcaatggacaaatggataaataaagtgtggtatatgtacacaatggaataatttgtaggaacatggatggaactggaggtcattatattaagtgaaataacccaggcacagaaagacaaatgccacatgttctcacttgaaggaatgaaggacataccatcccaaaatatgtcatgaaaacactggagaaattgtagtttccaaaagggtgagctgatctgtctccttctgcatgcagcaagcaataaagatccctctgggagggctaccttctccataccagtatgagaaaatagcccttatcaccagagtcttacaattgaaggctgcaatggacctgaataaacacactttaatgaagtaactcatatcttccacctgttttacaccccctcgccaatatatctcttagtgacttccctagaaatgtttaccactttagctagattttctttgtcctgtcactttttctcaaatgtatcactctttgtctaagaagtataaaagcatcttgtttggggcacttcagacttcactctcttgtaaagatccccatatacacacaaaactaatataatttgtaacttgtctcttgttaatctgcctggtgtcaatctggtttccagatcctgctgaagagcccactgagggctaaaatgggggctggaggtgatctctggctgccctacacactcatatgtgggagctaaaaaagttcatttcatggaggtagagagtaggacgataaataccaaaggctgggaagggtgtatggatgggagagggagataaagggaggttagtgggtacaaacatgcaatgaaatagaaataagttcttttgttcaataacagagtagggtgactatagttagcaataatttattgtatatttcaaaataaccagaagagtggacttgaaatgttcccagcacatagaaatgataaatgctaaaggtaatgaatgaaataccctaaataccctgacttgcttactattcattctatgcatgtaacaaaatatcacacccaccccataaatacgtacaaatacgtatcaataaaaaagaatgcttccttaaaaaaacccattacttagaaaaatacttttactttattatttcattttataagtcaagacaacacagggaatgaagaaagagaagttctgtgcccacagtgatgataaccacatttagtttaaaaaacaacctgaaggtgtaagtaatgcagttatattaattaaaggtaataaagcctaaagttgctagttaagagtttaaggctggcagaagaactctaggaaagcttggtactctctctgtttaaagcaagagtaagctaattaactgaaagcttagctttatcaacatctttaaatttcacgctgatattggttatagaagttatcccatgggttactgtatatgtctgctttgacttctaagacaaaataagctttacgacaggctgtaagaaagtcaaatagcattataataggcacctaaatttggcatagttatatattaaaataaccgtttaaaaatatctcatggatattctcttagagtaactatgctggctaaagagaaaatctaatatttacattcttaggaaaattaaagttggctgcactgagctgtattagtaagttctcatagcagaaataaaaatttgatagcttagctacataaactaagcatgttttataaaataaatactgcttgaattatgggcaataactaaattcataaatgatcaatttacagaaccactacttcgtatgatgttaacattactcatgtgcctaactaattaggcctagcagtcttttctggctcttgatttacacagctgaaacaaaacgttctattaaacaaaaactaacattatcagtgattttaaggaaaaaaatattttgattctattcttgttataaactatttcaggagaagaaaccacagaggagctctgccttatcatttggagtgcttcaggtattgaatctagctttgaatctaaatgcgaaaattgaggactgcttccccctatatggtaagcatttccttgaaagggacaaatttcagaatttctataggcagatcaattttacttcctccatagaaaaccttaaaacattacatatttttaatagagttattttaatctttccctcccatttaaatcttaagcagcatagtctgaataaaaatgctcagttgtatgcctctatactgcccctctagagaaagagtgcaaacttaaacatgtctcatgatccttgccaattcataatcaagaaaaaagatgaggttaacttcgctctgtgtcatctctcctgtttgggtagctggacacagaggcgtataatggagtaataccaagggatcagttgcctagttctgaagagttccatgtgcagctgatgttgtgctgatttctagtgacccaagaggctaaaccactatctttctggtactgaattagagaatctgctagcttatattgtctacacaagggacatgattttgtatattatactaattagctttggtatgttaaactatttcattttatttaattattcttcagctaaacatgcaggtagaaacaaagcttagagtatgtaggataaataataatactttaaagtttatgccatgtttcttatctaagaatctctgtaagaatgatatttttagtcaatcctgttatctttttcagctatataaaaggcaaggttacttatttcttgagatggtaggacattattatttgtttggggttttcctgtcctttggaaaaatttcaatactgcatggtacttcaaaagccatcagactgtaaaatctatgcagtttagatgtaagagataattaagtctagaatcctccatggtattaatagtgtttgacaggttgcagggaatcagtaaatgttagatagctgtaaggtggatggatgggcaggagagaagcagatagtaagcagactctttggagtagtcctacccttcatgatggtcatatggccatatgttaacagcatcaatcacagtcagaacagcaagagagtataactaccagttccataatgaaaattctctgtgtggtctctgtgcaaatgtacttagggcagagcttccctccaacatgctatgacacgtattttccacaaagagattacaggtatgctgaaaatagtgccctcctcagcctttggggtggcaaggaaaagccagacacaggaatctgcagctaggtccccttttcatttatctcagtaggctggaccaatattctcattttttgtgagtgaaaaacattgggaagaatgggtctagagtattgggattacagccctagtggggaatggattgaagagagaagagagtaaaaataggaatatatcagtggctaccagaagggaacttcccaatgctattttctttctcaaatattctggtcttcggtatgttttctgtatgcccaatgtccattgtttacctaaaatagtagttcagtaaagaaggctctctctctctctctccctcttttaaagcccttgtttctaaacaaatcttccttgtctggatactgggtaaaaattttaaaaatgatgaggagccatttcgggagagaatcagtaaaatgtatttgaaggatgtgaggaaaatagatccttggggaggtaggaattgatgacaaagtgacaaatcaggaaacagtaataggatcatggtgaagttagaaaactgcagaacaaacgaactttccatatgacttaatgagacagcacaaagtggtttaggaaaagactgtgcttagatacacagcttgtgcttaaggactcaaattacttaattaacaaaaggaacaagtaagtatttcttctttttttcatctgtcacaaattggttgaactttcccattatgacttatacaaagttgaataaacacatttgacctaactaaatattgaatgctggcagggtactaaccactaaatggcagtttgggtacaaatcatctatcatcattttttattttattttaaatctcatttgggctaatatattagagatgtgaccatagagtataaatctgtaacccaggaaggaaaatagtttttcagaaaggaaacattaataaaggcaaatctgctctctttcttcaagcttcaccgaaaacacaggatatgactttgaagtcattacttcaaactgggaattcattaacaattttctcccatttgccaactggaaaactgcaaggtctttttttttttttaccatggttaggtagaggatatttttagaattttaaaatattttcttcataagctctaaaacttaaatcaaagtaaggtcaaggcataacacagaatccttaaagcccacatatccaaattaatttaaaaaatactccctgatattccatatggtattgaatagcatgggctttggagtcagacacactaaggtttgaatactgcttgtgccatttctgtgtgtctatagaggccgtatacttaaactttgagagccctggttccctcaactataatagctaagatataatatttttctctctctagtggttttgagtattgagataatatatgaaagagtgcctggcatgtgacaggcatgcaataaatagtggctcttatttctttaaaaaggatttaatgtttaagatacaacttaaagagatgaagatttattatttaattctgtatacatgattattagacaatgatgattataataactttgatttacaattaataagctcttattcatcttgtgtatctttgttccacttcttattgcttttattttgtcatgatgttatttttccttgctatgtaagtctgtagagaaataattcatttaaagatcttcacatttaccattctctcaaagaatggaattggaggctgggaataagaaacaagaattctatatgagttagtgatacatgtaaaaattaaaatggaaaaatgtgattttataactacaaaagattatgagttgtatttcaattaacatagggcattcatctaatataatgaaaatagaaaaaacctgacaagatctaagcagaattctagaaggtatgatgctatttttgttgcacattttccactatttatgaagtaattttgggggggttaatgtacttttttccttagattacttactctttgtcctttaggaccttgactcccaggtggtcctcttgcccccacatgaccctatatgttgtaaatttaaagtcagttgtagaatttacaagaatactatcagaataatagccataatctttcttataacatatatccttctcccaggacatttttacaattgattagtcttccttaaaaatatgctttaatcacactgccctctaccaatattctgcttttgaaatattctactatttggacaaatttaatgtctgggtgtttacaccctgaataaaaaatggagaagcttttaatattcactgaccaagtcgttttcagaaggaacacatatggagtgatggaggaaggagatatccattgagctagacagaccggtctaatctgcctggcccatcaaaaaagcaatggctatcatggtaatatttctttactattattctagatatttatgccaatcccatcacataaaaatagtttttttgttataaaaatgccacaaaatgttccaaattactatgctataaaaatagcctgcaatggagattaagttgctatttattattaagtcaattataatgaattatttttatagctatagtctttaattaagactcaactggaaaacaaaatttatttatctattaacccaaggtagataaaaatgaagtaaactttagtatttcaaatttatttattattttatgtgactaaagatattagtaactgttcttgagactactcttcctaattttaaaagccaacaacatatttgcaaatatactagaaaattgggcttatttttaaaacagaagcttcacaaataataaaagtcttcactgataagaaaagttctgctcaggggatcctaaaggccgatcttgttcatattttaagttcataatagctgtcagattctgataagcaaaattaatttaggggaaacacttcatcatctttttgtaaacaaatggaatattttcaatactacaatttttgtttaataaatacatatttttatgaattttatctggttgtgataatatttacaaatttctgagaaaaatatgttgaagcttacacttgtaatttatttatccaattggtctcacttctaatcttaataatcctgtttccttatatgtggttattcaaaagaaacttcaaagcattttagtttaggttgcagaactgaaattgattgtataccaagtagaggtgaggcagttcaagatatcatgacaaattcaagagtgttttgtatagttgggagagaagcagtctccactagtttacacatgacttactttgaataaaaaccaacaataaagcataacaatttatgagtttaaattaaagtaaacattccggaaggaatcataaagtctttcctgtacttacaggtaatcccaatggaccgataggtcctggaaccccaggaggacctggatatccctataatttaaggaaaatataaaagaagtaaaatattcatgactttaaattattttcattgaagacaagccagtaaattataaacaataataaaaagggataatttgacacaatgtttcttttgtaaccaagatatgaaaggccacaggaaatattctgcagatagaccatagaaataaaaaaaaattttctgtagttttatttacatagaaactatatatccatttattagaaggtttttgcctagagaagaaaattgctagctagaatcacatactacagcctatttataagagaacattcatttcatttttctgaagatcatgttatcttatccatggatatatgttgtgttatataggttatgaaactatatccttttcggagaggtccaggagctctctaattaagcaatgtaaatgtgtacaaatattctagcatttcaaactttagaaggaccacacactttatggtattaacactgattcaaaaaatgcgttaggaggtaatgattcttgaagttgattagtcttacaggcatgctaaatttcctagctgacagcaactggaaattgcatagcttaaaaaacaaaacaaaacaaaacacttataggacttttctgataatatagaagttagttaaaatcaatttgtagacagtattatgtgccaccagatccattacaaggcattttctgtatggaatatccttttattgataataattattcactccagttcctgccatacttagaaaactatttagtaagttaaaaagatgtaacccaaatataaaatttgtcagctatttcctatattaaaagtgtaagagaataagatgaattctggattctaagctctcatatgtcaaaaaactacatcatgaccacaaactcatggaagaatggcagtgctgatatgtgtcatatcaacaataggctgtagaagaataagtagaactctaattttaaaaggtgaaagatttatacaatccgaagagaaatcacagtatgtagaattctaattgaattttcttctttatcttttttagcaaattgtggtggtcaaattcctttcctaaaactagaatcatttgactaagccatctcatttacatgcttttgagtaccttagtatcacatagcattctgggagataaaccatttaaaaataaaattctatgggaaatttaacattttttactcagttaaattccagcccaggcaattccatctctggaacgacttgcttttattgcattctttggaaacatatttttcaaatcactgagctcttaccataacacctttttctccctgcggacctagtgggcctggacttccacgttctcccttttaagagaacaaagaaaaaagagtaacatagaggcatattaattagtcatgactgagctaagcctagaaagaaaaactgtcatccagaatcatgtcttacatgcatacatcatttttatttccaataatttttaaatttacaaatttggcgctttatcttaaaattattagacttttaataaaatagaattatcttaagatgttttttggagaaaaatattaaagtccttattaaaatgaagaaaatagaaattatggataaacaagacttaaaagtgagcacacatcatatgttaaagttttgtaagaaatgcttactattttatgagacatacaaaatatgagaatagtgaaagtatcaaagcatattaaaatgtaacaaatctgtgtaaccatttaagaaaattttattttatagtctgcctaccacaattaagtgccataagaaataagtctggaagatcatgataatcaaatctgtcatagcagcttaaaaagactaaactgattcacattaaaattctcaagagtatcaacattttagtacagaagatttaactcagcacagaaataactaattgggtgaaaaaaattataatgcaaaattttttaactgcactcattttgttacattgttagtaaaaaatcaataagtatatattaagtatgtagtatttaagtaattgagaatgtagtacatgagagttagaagagatatttaaaaaactaaacttagattctaccctcagtaactgcagacactgcagacatgatattaacagagatgaaacaaccagagagtaagtaaattttgactatgtggtactattctaagtccaagaagtgaagaaattaggaaggatgagaggagtctgtggacttcatagaggagatgggaattcagctgagtccaacagtttggttttgaagaaacagagggaaggagagaggatattttagttcaagaaaatagtaagaatggaaataggaacaagctcaagcacaagatggggagagagaaaggtaaaatggtaacttattcttctttttcaaaaactgctttctttcaagcctctcatagaaggcttgctctcatgaagtcgatttacataatattttctagtcagaaatctagactgttccatcttttctcttcagatcacatctttataatcaaaagggtactctgccctttaaaaattagaaacctacatgctgttagctatatttcaatatatttaagatattcagtataggtaatgtgctaaagttataagtgatttctaattaacataaaagatcatatgaaagtctgccttttgaatttagcctagatttcttcctataaaacaaaataattcttaaaaaattaccttttcgccaatgcttccagtcatcccaacttctccaggtaagccaacaggtcccttttaggaaaaaaaaataacagaaaatacacacatattgtattgctattgtagtgcctgggtcttaaatcacctgtaatcactatgtttctttctaacttatcctaaatgttatcttggagtaaaattcctccttgtatagctatgcagtctgtgacttcatatcagaattaatttattcagtcagtcaacaaaaatatatcagtgcctaaaatataacaggcactacgctgggaggcaatgagtttcaaatccacagtcgctgtccatgtggaactgacatgctactagattttataaaacccctgacgttttcatacctgtttgatgtggatatattcgtttaagaaatcatttctgtaactaccttttttgaaagcccctcaatacacaagcggacagaacatgcctatcattcattcatccactcaagaaatatttggtgcctactctgtgccaggcactgtgatggttgctaagatttcattactgaggaagacaaatctagaccctgccctcttgaggcaaaaagtctcataacagggagacaaaagcaactaaattaaaagttaaataattataaattctgacataagctcataaaggaaacaataatattgctgaagaggagaataaaagagaagacctattttagcacagatggtcagggaagactgaggcctgacatttaatatgaaatctgaataataataagaggccagccagccaaagaagggaggaagaatattctaggtagagtaaatagcttgagtaaggaatgaatttgatttgctagaagatgttaaagaaggtaatcagttacaccatttcagagtgaacacgtctcagggtttttccatctttgtctttacggattctcaattatttctccttcaaacagtacagaaagcaaaaagaataacacagaacaagcttgacaagaacataatctctttcttgtcttaaatcataagcagttactttctacttttatttaaagacaaatgaaacttttttcaatagctaccatgcaaagaccttgtttagatagattctcatacgatagtatacattagcatacagaaagcactgactcatgaaaaatgacttgtcatttatctaatgcattgagcatgattttacccttacagatctctatctatctaatgatcccatatatataacatatattaagtgttttctatgtgcctgatttaatcttcacaaccagcagatatagtattatcatcattcccctttgacagatgaggcagatgaattaaacagtttgctgacacagatgaggttaaatggtatggatgagtttaagtggctattgagcacttgaaatgtggttagtgcaaattgacacatactgtaaatgtaaaagacaccagattttgaagacttatagaaagaatgtaaaatagctaactaatgattgcttacatcgattacgtattaaaatgatactgatttgatatattggtgtaaatgaaatattactaaaatcagttcacctctttctttttatcttttttaatgtggctactagaaaatttaaaattatatatgtggcttataattttgacttgcattgtatgtctattggacagccctgatgtatacttttaggcactatgctaatattattgcttaaatctagttggaagtgatttaataatttgtttctgtggtttttaagtgtaagagactgaacactttcattctgagacaatctattatcaatgttcatgtgcatggaattcactggtctcactgtgttctccaccattctgagacagctggtttgataaaacggtgaaatggcatttttaagactcagttacaaggccagctaggtgacaatactttgcagggttggggcaagactttccagaaggctatatatgctctgaatcagtgtccaatatatggtgctgtttctcctataactagtattttggggtccaggaatcaaggggtggaaatgggagtggtactactcactattacccctagtcatccactagaaaattttttgtttctgcccatgctctgctggactaaaggtcttagttccagagggaggaatgcttccaccaggagacacaacgatgattccactgaactagaagttaagactgccatccggccactttgggcttcttatgcccctgaatcaacagccaaagaagggagttactgtgttggctatgttgcttaattctgccttccatagggaaatgggaccttcacaatggaggtaaggaagagtgtgaataaaatacaggagatcccttaggatacgtcttaatatcaccatgctctgtgattaaggtcaatggaaaattacaacaacccagttcaggcaggactacttactagtgacccaaattcttccggaatgaaggtttgggtcaccccatgtcttagtccatccaggctactataacaaaaatattgtaggctgggtgactttaacaacaaatatttatttcccacagtgttggaggcttagaagtctaagatcaaggcaccagtagattcagtatctagtgagggcctgctccctggttcatagatggcagagccctcatgacctaatcatctcccaaggtctacaccacctcataccttacattggtcattagaatttcaacatatgaattttgcagaggataaaaacattcagttcataataccccaccaagtacagatcccaactagctgaggtgcttgctgatggcaaacggaataaagaatgggtagcggagaaggtagttttaaatacctgctatggccatgtgaccagttacagaaacgaagactataattgtcatgagtatttcatcgttattttgtcatgaatgtgtgtgtgtgtgtgtgtgtgtgtgtgtgtgtgtgtgtgcagcaaatatctttggttcttttcttctcatttctttttttcttttcttttttttttttttcttgagatggagtctcactctgtcacccagcttggagtgcaatggcgcgatcctggctcacagcaacctctgcctcctggcttcaagcgattctcctgcctcagcctcctgaatggctgggattacaggcgtgcaccaccatgcctgattaaatttggtattttcagtagagacagggtttcaccattttggacaggctggtcttgaactcttgacctcaagtgatctgcccaccttggcctcccaaagtattgggattacaggtgtaagccactgctcctgccctctcatttctttatcatataacataagacgtattgaccttataacagtatctaagtatggttaattttacatcatagtatttaagttacaggttataaaggagaagagtaaacatcactcaaggactttacatcctcttctggaaaagaggttagtgagtttttggttacatgcaggataatgatatcatgttaggcagaattatgatcttattattgtctttatttgaaggttaagtatggtttaaagagatgcatttgggggcaaacttgacaatggggagggctgtcacggttaattttatgtgtcaaggtcactgggttacagagtgctcagatatttggctaaacattatttctgagtgtatgttgtttctaggtgagattaacatttaaataggtaaactgactaaagcagattgcctttcccaatgtgggtgggcactgtccaatctgttgaggatctgaataaaacaaaaaggcaaaggaaaggaaacttttctctccatctgactgcttaggctgggacattagtcttctcctgcctttgaactaggacagcattgactcctagttctcaggcctttggacttggagtagaatttaaataatcagtgctgtaggtctcaggcctgtggactctgatagaacttacactgtcaattcttgtggttctcaggcctttgaactcggactggaactatactggatttctaggatctcctgtttgtggatggaagactgtgagatttttttttagccccccacaatcatgtgagccaattctttataataaatcaatctatctatatctatatcctgttggttctgtttctctggaaaaccctaactaatgctgtcaatcaaatctgagcaggaaaaatgaaatagagctatctgttgtgagacagtaaacaaaataacagaaactgaacacagactagtcaaactattcggaaaaaatcatttttctttttgagacagagtctcgctgtgtcgcctgggctggagtgcagtggtatgatcttggttcactgcaacttcagcctcctgggttcatgcaattctcctgcctcagcctcctgagtagctgggactacaggcacagagcaccgtgcccggctaattttttgtttttgtttttagcagagatggggtttcaccatgttggccaggctagtctcgaactccagacttcaagtgatccacccgccttggcctcccaaagtgataaatcctttttctaagacatatgatctaggggagtgaatgcagtaggctcgtttagcttatcccatgtgcaccagaacaatataacctacaaatgtattctgcttagcctatagcatttactaaactgaactaggtaaaaacatttaaaaatctggagattttacatataaatactttatatataaagatttataaaattattagcttcagatgacctagcaaatgtagacaaactttctcaaaggcaaatattggacagaactaagtaactgttgtactgttgagatccagatgcactctttactttgctattccctattgtctcttatacatggcccattttacttatttatactatctgcctggtcccaatagggcatctgagttttttacttcatgtaagtattaaaaggtgcagtcagtcaaaagggcataattggaagatagaggttctcactaaaaagtagatagttcacagggttccggccatgcccatggatatctttaataaaacttaaagttggagaacataaattaaaaatggtttccttgcagcctaggcaacatagggagatcacatctctataaataatctatacataataataataaaattagctgggtgtggcaacatgttcctgtagtcccagctactcatgaagctgaggtgtgaggatcgcttggactcaggaggtcaaggttgcagtaagcctgagtgacagagcaagaccctgtctccaaaatacataaaaagaaaaacgtactatttcagtaccttaaaaagtctaaccaaaacatatgtcaaatctgataataccacaagtgttggctagaatgtaaggaaagaagaactcatacatacacagcaggaaatagcaggaaatagtataaattggtacaatcactttggagaacaatttattatatatagtaaaattgaagatgcccctaacttacaactcagcacttctagttgttcacatggaattctactttcacatgtatgtactaggagacatatagaaagacgttcattgctgtattatttaagtacaaaagtagaatcatcggcattatcagtatggacacagattaactaaaatgcattcatacaataaagaaaactcttgaatgaccaatactgagaaataaacagaaaacctcaacaccagctaaaattaatagaccagatctatatgtatcaacatggataaacattttaggaatataatgttgactgagaaaacagcataaatccttttcaaaaggatacatcattatgtgttttgtgcaaaattttaaaacgcatacaataatctaatttcttactggcagaagacacatgggaattatacacacaactttaggataagggctaatgtctgtatatagagtagtggctcattatttttttattttgaatttctctgataactagtttctctgagtctgaacttctcttcatttatgtgttcatgttttggactttttctgcttagttcttatccatgtcctttgctcaacttattttttcccattaagatttcctaaattttcttgatgattttcaggaatttttatatatttgaagtataaacttcttattggttttattttattttatttattcatgttttgggctttttctgtgtaattcttttccatgtctttgctcaatttattttttcccattaagatttcctatattttcttgatgattttcaggaatttttatatatttaaagtataaacttcttattggttttatttatttatttatttatttgagatggagtcttgctctgtcgcccaggctggagtgcagtggcatgatctctgctcattgtaacctttgcctcccaggttcagcttgatcctgccacctcagcctcctacctcagcctcctgagcagctgggactacaggcatgcaccacgacgcccagctaatttttttgtagtttttagtagagacggggttccaccatgttggccaagctggtctcgaactcctgacctcaggtgatctgcccgccttggccttccaaagtgctgggattacaggcatgagataccgtgcccaaaccttattggttttagatgttctaaattccttcttgtgataaatcacctgtgaaattatttttgatatctttcattgacaagaagtccttaatttttatgtggccatatccagtgtggtttttgtttttttttttggccttatgatttgtattttctggatcttgtttaagaaagctttccttatttctatgtcattaaataatgggcattcttttctattgctgttaacttttctatctagaaaagtttctttaatccatctggagttcaattttcacgtggtataagatagggatccagttttaattttttgcatacagggacccagttttccaaatgctatatattcagcactatttcttacccacctattggtttatggtgccattcttgtcttatacatggcttatttctaagctttctagtctatcttatgatgatttgtctgtttttctccctttgcaaatttctctcactccatttttctaatgtttttatggttgtctctactacagactgaaaataagcatgccaacaaaggtttatatcagtggtaaggaatgtgaacatacaggctttaaatctattcagtctttaagtctatattactctttgaaactgtgtacacacttggaaataatagatgaattagacaaaggtatttaaagctgaggtctgccaaatttcatggaatctaagatatcatggattgtaagatacaccaatattttttaaatctctgaatagagaaaaaaatctcccaagcaattgtaatttaccactgatcatgagaaatatctcaatttttaaaatgtgaaaatgtgaaaagaaaaaatggtatagcagattgttttactgtttgaaatattcactgctcctttctgtggaaggattatacctccctatgctactgatgtcagacttggccatataatttggagtgcccgtcaccatgggaggaatatacccctgcatcttattaatgtcattcttctctatgtaacttcaaataaatagaaagtgatatgtaccactttttttttaagtcagtttcttttttccttttgccatgagactaaacatgttccacacaggcactgctccttaagcctgagtctccgaatgcagataacatgtaacagagtcacagccaacccacagtgtatagagtgcaagtaagaaataaacttttattattgtaaaccactaatatattcaggctgtttctttctgcagcataatttagcctaaactgactgatgcaatatgtccttttaagctgatatgacatggcaattattaacaggagaagcatgtggttttctctaattttatcccaagtgctaatgaccctaagagatagatggagccacaagaaagagggggcctgggccaggcatggtggctcatgcctgtaatcccagcactttgggaggttaaggcaggaggattgcttgaagccaggagttcaagaccagcctgggcaacaaagtgagaccctgtctctacaaaaaagaaaaattaaaaattagctaggtttggtggcccgtgtctgtagtcccagctactcagaagactgaggcgggaggcttgagcccaggagttggaggctgcagtggagcaatgattgcatcactgcactccagtctgggtgacacagtgagaccctgtctcttaaaaaataaaaacaacaacaacaaaaaccaagagagagcacctggttttcttaatcaacttgtaggggagagctacttaggaacaccttcaccagacaattaacatgggcaaaaataactttctgttgtgttaaaacaacataaaatatttaggtttacttattatggcagttagtgttatcctaaaaatacagtgaatttacgtattaacataaaattgaaaaactgtgaaatctaactcaattagtttatttgaaagttaatctcacagaaagtgcactgaatcaatttccagtttagtacagttgcaaatcaatttcttcaataaatgcaaaatgaggtgaagaaaataaaattaagcatatttatttgttcatgtaacagatcctgtgctaagatttagctggagaggatatagagatgagtaaaatatactaaggagttcaaaatccagtaaattggaataaggtaaacgtatattttctaaaagttaatagaagaagaagtaaaataatatctaacacaaaggcagaagagattatatctggttgaaaacatgagaaaagactttacagagaaggcagcatctcaggtatggttacatgttgacatgatgaaatggtgaaagtgtattccaagcagagggaatgttttgagctaaagatgggagggagcaaatgataaaacatttgcaaacacaaagttaatccacattgtctgggacacagaatatgtgtaggggaataggctgggatagatacattggttatatactatagacggctttgaataccaagtgagaaatttgtgtttgtggtatctgcagaagagtgtgtgcttgtagaagaatcactattggttttcagtaaaggaggaatataatcatatctagacttgaatgggtggtaatttaacatcactgtgtttaatgtgtagaaatgggaaaaatagaaaataggacaaacaaatcattataatagtccacattaaatgtaatgactggtatgaggacaatatcatcattaaaaaaaaacagtaagctcaggagaaaagccactgttagaggaaaagtgacgaagtaagccaacagacagttgtgcttgtaaagaatctatcttgaaatactgatttgtgtctccatagaacaatcaattgttgaaataataagaatgatgtagtacatacgctgatgataaaccaggaacaagaagggaatctaatgaagattcattggaggcaagaggtagaaaaaaaaaaacaaaaacaaaagaaagagtcacaaaagaaagagtcaaatagtcatgttccaagatggccaaataggaacagctctgatctgcagctctcagcatgatctgcatttccaactgaggtacctggctcatctcattgggactggttggacagtgggtgcagcccatggagggtgaaccaaatcagggtggggcatcgcctcacctgggaagtgcaaggggttgggggacttccctttcctagccaagggaagccatgacagaatacacctggaaaatcgggacactcctgcccaaatactgcagttttccaacagtcttagcaaatggcacaccaggagattatatcctgtgcctggcttggcaggtcccatgcccatggagccttgctcactgctagagcagcagtctgagatcgacctgtgaggcagcagcctggcagggggaggggcatctgccattgctgaggcttcagtaggtaaacaaagtggccaagtatacaggcaggtgcccctctgggatgaagcttccagaggaaggatcaggcaaaaatatttgctgttctgcagcctccactggtgatacctaggcaaacatggtctggagtggacctccagcaaactccaacagacctgcagctgagggacctgactcttagaaggaaaactaacagaaaggaatagcatcaacatcaacgaaaaggacatccacacaaaaaccccacctgtaggtcaccatcatcaaagaccaaaggtagataaaaccacaaagatggggagaaaccagagcagaaaagctaaaaattccacagagtgcctcttcccctccaaaggatcacagcttctcagcagcaactgaacaaagctgggcagagaatgactttgatgagctgatagaagtaggcttcagaaggtcagtaataacaaacttctccgagctaaaggaggatgttggaactcatcgcaagtaagctaaaagccttgaaaaatgattagatgaatggccaactagaataaacaatgtagagaagaccttaagtgacccgagggagctgaaaaccatggcatgagaactacgtgacgcatgcacaagcttcaatagctgattcgatctagtggaagaaagagtatcagtgattgaagatcaaattaatgaaataaagcaagaggagaagtttagagaaaaaataataaaaagaaacgaacaaagcctccaagaaatatgggattatgcgaaaagaccaaatctacatttcattggtgtacctgaaagtgatggggagaatggaaccaagttggaaaacactcttcagggtattatccatgagaacttccccaacctagcaaggtaggccaacattcaaattcaggaaatacagagaattccacaaagatactccttgagaagagcaactccaagacacacaattgtcagattcaccaaggttgaaatgaaggaaaaaatgttaagggcagccagagagaaaggtcaggttaaccacaaagggaagcccatcagactaatagcggatctcttggcagaaactctataagccagaagagagtggggggccaatattcaacattcttaaagaaaagaattttcaatccagaatttcatatccagccaaactaagcttcataggtgaaggagaaataaaatcctttacagacaagcaaatgctgagagattttgtcaccaccaggcctgtcttacaagaactgaaggaagcactaaacatggaaaggaataactggtaccagctgctgcaaaaaacatgccaaattgtaaagaccatcaatgctaggaagaaactgcatcaactaacgggcaaaataaccagctaacatcataatgacaggatcaaattcacacataacaatattaaccttaaatgtaaatgggctaaatgccccaattaaaagacacggactggcaaattggataaagagtcaagacccatcagtgtgctgtattcaggagacccatctcacatgcagagatacacataggctcaaaataaatggatggaggaagatctaccaagcaaatggagaacaaaaaaaaaagcaggggttgtaatcctagtctctgatgaaacagactttaaaccaacaaagatcaaaagagacaaagaaggccattacataatggtaaagggatcaattccacaagaagagctaactatcctaaatatatatgcaaccaatacaagagcacccagattcataaagcaagtccttagggatctacaaacagacttagactccaacacaataataatgggaaactttaacaccccattgtcaatattagacagatcaacaagacagaaggttaaaaaggatatccaggacttgaactcagctctgcaccaagtggatctaatagacatctacaggactctgcacctcaaattaacagaatatacagccttctcagcaacacatcacacttattccaaaattgaccacatagttggaagtaaagcactcctcagcaaatgtaaaagaacagaaatcacaataaactctctctcagaccacagtgcaatcaaattagaactcaggattaagaaactcactcaaaactgtacaactacatggaaactgaacaaccagctcctgaatgactactgggcaaacaacaaaatgaaagcagaaataaagatgttctttgaaaccaatgagaacaaagacacaacgtaccggaatctctgggacatattaaaagcagtgtgtagagggaaatttagagcactaaatgcccacaagagaaagcaggaaagatctaaaattaacaccctaacataacaattgaaagaactatagaagcaagggcaaacaaattcaaaagctagcagaaggcaagacataactaatatcagagcagaactgaaggagatggagacacaaaaacccttcaaaaaatcaatgaatccatgagctggttttttgaaatgatcaaaaaaattgatagactgctagcaagactaataaagaagaaaagagagaagaatcaaacagacgcaataaaaaatgataaaggagatatcatcacggatctcacagaaatacaaactaccatcagagaatactataaacacctctaggcaaataaactagaaaatctagaagaaattgataaattcctggacacatacaccctccaaagactaaaccaggaagaagttgaatctgtaaataggccaataacaagttctgaaattgaggcaataattaatagcctaccaaccaaaaaaagtcaaggaccagacggattcacagccaaattctaccagaggtacaaagaggagctgataccattccttctgaaactattccaagcaatagaaaaagagggactcctccttaacttattttatgaggccagcatcatcctgatacgaaagcctggcagagacacaacaaaaaaagagaattttagaccaatatccctgatgaacattgatgcaaaaatcctcaataaaatactttcaaattgaatccagcagcacatcaaaaagcttatccaccattaccaagttggcttcatccctgggatgcaaggctggttcaacatacacaaatcaataaacataatccatcacataaacagaaccaacaacaaaaaccacatgattatctcaatagatgcagaaaaggcctttgacaaaactcaacagcccttcatgctaaaaactctcaataaactaggtattgatggaacatatctcaaaataataagagctatttatgacaaacccgcagccaatatcatactgaatgggcaaaaaactggaagcattccctttgaaaactggcacaagacagagatgccctctctcaccactcttattcagcatagtgttggaagttctggtcagggcaatcaggcaagagaaagaaataaagggtattcaattaggaaaagaggaagtgaaattgtccatgtttgcagaggacatgattgtatacttagaaaactccatcgtctcagccccaaatctccttaagctgataagcaacttcagcaaagtcttaggatacaaaatcaatgtgcaaatatcacaagcattcctatacaccaataacagacaaacagagagccaaatcatgagtgaactctcattcacaattgcttcaaagagaataaaatacctaggaatccaacttacaagggatgtgaaggacctcttcaaggagaactacaaaccactgaacaatgaaataaaagaggacacaaacaaatggaagaacattccatgctcatggacaggaagaatcaatatcatggtaatggccatactgcccaaggtaatttatagattcaatgccatccccatgaagctaccaatgactttcttcacggaattggaaaaaactattgtaaagttcatatggaaccaaaaaagagcccgcattgccaagtcaatcctaagccaaaagaacaaagctggaggcatcacactacctgacttcaaactatactacaaggctacagtaaccaaaacagcatggtactgttaccaaaacagagctatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacctaaatgttagacttaaaaccataaaaaccctagaagaaaacctaagcattaccatccaggccataggcatgggcaaggacttcatgactaaaacaccaaaagcaaaggcaacaaaagccaaaatagacaaatgggatctagttaaactaaagagcttctgcacagaaaaagaaactaccatcagagtgaacaggcaacctacagaatgggagaaaatttttgcaatctacccatctgacaaagggctaatatccagaaactacaaagaacttaaacaaatttacaagaaaaaaacaaacaaccccatcaacaagtgggcaaaggatatgaacagacacttctcaaaagaagacatttatgcagccaacagacacatgaaaaaaatgctcatcatcactggccatcagagaaatgcaaatcaaaaccacaatgagataccagctcaccccagttagaatggcgatcattaaaaagtcaggaaacaacagatgctggagaggatgtggaaaaataggaacgcttttacactgctggtgggagtgtaaactagttcaaccattgtggaagacagtgtggcaattcctcaaggatctagaactagaaataccatttgacccagcaatcccattactgggtatatacccaaaggattgtaagtcatgctactataaagacacatgcacacgtatgtttattgcggcacaatagccaaaacttggaaccaacccaaatgtccatcaatgacagactggattaagaatatgtggcacatatacaccatggaatactatgcagccataaaaagggtgagttcatgtcctttgcagggacatggatgaagctggaaaccatcattctgagccaactatcacaaggacataagaccaaacactgcatgttctcactcataggtgggaattgaacaatgagtacacttggacacagggcggggaacatcacacacgggggcctgtcatggggtgaggggcagggggagggatagaattaggagaaatacctaatgtaaatgacaagttaatgggtgtagcaaaccaacatggcgcatgtatacctatgtaacaaacctgcacgttgtgcacatgtaccctagaacttaaagtataataataataattataataataataaaaagagtcaaaaaggaggagaaccaggaatgcacaaagaaagatacagaaaataaaagtttcaagaagagagaaatctgtgtgatgtgggaaggtttaagaaggatgaacattaagacaaattcatagaatttagcaatcaccaggttgatggtaacctgtaggaacaatttcagtagcttttgtgtgtttggatatgtttgccaaagggttaagaatgtgtgtagggggaggaggagccaagacggccgaataggaacagctccggtctacagctcccagcgtgagcgacgcagaagacgggtgatttctgcacttccatctgaggtaccgggttcatctcactagggagtgccagacagtgggcggaggccagtgtgtgtgcgcaccgtgcgcgagccgaagcagggcaaggcattgcctcacctgggaagcgcaaggagtcagggagttccctttccgagtcaaagaaaggggtgacggacggcacctggaaaatcgggtcactcccacccgaatattgcgcttttcagaccggcttaagaaacggcgcaccacgagactatatcccacacctggctcagagggtcctacgcccacggaatctcactgattgctagcacagcagtctgagatcaaactgcaaggcggcaacgaggctgggggaggggcgcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagacctgcagctgagggtcctgtctgttagaaggaaaactaaaaaccagaaaggacatctacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagttacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaaccctccaagaaatatgggactatgtgaaaagaccaaatctacatctgattggtgtacctgaaagtgatgtggagaatggaaccaagttggaaaacactctgcaggatattatccaggagaacgtccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaatagcggatctcttggcagaaactctataagccagaagagagtgggggccaatattcaacattcttaaaggaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagctgctgcaaaatcatgccaaaatgtaaagaccatcgagactaggaagaaactgcatcaactaatgagcaaaatcaccagctaacatcataatgacaggatcaaattcacacataacaatagtaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaatgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcagtcaaagccgctcaactacatggaaactgaacaacctgtacctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatgaatgaatccaggagctggttttttgaaaggatcaacaaaattgatagactgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcagtaatcaacagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatacagcatataaacagagccaaagacaaaaaccacatgattatctcaatagatgcagcaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactataccacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctgcacagcaaaagaaactaccatcagagtgaacaggcaacctacaacatgggagaaaattttcgcaagctactcatctgacaaagggctaatatccagaatctacaatgaactcaaacaaatttacaagaaaaaaacaaacaaccccatcaaaaagtgggcaaaggacatgaacagacacttctcaaaagaagacatttatgcaaccaaaaaacacgtgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagtccaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagattggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagtattgggagatatacctaatgctagatgacacattagtgggtgcagcgcaccagcatggcacatgtatacatatgtaactaacctgcacaatgtgcacatgtaccctaaaacttagagtataataaaaaaaaaaaaaagaaagaaagaaaaaaaaaagaatgtgtgtaggtgaagagaaaatgtaaaaaacttgtatagtttagatgattattttaataagttggcagcaaaaatgaggaggcatgaaaactgctaaaggatgtggttgcaaaattactctattcagtatctaatttttgctgtcagccaaatagagttcatcggcaatagaaaatgtacccttctgaacagaaataaattacattaaaaacctacgtttttgctgtgtttcacagaataattttttttaacacactattattatggcctaatctatcacgattggttgggaaccaacacactgtaacaggagagaagatgctggcaggattaatcttctcccaaagactatttcctagccagctccctacttctagatagctttcctacacttggaatgctccatccagggaaggcatgtattgtgcaaaggtgccatataacctcttccttcttaacagaagtactttctgaaaggcagactaaggtgctgtgacttattctcatttttttccatgaaacttcaagtatcatatatgctagtgagaatcagacaaatgcaagtgagaatcaagggcaaaattatattttcaattgtaaagttgtcaaaggcaaattatgtgcatgtggaaatggtcataatttatttatatttactactatagctctttaaaatagagacatgggtgaattctggtttgttcctatttattcttcttcattttaaaacaaatgttgaaatattatgtattactattttagttgtctactgctgcaagacaaattacccccaaaagttagtggttaaaataataaacatgtattatctcacagtttctgtgagtcagaaattcaaaggtggcttaaatggttagttctggctgaggatctttcatgaagttgcagtcaagatttggcattggctgcagtcatctgaaggcctgactgaccagaaaatccatttccaagaaagcttatttcctcaatccatagacctgaggacatagtagttggcttcccccagattaagtgatgcaagaaagagagtgagaaaggaagaagctgcagtgcctttatgatctagcacacattgacttctgccatatcctactcattagaaatgcataactgagtccatcctgcattcaaaaagagccaaagtagactgcacacttcagatggaggaatagaaaagaatttgtagatatatttttaaacaatcacaatgatttaaattctattcttggcttgatttgatattttattaagactttgactcctcccaatagttttctttagtttcttgcatgtatttttaagttatacacttctttgtgaacactctaaattagtgttgttggaataatgtacattttcctacagatgaaatgcataacatttcattcttattagttattatctatcatgaataaggtactatagtagtcaatttagacatcactaataactaaaatataaagtagatagccaaaaatgccagaagatgaactactatagaatagcagataaaacaggaatgagcaatctatggctctgatggctggctgcctgttttgtaaatagtttcattggaacacagacttgcccatttgtttacttattatctgtgactatttccacattatgcaggcagaactgagtaatttcaacagagaccatatggcccacaaagcccaagtcatttctgctggatatttaaagaaaacacaaaacagtcactgagccatagccagaattattgtcaatatataccaagaatttacattaaaaatatttcaaaacactgattccacatctaacacacaattaaaaaaaaaacaccaagcatttagctagaatatgctgtgtttcaagatccagacaaccatataataattgaaaacatttcacttttggcaaaatagtatattttgcaaaatggtctataaaaactttaaaactctctcctaatattttttaaagtaactatatcctatttattaactaaagactgatttaaattagaatatttcctgtttgaaactaaaaaatttttaaacatttatttaaaagttcttatgcttagatgagtcaccaaagagaatatgtagaacaaaaagaggaaaaggctacgaacaataacatttagagagttggttcggaaaaagaaaacttaaagttgactatgcataggaacaaagtgaactgtcaataggagaatactgtctatttttttccatagtgtttcttcagaccttttcattggagggtaatactatgacttgacaagtaggaatgaacactttctgtttatttataaatacatcactgtttccaaatagctaacctttggatcacttcactcctattttcaaatgaaatctgtaagctaagtatttatttgacagcatgacttgtagcaagttactttagctcactgtacttcatcctgtaccatttaggaagatgtgactttaagttcattggtctatatgctctgtaaagcagggatgatgtctgtattatcttctgtatcccaggcagtaggcataagggatacagtatcagactgaagtcatctgaaggcttgactgacagtttattaattcgggagcactttccaagtatcagactgtatcccttatgcctactgcctgggatacataagataacatacgtagaatgaatgagtgaacaacttagagcagtagtggtggaaacagaggtgagccacccacattccctttttatgacatatcttattaaccctgcaataagctccttcaagatttaggccttagcagagaggcctatatccaaagcctgattaaggcggggtataaaagtctggccatttgggcccaatgtctgactactctgatggtccaaacatttggttggtctcttccctccttctgggggattgcagagaagattgggtaaaagccaggatttaaaatcaaagtgaccaaattccagagaaggtccaactcctaaccaagacaagtctgttatgccaaagtcagggtcttggttagaaaaaaaaaaatggaactctgatacttgtgaaaacagtatctgggcagaggtccctgaagattttgaactgctagtctctgaactctaccagcttacacaagtggcctacttcttattataatttagcattctcccctaacataacctctcccctgtaagaaaacgtaacccagttaggattcccaccacctcctcttctagccattatgccaataactagggttaaatcacagcataacttgctgcacctgatataggcagaagggactatgacccaaggggataaaagatctcgtcagtatgtactggtaggagaagggggcatatatgtggatctgattgcacaggtatttgatcaagagaaccataatataacataaataacataaaattagatacggaaaagtttattaatttgggagcactttccaagatagaggaattaacactctggcaaggaccccaggaggttgcacaagctcctacagtgggtccaagctgtgaggcaagcagtcctgtactttgggccacatgacctggcagaccctacggtattagaggaatcaatggtggaaaaataagttatgcaaagcctatgttaagccttgatgggaagatcacagtgcaggctcctgagattttgtatcaaggctctgccacctgcagcagagatttaaacacattttgaaaaatgaattccagcataccggtagccttagtagagtctgggcacttaatcacaggacaccaaatgactacacatctgaatctcctataagctgagttccatcagattcatcaagtcataaggccaaccagttccagtgcattctgggaaggaatatgagcaacacagaggcacaagcagactgcataagcaagttgtccatattcccagccagtacctcttctttagctgacacctttgctctctgggggatcccttacgaccagctgtcagaaggagaaagcccaaacttggtttatggatagtaggcttcttacgtaggtgcaaactgaagatggatggcagctgagctacagcttcacccagaagtgccttaaaaggcagtaacagggaacatcttctaatgagcaagtctcaggcagtgtaccagatcattcactttgtgagcaagagaggttgcttgaggttagaataggtacagactaatggaaatttgtgagtgacctggctggttgattaggcacctaaaaggaagaatattgtaagactggggccaagaagatgtgagaaacaggaatatgggaggacatactggagtaggcacgaagtgtgaagatctttgtatcacatgtcaatatttaccagagggtcaaacatgaaagagtatctgcaggtagatttaatgactcagaaagctgacatcagcaagccttgatcatcagtcacttcagtgctggatgatggatatatgaatggaatggacatggtagaagagatggaaggtatgcatgagtctgacatcatagggtgcaattcaacaaggctaatataaatactgcttccactgaatatccaaactgccaacaacagagaaccatattaagcccacaacatggtaccattctttgagaagcccaaccagctagttggaggcaagttcattctggaaaggccaaagatttattctagcagaaatgacatatgctttgaaaatgggtggccttccccacactgaggcctcaattagtaccagtatttagtagcttaaaaagtgtctaatttaccatatgggatccccaaaatattatgtcagagcaggggactcattttatgcaaacagtgcagaagtgggcctatgaccatgagatctaattgtcatattacatcacatcaagaattttccaacttgagagagcattggaatagcctgctaaaggtacaaactaaagtgccagctaggaggtgatgctttatgaggatgaggcactatcctataggatgaagtatatacactgactcaaagacatttatatggtactgggtctctaataggaaatatggatgggtctgaaaccaaagtgtggaagcagaattagttccacttactatcactctcaatgtcccagtggaggactctgtgctttccattcccacaaaatgtgagctctgcagacatggaggccctcgtcctcaaagggaacacattttcaccaagtgacacagtgagagtctcactgaactataagctatggcaatctcttgagcccttcaatttccctgtgtccacaccccagcaggcaaaaataagtcaccatcttggcacagttaattcaccctgatcatcagaagagggagaagattaatatcactgaagtcttaaaatcagctgcagtgctaggggctgtaatttgtatgactgattcctcttctaagcttccctcaggaagagaatccactagaatcctaggacagcatctccctaaaaggatatgaagaagtagatccaagcagaacaaggagtagactgtggtgaacaccaagatatgcttccaaggtactccttcaaggaagaacttgtgtggcccaagctgtcagtagcttcatggtttgccttagttccagagagccttcttgaccaaaggtacatatacctttcccaggttggtccatatacagtgactgcttggagtaaactataaaagcccagttacttaagcctagcatgggactactcagatgggtcataaaggatttagagcttcttgcgggggtggttgaaacttagtagggtctgtgtcacagattgacttcttcctctacccaatcctgtttcttccctgactctttctacaactgttgcttcctaataaataccctgtagcgaaatgccatctcagcagtttgcctctagaaaatccaatgtgtgctcacagtttttctctaactgtggaactcaatccattgagggccatggaaatactgaaaagtgtcaccaaggttatatacagccactcagagtagactagatacataaaacgtatctaccgtaaatgatcctcattcttgagaacattggaaacaactaagatagaatctcttcttaaccaaaatctgtggttatggaaaaaatggaatttatacctttattcaatgttcacttatgcttgatggacacaacaactatcatacctagcagtgtggctcctaatgttcactgtagtttcaatgtctgggtaagaactgttgctatccttaggaaacacagaatgttttatcctgccttcctataaggaagaaaattgttcattacatatatatggtttctggggattggctcccaagtccaaagtgtaagaaaatagcatttggtatgtatcccaaatccaacctaatggagattctctgagacagcatctggagtgagatactcattcctccttttccttcatactaagtaataaatcttttcctgatgattggctggaggagaaaacttatagagctcaccaaagactgaagacactttgacagcaaaagctatagctttttataagttttttttggaatatttaccaaaaaatttctttaagtctatttctgtttcattatgtgcagtgtgcttatattatgtacttgcagaattttactatgccagtatctagtgcctaaggagttcaaataaaccagatgaggaaatgatgtagcacagagattatactgaatcatatctgttactgaacataggatatatactgccctcttaatttcttttctggcatgaagtagtagtataaataaataaaaataatgactactcacctgtgctatctacttactgagtcagtctttgaaactaagactgtgcctagtatgtcttattaaggtttccaaaagttgaagataaactatctacaaacactggggatgaattgaagaaaaagcaattttatacaaaccctgcattcattaacacttttaaaaagtgccataagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaagtgccataagatatattcagccatttatttagtcaagaaacatatttgagagcataatacatgcaaggcatgctaaataatgtaaaatgttttatattatcgattacatttagaatataagacaagcacttcatgattatggaggttcctgattagacaatagtctactttggagtcacagttcctccacttcagacatttggatacataaagttttataaaactgaatggtctgcttagtatccaaatagggatttcagcttctaacgtttccctaacaactatttgactcttggatcaaaaatgtagtaataaaataaaagttcagaacaaagttttgcccgaggaaggtctggcagtgatcaagagaatatgcctggaatgtctactcaacagatgcttttactctcacatttatgttatggtaaactcaagaatagaaaggcaacttgtgctgtactccctgcactaaatttgcctggcaatgttgttcacatagcctgcccttttgaatgagtctcttggtaataaatcaaaggtgataatgtgaatatcatccacctaacttggttgaacttaaggtgttattagtttcaaaaaaagtaacttggatgagaaataagaggaattctcttgctatgacacttgtattgcaaaacatctgaattgcaaactcttcccaagactctaataactagcaggaatgttaagagaatgttcagagaatatatgcttatatgcagaacattattttcacatgtaaattgttaaattagttctatatttcttccatgcagacctcataggtgttgtgttttctgaggattatatctaaagacaaactcagagtaagaaaatctaccatccgatgcctccccccactgtcaatattcccttcccctcaaatcactctaactacaaatgaggaaaatagcagcatggtatggaggattattagtctaaagacatgaattccagcttagatcttcaattctgaagcaagtctttgaaccaatttgggtttcaccttcctaattcaaaaaacaaaaaggatgggctagataattctgttcatatttttagctctaaaactctacgattttaacaataagagatatgaaaagcattcagttatttagagggtatttaaaatctctggacaggtaagaacgagacatgtacttttttttaaaaaaatggaatccttttattatttcatagtgaagaaggtgtttccagcattctgaatcctcagtaccactaagaaactatttcctgacatatctacaggaagcaggctttgtgaccactcagagcttactttattttttcattaatcctaaaaacttgtctaatcttttaaacttacttgatcttctaaactcatgtgtgctcttttgagtgtaggggctgtgctccattaattgtgatgttcatctcaatgctcatctcattgtctagcagcatactgggcacatagtaggtgttcagtaaagatatatagagtgattgcacagcataaattagatgctggtttctaaattaatatattgaaattacagaagttcccacagtgtacttaaacataggaacgttaaagtatttacttgtttaagttatgaaaaaataaagaaggaaaagtggagatcatatagggaaaaagatgttttcaagagactgcctttcttctctctttaggcaataataaatctttttgaagttctctgccagctagttagactatggttttttgaaataccatttgatagacacatatgacatttttagagctcaagtacaggatagcatctttgagatatgctgcagaaaaacctagaaagttttcctgagtggtgaagacatcattggtcggaatgaaatgacagagggtcacatttctcatttctttcttgtattgtgatttcctcttgtattacttattcctgctggttttgagtatctatcctatatggtttttgcctaagtgattggtctttccttggctttatactgtgccttccaagttagtattattggttatttggagttcttgaattttggctttgctacattgtagaatacgctaggtaaattagtaatctcattacattagttagtgccaatcataatccccaaagacacagtcctgaatgtcataatctggaatgttgaaatccaaaagatcaaaatcacaaaagttcaaaattcctaaagtctaaaattccaaaaatcaaaatcctcaacattaaaatccctaatgttgaaatcctgaaagttgaagacacctggagaagggattagtgtgtcttcagttgcatgcaggataattgcatcacgttagttacatcacattacagtggaactactgctttgttactgtctttatttggaaattatagatggtgtgaggggatgcttatgggtgccaaattgatgaggggtagactcgacttaattttaggtgtcaatttgactggtataaggaatacctaggaacctggtaaagcattactttgggtgtgtctaccagggtgtttccaaaggagattagaatgtaaccctgagtggactactagctggagaagatctgccctcaatgttagcagggagtatccaatctctcagggcctggagagaaccaatacagaagaaaaattggttgctctctgagagctggtacagacttttcttctgttgccttggacattagaattccagggcatgccagcttttggactccaggacttacaccagtacccgctatgtcctgtggctttcagcctcagactgagttacatcattggcttccatggtcctgaggcctttgtacttggacagagccaagctactggcatcccagggtctccagtttgcagatggcctattgtgataattctcagccaccataatcatgtgagccaattctcttagtaagtcctttctcatatatctgtatataaccttatggttctgtccctctgaagaatcctgactaacacaaatttggtatgggaaagctgagtatcattctttcatactgtattccttacaacacaatgaaagagatctgtgaaattgttctcccaccaaaaagttgtgataagttaagtgaatgaggctactgaatagtgaaagagaaaagtttaaaagttaattactactgatactgtgaaagcagaaaatcacttaattgcaacagttgagcaataatgaggctttcgaatagacaacatatgtttataaaatgtgtagacaacaaccactctttaaatacgagtgcagcaggtgtttcaaagattacagaagtgaaaatgcaggttgaaagtccaagaaatctgtccttccaaattatgcaataatgtgtgacttctaccccttcacacatagcaccaatttgctgcgctatgtatttcagcttcatatcattccagactggaagtataaattatgaaaagacttttagaaagttctaattcattttacgcatttttttgcaaatttgactccatgaaagtgcattgtcacaatgctgacagtgtgtgcaggcactgtgtgtatatgttaaaacattgaactttcccagtaaatgaagagatgtcctttttgtacattcgcatttgtgaaagataaaatttctacagatctcagctctttggaaaagattatatggctatgtgcatatgtagtagtgactcactgcagcttttgtattgatcttgtcaaaagacttatgttctctattacagtatttcagatgagtgcagttataaagctgggtatagacaattaccaaccataggtgacataagtttttatatatttcactttttgacctatttatttatgaatattgttcatctgcttataactgatatgcaactgtcactagaatatttgagtgtttatgcttgcaaaaatatgtatgttatcattgcctattttattaaagtagcctaggaagtgttctgttgtgttttttatgtttctcaaatacagcttattttaacaatgtaaataaatcttttttaaaaaaattttaaattattctttccagaattatattttcggatttgatcttatgagatcatagccgaaatccctcattagtacttcacaggtaggacagacacttcctctgtgtagagaagagactcttttttttttattattattatactttaagttttagggtaaatgtgcacaatgtgcaggttagttacgtatgtatacatgtgccatgatggtgtgctgcacccattaactcatcatttagcattaggtatatctcctaatgctatccctcccccattccccgaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgtgtttttttttttttttttttttttttttttttttgagacagagtttccctctgttgcccaggctggagggcagtggcacaatctcggctcactgcaacctctgcctcccaggttcaagcaattctcctgcctcagcctcctgagtagctgggactacaggtgtgtgccaccatgcctggctaattttttgtatttttagtagagatggggtttcaccgtgttagccaggatggtctccatctcctgacctcatgatccgcccacctcccggcctcccaaagtgctgggattacaggtgtgagccactgcgcccggccgagaagagattcttaaatataataatacataacaacattgtactgaaaatcctgaagcttaaggatgccctgactgactgaaaagttgaaacaattttattaaaaaattatatgtgacttcttcagttaaaccttgagtgtggttttgtatgacctttctcttgtactggagttctgtagcatatagagcagaaagcaagcatatattctcatccttgagaatactgatgactgagaccttaagaccatcaccaactgacctgctaactactgccacagatgccagataggttggtctaattatgtggcaactagatacatactaagctagatcttggagtggggtgagtggcgggtgcttccaatttcaggtggttctggattttaagagtgagatgaagggacccaccttcagacttcctataggcaacttaagtgactatctacatctttcagtctctgaaatgttcttgagaggaatattaatatagttctttatgacttatttggtaaattactggttacttggaagatacgatataattcctcaaataatgtctcctatgaacatttcatctgcacatctgggcaaaaagagttaagagagcaggcttgagtttgccatctttaaaatggcctgcttacaagactggctcttggctgatgtctggggaatttggatttggggacagttcccagcatttccaaaactggcaagagtggttcattgtgcctcaactgtttgtgcaaacaatatagtttatgctaaacacttgttttccctctgagagtttggaattttgctacatgatagccagagggtagctatgtgatcaacccccagtaaaaatcatgaatactgagtctgtaatgagctttcctggtagataatatttaacatgttatagctcacttccgagttgagggtattaagcgcatactgtgtgactccaccgggaaaggactctgggacaccgcaccgggtttccgcgggacttcacaccatgtgccttttgcctttgctgatgctctgtatgctttcactgtaatgaatcttactcatgggtaagattcattcatatgctgagtcatgtgagtcttactagtcaataattgaacctgggagtgacttggggaccctcaacacagtgtcctaaggtatctccatgagaaacctggggagaaggagaaatgtaactgccttgttatccttctctttgtgcagtagtagcagtagtacaataaatacaaccatcaccatttcttaagcaccttctatgtgtcagcttcatccaaggcagttcttattttctacccctgacaataaacacggttaaaaggcatttaccctaagtggaagtagaattagaaatccaggatcagaattcaaatatatcttacctcaaaacccatgtactttctaaaataacacattcattccttctccttcttatgtaacaactatttaatgaaaagcacctcatttttatatggcagtttgtttaattttcaatattcaaactgaaacagaactactattctgttgaaattcttaactgttctgtgttctatatatacaccgactagccaatatgggaaattagtgactacaaaaagaaagaaatccagtcagtgtgtacttcatgctttttgcacaggacaaaagggataattctgagtttcgaaaccttaggattagatgagatattaaatgtaaaataattagcacatggcatgaacagatgcttaataagtattagtcccaattttcttatgggttacaaattattttggcaattaaatcaatgccttaacatccttgtccccattcccctatgtactgttttagatttacctactaaaactagatgagcacaaagtggtcttgacaaatacatgtagaactcaactgatcctagttgctaccagattgacaagtatttcaatccaagacttattcactaaatttctgccatatgccaggaatgtgtcagataatcaggaaacaaaggtgaacccccatttacaatctagtgtccgcagtccagtggaagaaatgcaggttagttataggtgacatggagaagggaaattgaaaccaactaaattgccttattcggaacatgcatattctttcagtttcatctatgctattctaactagaaacttaatgaaaataagttactattgcacatattttcatgttggacttctcctgtaagtatatctattgataccagtgagaaaaaaataactgatactttaacaataaagagcctctgataattctgttatgggcaacaaaatatttgttttaaaaagctgacttaaaaaaatcagtgtaactgattgaacttcaagtggcatgtatcacattacgaagactttacactatactacttcctaaaatataacattctaatccaggctaataactatttgtaatttttttctcatattattaaaatgagaataattttaaggatagttcatttctgtcagcagtacatggaagcccctcaacccccgacaatttctccaccacagaagttttatggaatttggcagccatgcatgtatgctataagaatttatttcattatgttttcccctcaggccattgtatttctttgaaatacattcaatttctttgaaattggtatttttgaaacagtttattccttttttccctgcatccatcactttctgtactgttaagatatcaattactccatgaagtctcatgcatatctcctgatgaaaacaatcaacttattcttactttgtaagggatagatcaagtctcaacttttttcaagaaggcttcttgactattttaaaccactataagctctcattacccttatcctctttagtaactaaattatttaccatgaactttttggtaactaaagaaaccattaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaagaaaccattaactcttatcctgtttcttatattataaatatttactttttgagatttgatgatccttaaggagagcaatgtcatcatgtgtttctgtataccaacacaacttagcaacaccaaggagtcaaaaaactatatttttgaatgactcctccctaactcattctatgaggccagtatcatcctgataccaaaacctggcagagatacaacaaaaaaagaaatcttcaagccaatatctttgatgaacattgatgcaagcacatgtaccctagaacttaaagtataataaaaaatatatatatattaaaaaaaatcctcaacaaaatactggcaagctgaatctaacagcccatcaaaaagagatgtacaacattaaaaaatacaaagaattgccaattacttaatctttttgaggttttctgaaacttttgcttaacattctttcctgacatacttttgacaatttttcatcttttcagtatcggttatcgtgacatattggtatcttctactatactatgaaagcaatctggtctcacagtccttactcttacccgttttgttatattattctaagatattttgtttccaaaatcatagttagacatgattgtcactttttcattcaacaaatatttattgaacaactgataagtgaaagagtcttgtgctaggcagtatgaggaatataaataggaagggaaacacagattcttccctaagacatttataatcaaagagcctagggatataaatatctaatacacaggaagaaagtgctaaaaattacaaaagactacattttatcaaatttaacaagagataaagtttattttcagcttggatatttagggaagatacaaggaatagataaaatttggatatatatacagagatggaagtctagggcatttcaaaagagaactgaaatcaagttgatccaaatcattaatctttgaacaaatgtttattgaatatatattatgtgccaggtactgtatataagatatagtccttgagtttatggagcttttactctatttcctaaatatcttttataactttccccttcattgctgcccaagttgaagcatttcgctgtcatttctccttaatattactgcaataactttgttattggtctccctttatctccaattcatcttttatcttgcagctgcaagatatttctaactggcaatatgactgtttcaaaatattactataaattcaatgatctccttacgctacaggatacaatgttaatgactgtagatggcatatatacagggttcctcattatttcatcattgtctactccttgttcagaccctttctttcctccctcctcccttttactgtatgatccagtggtataaaactaactgttattcagtatatattggttctctcatgattctcagcctctgtacatgttctgttacctagagtgatgcctaaggccttcttacatttttaggaaaactcctccacattattcaaggtcctgctcaagagctgactcttcttcaaagccctcccctggttatcccacaaaaaaaatgctgtgctcttttattatagccataaaatattgtatcataatggatttttacttgtctctcacgaacacataaaaagcaagaattttttttaactatttatctgtaacacctaacggttatgtctgacaaacaattggtatccaaacaatatttgtggaatagtgacagactcaaaaagccagtggattaaggttgtaaagaatggatgcaaaacatattacggatgtagaatttataaaagtaactcactgaaagtaagtacaaaggaaaagagggaatataagaaaaaaatactgagctttcatcacctggtaactggagagtgtggtaccaattacagaaaatactaagaggagggggtgaattgaattttagaagaaaggtgataagtgtgggtttgaacccagtaagtattaggcttgaaaacctgaaaacagcctcaaacaatggcataaataagttttaactttactaaaaactacagatcaggggaagtgttcagatttaacttcatctgtcattgatttcacaaacagaagttacccttcatgatttagtttttgcttcacgaatcatggcgcttaaaggacttaaggtccagaagggaaaagacatattcaaataaaaaatggcaagaagtggtaatagaaacatgtataaaatacagaggatacttgatgtgaagtatagaagtgatactggcattgacttgtagaaaaaaaagtatttgtaaactcaagaagttgggtgggacattacaggcaactagtagaagccaggtgagctgtgactcattgtgccttacctacctccagctatcatgaactgcttacagtacagttctgcaaacgctccaggtcatttcatgccttcatgttttattctcatgctgttgttcccattgaaatgtccttccttattccgactgcttcacaagaatctgtcgcattttcagacttagattaagcacactaatgtcctctgaatatacagacagtagcaaataaattttaaaaattacctttcatttcttaatttatcatagttcaacatacacatagtgtcaatgtacaaaaataaggcatgtggtcactgctgtagaagagctttctgtatggatagttcaagtaaaaaagttactgtgatatcaaacaatgaatgctaagaaccgtaatagtgtagatgaaagtgctgaaaaggctaaagtaggaagaaacggaatctaactgggcgtggagattagaaaagacttcatggttgagaaggtaatttaagatggatcttgaaagttgatgcttggtggacaatgagggtgggaaagcgaaggtctttagaggtgacagaaacagcctgaaacaaaggcataaataagtgagtgatgtttaatgaatattgagtggccagatcatagggagtaagttggaaagtgtaggaataacaactgtaaaggtaggtgaggaatatattgtgggtgatcttaaaagtcagaataaaaattttttacaatttatattcttaaagcctctacagactcattttcccccttataatctactatgtcccattcccctagcattttttggaggcatttatatcatcttggtcttttctgattttagtgacagcaaattgattttatcaacataccagaaaaacatagattccaaaactcattaatcagaaaagtgctgagcataacaaccttgtatctcagctgttactatttttccatttttaactgaaaatgaaaaggttatatacttacaaaaagttttctacaaaacacaaaggtggctatatttgtggttaaaataaaatccagatttcaatcaattatttttcttacagtcaaaagtagagcattcatatatttgtggtcaaaaaatgcaatgctgctcccctcatcgggctgcttagtacaattaatgaaaaaagagacatttcataaacagaagatagagtccaaattcaaaatatctcaacctgataggaaatataagtttaatgacattctctgataactttttcaaaataataaaatgaaaagtcactaaaacttaaaatgtagaaatgctttgatctgtaaagcaagacttcaaaaaacatgtaaagtgttcagaaaaatgtttctagtgaacatgcgcacataaagaacagatttcactcctcttgaaaatattttctggtaagattcttaagtgtttgttaaggaaaaaaaatgatacattccataaaagtattttagacatacatgtggtgtacatgtaaatgcaaattaattcattatgttcacactacacaaaataaatatgtgagagcaacacaatttgtctgctaatttgaatctgttttctgatttgagagtaagagttgaagaaatcatcacatttgtgtttaatgtttcttaatgataaaagacaaattaggcagaatcacatatggtagattcatttaacaaaatcttgtacatctcaaataaagtataaccttccaggacaggaaagggcaaactacagcccgtaggctacctcctgccagctgtctgtttttgtaaataaagttactgggaacagagccaggctcaatcatttatgtattctcgatggctgctttcatactacaacagttgagcagctatgataaagaccgtatggcctgaaagtctaaaatatatactccctggccctttataaaaaagtttcctgaccactattctataatgtttgtaacttttaagttttaaaatttagtatattgattacatagtccttaatatttttttagaaaaatcagaaccacaatgatttttcactatttttactctcagattataattcagccatcaccttctctaagagtggtattgtcaacaggtggcccaaagcaatgcctttacctttgccccttccattatttccatcagtccttcccattctttaataccaacaagcaatgtattctccatttgatatatcctgaccataaaagtatcattagaaccctttgctatttttactgatttgtaaataaaaataagacagagcactactaataaatgcaaacagtatagtttttatgcaaactagcttcaggggaagtcccttgacagcctcttccaaccaaaatgccacccctcgaccccttctatatagaaagttagagctgccatttcctcgaaagttgtgattaacactttataatatccctacctaagagaatagtaacatgtttttagcaaaataaagccagagtttctctatcaacacctatgtccttatgatagctgccaaaacaatttttacttctttttcttagagtatcttatgaaagaggactaatgttttggcaaaattatgtgtataattcttttctcattttctagatcgtatactacttaaagatcaagtcttactttactgttatctctagcacacattaagtgttcagtaagtgtcttctgaatgctagaataaataaatgagaaaaatactagtttttaactgtatctttcttttgtttggctataaaaatcacagtatccttctaaagcacagaaacataagtacacgatgaagaaaaacatgagacacacatatttgtagacaatgaatttacttcaagtcacagaataatgtttaaccctattaggattctaaatattaatgtcacaggcacatatacagaattacattgaatgtgatttttaaaaaataatcattaggagtaaatccttaaaaatcagaggttattaaaaaatattatttctatcaattctaaaacaagtaaggtgatcaagtttacatttccttagtctgaaggctaatgggctaattgcctctgggcagtaagcatgttaaatactcacatctgaaaaagactgatgctattggaaaagcaaagttccattttaatatctcttttatttttattattttgaagaagtaatttattgtttttacaatttgggcaatctgaaaaattttattagactaagaagggtactctcttgtttattactctttaatatggcacgtataataactagcttgttttctacaccagtacatgaatgctaggtctaattctttttcagtttcaaaaatgataaatatcaaatacatgatcctaagacataataattttacatgtccgtggtttttcagaatagcttctcaaaccataatatggtacatgtggccccatgacctctaacttcatgcagtaataacaggattatacttattcattagaaagacaattgaaaatcttcagctaattgctaagaggaagcaggatgatggggagaagttaaagatatctccttatcagtcccagctctgctgctatatgacctgactttggacaagtttcttgacttctctgaaacataagtttccttttgtataaaataggaataataatcattattttccagggtgtctatgaggattaaataatataatatatgcaaagtatctggcatattatcagttctcaataaatggtagctatttttttatcatattcaggtaaacatcctcctgatgatgaaatgtatcatggatatacatttcatataaatttccattgcctgagaaaaattactaccccctattacatagaaggtatacaacagctttattgctgttttatagatacgagtagcctaaaaacaggaggggtcgatgacattctttaagataaaggcactgaaactgcaaaggccctagctaggcatagttgtagagttatactacagttcttcctgcatggctgaatggtaccaccagtatctgggtctttccctcaaggaaatatgacttcttatgatttaggtaggtcccactaaaactagcagtctcctattgatacggaagtgcagggtagggaagggctgggtaactggtgagggctccaccctcaggcctgtgcctaggatggcccaccatgctccccatcctgtgccgctataagccggatacagacacagacacaaatgggtggatgataagagaagcagaataacacaacaacagacaccagcaggccatctacggggagaccacatggaattcagttggtgtagttgggagaaaagtccagccactgggtggcctgactccaggggaagaccaccttcccattccatccccttttggctccccatctggcttgctgagaacaacctccatcactcagtaaaaccttgcacccatcctccaagcccacatgtgatctgatttttccaggacaccagggcaagaacccgggatacagaaagccctctgtctttgcgataaggcagagcatctaattgagctgattaacacaagccgcctgcagacggcaaagctgaaagagcacactgtaacacatgcccactggggctttgggagctgtaaacactcaaccctagatgctgccgtgggattggagccccaaaatgctacgcactacctgcctgtctgcatgcttcccctaggggtttgacagcgggacaccaaagaaatgagccacacccctattgcacaccctgcaggggggataagggaagttttcccatttcattattaatgaaagaaaaaattggaaataaaataaaaccaacatgtatcaagctaatttcatggtaattctaccagagggtagcaaaaccaatcactgtatcaaatgaggttttgtgctgagcacttctacgatatttttttctggctctttcaaagtctttcctatttctatcacaaatacattaagttatattttcataattctcagaggcaaataacatttgacaatatttttaaaagtaaattgccagcttggcttaagatattacagagcaaaattttattttaccctttttcacatctcttaaacattaattctcaaggatgcacttcaagtttaaaaacaggacaaattgatgattacctgatgcagaaaagagagacttggaacggaagataaaaattttggatttgaaatccaggtctgctacttactcactgtatgaatttggatacattacataacttcaataaatttcagtttcctcatttatagaatgcaatatgaaaacttatttcataagagttgtttaaagactaaatgaaattaacaggccttcaataaatatatttatttctttttatttcctccactgactccacctctttttgcttctgaatgaattcgttataacccagctcagaatcagtcatgagagggtttatgattataaaggttttgtaatgagaaacagagtatctgattttgaggattatccatgcctttctcttcttcctctctgctcatcggtcatttattatacattagcacaccagacaggaggcagaaaaacagagaggacacagtagatttctcatgaaatcttactttgttcaccaaagtctataagtaaaggaataattgtggtaaatcaaataagttgggttatgttttaagagatgaaacaatgtggccagactactggacaatcatctgaaaatcttcacgtggggcagaaatgtggcaactgaaacttaatgtaatcaaggaaactgtgaaaaaataaatccacattttacatataaaatatgagaccagaaaatgaccctagaagtccccaccgattatttgccaaagacatcctcagtttcctgttacaggtaaaaggcttgcttgatttaagtatcatcaacagtaaagaaaacataataggagtcattatcctactcatgaagaaagctgtgaagtcactgcctctaaaatactttagttttgtttgctccaacatcagaaagacataatgaaactagaaaacggccagagaaacttagaaccaacccaaatgcccatcaatgatagactggataaagaaaatgtgacgcatatacaccacagaatactatgcagccataaaaaagaatgagttcatgtcgtaccatcattctcagcaaactaacagaggaacagaaaaccaaacactgcatgttctcacacataagtgggagttgaacaatgagaacacatggacaccacgaggggaacatcacacaccagggcctgtcaggggatggggtgcaaggggagggagagcatgaggacaaatacctaatgcatgcagggtttaaaaccgagatgacgggttgatgggtgcagcaaaccaccatggcacatgtatacctatgtaacaaacctgcgcattttgcacatgtatcccagaacttaaagtataatttaataaataaataaataaaataaaagggccagagaaaagaagtcaaatttgcaggtgagaggaagactagaaacatcaacattcttagaaagaagtcatggattcttagaattggaattatcctgagacagtctatatgccatttccttgtgcttccagaatattcctgataaatcctaaatagtttagttatcaaaggcctaattgcacactggagactgactaggatcctcccctgatttgcagcctacctccaatctgttatctcaaatatcttccaaatatatccacttctctttatctccactggtctaaatcatctttctcattcatatagactactacagaagcatcctcattggttatcctcttctacttctgctctttacagccatgcttcccaatccattgcaataagagtgatcttaaacctcaaactaaatcataacattggcttacttagcatacctttagcgattgttcattgaccttacattcaagtgcaaagtaataaacatggtcctaaatgattggctcctgcctccttcactagtatcatctcacataccttctccctttgctcatcaaagcttatccacaccaactttatttcagttcctcaaaagagctaccatcacatataacaataacctccaccacaacagctaacatttatcaagtttttactacatgactggcattgtgataagtgctttatgtgcattatcacttttaatcctcataagaaaatctataaggtagttattttcatcgttttactgctgaaaaaaaaacaaatatttagaaacattaagtattttttccatagcaaggtaggtggcaaagatggaaattatgttatattgcatattccagggaagttttttccccaccccttccctggctaacttatatcattctttatgattactacttatatgtcatttcctcaaaacagccttctctcatctattgatctaaaattggcacccttgtcatagtcccttgtactattttttatagaatgcatcacagtttacatatttctttctgtgactatttaatatctgtcaaacctccaatagactgtaaattccatgaaggtagggaccatatgtttaaaaatgtgcctgctataatcaataaatatctgcctaataaatgattgaaaaaagacatcaaaccttccaataataaggtgttggatcactctatggaagaacctatttgagtgttagaaattctattaaaatattcttgcctacattaaaccaaaagctgttcccttataatgtctatccactgatcctaatattggtcttttggccaatagtgaaaaagaacatgtttttttctttacagttcttcgaatactttcagcctagaaagtttaagacagagaggactggtaattatggttagataattctagatttacttctaaacatctgaatgctagaatatggaagatgagagggcatcttttgaaattagagactcatctggggcacatttatggaaattaagtctttgtatactataaataattgcaagaggtagacatgaaatataggtgggactgctgtgcttcacacactctatcacaaattgaattctaactggtataaatctagaaacaaacaaacctggaggagggccagttaaaggcaattaatgactatacaaaaagattgaacaaagtaaaaatcagctactacaattacaagatagatgtcatgaagtgcaaccatatcttctcctatctctcaagaattttcttggcaacagaactctggattagatgaactatatttctaagattttgaaattagaaagacaaaatgaaagccagaattactgagagccaaaaataaaaatattctttagacattttatatatttgaataaacttgatataggcagtaattttttaaagaaggcttcatgtgccatccttaacaagaaagatagaatctcaaagttggaaaggtctttttgtctaataacttatcagatgcttaaagactctctacaacatttatatgagatagctattgaactaatattaaaatatccaagcatggcataatgcaaagatttggattttgagtttggagctttgggtttaaatctcagttcagtaatttattagctatgtaactttgaactggttactcaatgtgctccagattcctaattttaaaaccagaataacaaaatgtatcttttaaagctgtttgagaattaaatggaataccgtaatatgaaatgtcacttggcactatacctagtacatagcaaatgttcaataaatgttattttccctccagtgacaaaaatctactacctgccaagatagtctgtttcctctttggaaagcactggcagtgggttcttatactatgtggaattagtccaaaactattaagtaaataacacttaaaagtttaatatgtaagatattactttaagaaaatatgttcttcattagcattttaacttcggatgccaactttatatatatttcttaagcaatttgtcactcagaaatggcagaatttgagtaatcttagagaaatatgttacaatcatatttgactagaagcctttaataacctaattcatacaaatacttccttgaaactttcccagaaaaagcaagaacaaaaagttctccttctagtgactcaggattaattaggtatggcaattatcttttaggactacacagatactcttcctatttttattaacaattaataacaaaaaatgggcatcagaaatgttttgttgttttgtcacaagaccaagatttataattaattatttaagcctataaaacaaccatatagaagaaaattttttaagtcataagaaataatattatctattttgtgacaattaatttagcacactctgtaaacgaattcactttcctggtgttaatttaattttccactttatgtatgttatgtaagttcatttgttagagaatattttggctggctttcttcattgtaaagaataaaattacttctaacaaatctgattcaaatacaacatgaagcctgttcttccacaataatattaatttgaacaactcaaactttatttgaggaacacaattacactttccagctcaatatctcttaatttacctcaacttttcaaacctaaagaaaaactatcttcaagctattaaattattgtataatttaataagctttttaataatgaaaaatggctgagtgcagtggctcacacctgtaatcccagcactttgggaagctgaggcgggtggattacttcaggccaggagttcgagactagcctggttgacatggggaaactccatctctactaaaaatacaaaaattagctgggtgtggtggcacacacctgtaattccagctatcccgggaggctgaggcaggagaatcgcttgaacccgggaggcagaggatgcagtgagccaagatcatgccactgtgctccagcttgggtgacagagcaagactccatctcaataaataaataaataaataaataaataaataaataaataaataaaatagtgaaaaatgttaaggtcaaattagattgaagctatcagaataaaattaaaaaccaaatattagaaacaatgtttctgaggtcacaaatatactttatattggatgaaaatgtcatcaattgtgttttctctcttttctcttttgtacaataggttttatttgccagcagaaacatcacaagtaagtttaaatttgtagtggataagaattattctgattccgagtaacttgactatagcaaacgtaatcatggctaatatgattcctaaaaatgcttacagctgattaaaaaataagagcataaaataagcttactgtttcaccaatttttccaatatttccttgatctcctacttctccctgtcaaaaaagaatataaagttgcaaaaacagttatttttcaaactagattattcatgacagtttcaattttcctttttaatgtaattatctagtcataacctagaaaaaggcaaaggaaatttcagttacttaaaactttgttataagtggagcaaaccaccatggcacatgtttacctatataacaaatctacacatcctgcacatgtaccccagaacttaaaataaaaatttttaaaaactctgttatagtatttctatgaaatgtggcctaccctctattttcattcaaatagtaacgtatcagtctgttctcacactgctataaagaactacctgagactgggtaatttatgaagaaaagaggtttaattaactcacagttccacggtttaacaccaagcatgactgggaggcctcaggaagcttacaatcatgatggaaggtaaaggggaagcaagcacaacttcacatgttggagcaggagagagtgagagcaaagggtgaagtgccacacacgtttaaactgtcagatctcgtgagaactcactcgctatcccaagaatagcaaggcggaaataagccccaatgagccaatcgcttcccactaggtccctcctccagtttgacatgagagttgggcagggacacaaatccaaaccatatcaggtaataatctattttcttaaaaaatattctcctattcgtgacttttaatcacttttatcaataaaatttttaaaaataaaatctttattgaggtgtactctgtaaaaggcagagtagtaagcactgtgaaagatattaagaagaataaaattaaagtctttcccacagggatgttctatttgctcaaatagaacagaatacatgccacaggttaagtactaaaggaggtcttaggagcaggcaccctgtgaactggagcagctagagctggcatcactggagaagtaatgcatgttcataacctctgaaacaaaattttgcaatccataaatctctgaaaactcagttttccacaactcatttggtggcaaacttgacctaacttggattgatttggcagtaaagcttattttgttctgaataaggccatttatagtcttgatttattccaattaatctaaacgtccttacatttcactacagaaatattaatatatctaattatggtatgctgtcccacacccttctggtagtggtaaataaaatacagcatatgcaacatattacttttcaaaaatccaaacattaatgatttcaaataatggattatgaaactgtaagtggggccctgaaaaatatgtgatacttaacactggtaatgagaaagcgtcatttttagtggtgaggaatggcatcagcaaaggtatagattaacgaaaggtaaaagattaagttcaaagtacaacagagactgactctaagagcaatatacatttagtgtacagaaacagattaaatatgttatgtctaaaagtaatcaattactgtctaaacagtaataattatattccagtgtagaacagtaagatgttaagatactgaaaaatattgtagccaataatgacatgtggctactgaatatttgaaataggctggtctgaattgaaatgtgatgtaagtataaaaaatacatcagacttcaaagactttctacaaaacaagaatagaaaacatctcattaataatttcaatattgattacatgttgaaaggatataatatttggatatcttgagttaaataaaatatactattaaattaattttacttctttcttttcactatctaatgtggctcatatttgcagttcatgttgcatttctattgaatagtggtgattttaagcactgaaacctaatattcatcatgagtgatcactgaaataaactttcaaagtctacacaaattttcttttcagtttctgtatgtatttagataaatagtaaagaatgaagcacagcagtaggttttaataactaattttaacaggcagttcattagacagcatttatggaaaatttatggaagaataatatatgaattattggttttctagtatttttccctccttacccataagttacccttcttaaattccaaatttgtgctacttagttttaagggaggtttgtgttaatagtcaaaaagcaaaagttgtttgcagattacttgcattcttactttagttttcagaatctgaaggtaagaagttacttgtctttgacgacaatgaaagagagagagagaagctatttccccaggcctagaaagaaaacacagatctagggttctatgaagagtgtgtcccttaagcaactcccccaggcagtgccaggtccgagttaatagctacatgatgtattgaaacgcaaatttcagtgacagctagggaggaatgaacattacaaaatttcctgtgtttactaggtaacacagaagccacctagattttggtgtgattctagggagagaaagtatatacataaatgagattccgtttcttgccagtttcactggatggtagctcacagttggatttcctagcgctatttggcagtctagtaaaggagaattgttaatcccaggcaaggagaattgattaagccttttgtttgtaaatactacaatcctatttttcagaggacttttatatgtaacttgagaaagagtcaggtacacatattctgccccaggataactttagcctcatacatactgatatattaaaacatacttcagctcatatttctttatcaagcttgaaaagtgttgtttagcttttcgttaggttccagcatcataaaaatgatacatttaatacaaaaaaatagcttcaggaaacgtagtaataatgctgtgactatgtcaattcatagttaaattttcaatttgcaaaacttaccaattcttataagctagtttctttcaggtctcaattctgtatgtaataaaccattgcattactttatatttgttggtgttataaaaattatccaagaccttggaaataaagtaaatagtgagagatatatctttttaatatcataaagtgatgaaggttacccagtgattatctagtgaatattacttagactcactgtttactagtgattaaaagatccagacttagtaatgttatagaaacttgcacatttctacccagtagaattgaaaaccccagcagttatggtttattgccctgtatgtaacacacaaatcttatcctaacatttctttattaaatcacatacatagatatagatacagatacagacataatcacagatacacagattgagcatccaaaatctgaagatctgaaatcataaatgttccaaaatctgaaactttttgagtatcagcatgacactgaaaggaaatgctcattggagcattttgaatttcagatttttggatttgggattcttaacttgtaagcatgtataatgcaaatatttaaaactccaaaaaaattggaactctgaaacacttctggtcccatgcatttcagataggggatactcaacctgcatataaatagatacagatataaagatatagattctcagttgctctttgtaacagttttaacatctcactggttctttttaagttgatgtgttcatttcacatttgtatgaaagtcataattttatctttctgaaaattatattttaaaactgataataaagtcagttgctttacctttaagccttctggtcctggttcacctgcataccccttttgacctggttttccctagaagagaacagcataaaagaagaaagtatatatgtttagtcattctcatttttgaaagtttcctaagatatatgaaatttagactattcttataaatttaaatactttaaaattatttgataaatgtatttcatcatactcatttgccattcattctacaaatatccaactgtctactatgtgccatgaacggttctagatgcagaggatcgaggactgcactgaacatacctgccctcatagagcttgtattttagtgagaataacaatgttttaaaaaataagtaaaatatatagtatgttaggcagtggtaatatgtaaggtaacaaatcaagcagggaagggatatataaactgttgtgggagttttattgaaagtgtttgtaagattccaggaaagaagccctcaccgaaaagttctttgcagattacttgtattcttactgtagttttccgagagtctgaaggtaagaagtgacttgtctttgatgacaatgagagagagagagagagaagctatttcctcaggactagggagagaagagagatcccaggattctgtgaagagtgtgacccttgacccctcaaccaacttccccagagagtgccatttcctgggggagttggcagtttggtggcatttgagtaaagacctaaagaaagggacaagttaaatggatatctgaaggaaaagtgttccaggcagaggaaaagggcctgtgcacaggcactacagctaaaatgtgtgtagtatgttggaggaaccaggagaagctgaagaattgagagaagaccagtaaagtgatgaggtcaaaggaaatgggggatgagaagtcaggtcatgtagggccttgcaggttgcagttaggactttgacttttaactgagtgagataggaagcctcagacaactttaaggagaaaactgatgagatctaagttttaacaggatcactttgattccagggtagaagaagagagtccaaataagcgtctagtacaataatccaagtgagagatgatggggatgtgaatcagggtggtagcagagtggtaagattctggatataatgtgaaggtagagcttccaggaactgctggcgggtcatgtgtgaaacgtgggagaaagagaagactcaaaaatgaatctcaggtttttaatgtaagagtagcagaccaaatgaaatgaagaagactgaaaacaggtttggagggtaaataagaagctaagttttggacatgttagtttgatatgcttgttagacatctaaatggagagatcttgtggtagttatttatacaagtccagaatttaactggatcagttaaattctttctaatcagtagaaagatctgacaggaagaaataatcttagaaaccaccagcattttcattttgatggtatttaaagtcctagggtggatgacctcatttagccagtgagtatagatagaaatgagaaatccacaggccaatctttggggtactccaaaacttagaatttgaagaaattagaaaaatatttaatttgatgccagaaagtgaggaggaaaatcatggaagtaaataaattgtttctaggaggagagagtgatcttgtcaaattctgaaaaatagaaatattgagtaataagaggactttgaggattgagaaatgataattggatccagcaatacagaaaccactgatcgtatttatcagatcatttgtattgtagtggtgggaacaaatgtggtttaagcagatagagggaagagaaaaactgaaagagcatgtatagacaacacttttgaggaattttactgaaaagggaaagaaaaaatagggtaacacctgggagggaaactgacaccaaaaaagttttgttttgtttttaagctagaagaataacagcagctttatatgctgataggaatgattctgtatagagaaaagaatatgtaggagagacagagggaattgttggaccagttatcttgagtagtcaaaaggacagggtatgtagtaaacaagtggaagttttccttagcttgaaaaatggcctgttcatccacaacaacaggaaagaaagcagagtatagataaaagaaggtgggtagatgcaatgtcagaaaactgtaagttctcttctggttacttcaatcttctcagggaagtaggatgcaaggcaaaggctaagaataaggatgagagataactgaaaggagtttgaagaaacagaaagtataaagtaataatttagaaaagcaaaagaataaataggcttgaagatagaattcagaatgtaatcaaaggaataattataatgttttaagcaggatgaggaatttgggatcataaaggagacaagacacaatggaaaggcagcagaatcaatgcactgacattcctattggggctattagattggataataagagagaatgtattagaaagaaagatggtggttggggaatgagaagttcaaaattgaaaatgagaggttgctatcactggtaatgacaaagtaaagggtatgactgtagcagtgagtagctgaaaagaatagaggataagatcactgggggagagcaagtccacagacgaggtagcagggtatggtttcaggatgaaactggtccacctcagaagatcatcaggcattagattctcataaagatcacgcaacctagatcccttgcttgcacagttcacaatagggtttgcgctcctatgagaatctaatgctgctgctcatctgacaggaggtgaagctcaggcagttagatggtcaatacttagtgtcaacttgattggattgaaggatacaaagtattgatcctgggtgtgtctgtgagagtgttgccaaaagagattaacatttgagtcagtgggctggggaaggcagatccactcttaatctggtgggcacaatctaataagctgccagtgaatataaagcaggcagaaacatgtgaaaaggagagactgccctagcctcctagcctacatctttctcccatgctggatgtttctctgccttagatcattggactccaaattctttagttttgggacttagactggttctccttgctcctcagcttgcagacagcctattgtgggaacttgtgatcgtgtaagttaatacttaataaactcccctttatatatatcctattagttctgtccctctagagaacctagactaatacaagtggtaacgctcactcccagtccatggcctgggggttggggacccctgctatattggattttattgctgttgtcaattaagacatgctcttatattttttcttcttaaagtgaaacagaacaactctctggctcccattctgtttttactacacataaaagctttagccacttacaactatatttaagacttctagtcaaaacattctaatttttgcttttgactgctctaaattatcgaatcatttcctaacaagcaaaaagcaaagcaaagaactgaaaaccatcctattattattaaatatcaattgttctctacttaatttagatatacagaacaagaaatatagttaagaacctgaattattagattttttctatgatatttataaaaccaattctatttttatttccactggttggtaagagccttaatgagtcattcctttcatctttaataatactctttcaagcactgtgtagtacattaagatagagttatacatatttacattatggaaagaatctcactggaatctggtatcagcacattttcaaagtctttgaaatcaagcatttcagaatatcagtaacagaatcataacttcttgtcctacttaaattctatcatattgtattgattttgagagtgttatacttgaacatctaatactaaaatcttattttcacatctaaaaataggaacgatatcttgcaaagttgttttcaggattaaagatgattcatatacttatagcaatactaggtcccaaattgatattcaacaaatagcaacaacaataataattaatattaagactgtgtagaccagagttgaatatggttctcctgttttcgaaggaagtaaattttaaataagatcaattttattgggctcaaataccagtttttctgttaaataattctcacgaaaaataaaatgaaaactcttttttttcccccaatgggatatagcaatatatgtgctagtaaggtaaaaatgtgaaagaaataatcacagtctttttaaacgtaaaagcattttaagaaccagtactttggccaggcatggtggctcactcctgtaatcccagcactttgggaggccgaggtgggtggatcacctgaggccaggagttcaagaccagcctgatcaacatggtaaaaccccatctctactaaaaatacaaaaattagcagggcatggtggcacatgcctgtaattctagctactcgggaggctgaggcaggagaattgcttgaacccaggaggtggaggttgcagtgagtcaagatcacgccactgcactccagcctggatgacagagtgagactctgtctcaaaaaaaaaaaaaaaaaaaaaaaaaaaaaaaggaagaaccagtactttatgatgttgtcaagaaaagaaatgagatgtatttcatgtgagtctaatgcctcttaaaataaatgtaacacatataccttaattatttcataaggtaaactttgatcatgtataccaaaaatgtttaaataattcatttctagaacttgaaaacaaataattaacatattacccatggtattatctgatgaaaaaattggcagaaaatacatcttattagccttccataattttactaacacatttagaaaacaggaaatctcagaatattactaaaatggctaaagtatttagcttcctattacattttgagaaatttataaataatttgcacaaattactaagtctacagaccactgaaataacaagtaactatgtagtaggcataacatcattcaaaatatatttgggacttccagttattggcctattttattttggggcattttatgactttaatttgttttcatttttgtcctttactataatgtaaaatgttatgatgttaaaaacatttatagaacagctattttcaagaaaagcacttatggaaaattatttatatgatacctactcttggccccagttccccaaaggctccaattggtccttcttctcccttaaaaaaaaaaaaagtcagaacatattatggcctaaaatgagtatttaaaaatgtaaactcttattttctctatttattctaaaatgtgaagctcattctgagatgtgatgaaaataatgctgttattttcttgtactttgaactccatcaccccacaacactttagtttttttgtgtgaacctggtgcattcgtgtagggaccaaaaactatatgggtggatagagactgaagatgaacatagaaaaaaattaaaagcttttattcataattctctaaaagaaaaaaaggcagtaagtgtttttactccatttatagacatatttactaaatatactgatttacctttaaaaaatagatgattgttttctgaataatacatacagacctccctagaatcatatagtatatgttatttatttggtaaatattttgctcaattcacaattcaattaaaatataatttattggttcaaaaatattaagtagtcacaaatagtaaatataaattctagtatatatgagtgagattctgggttcagattcttcagacattccattggagaccactaacataaatcatttaatgaattcagaacactgtaaaatgattcttaattctattccataactggcaaaataaagtgttaacttgaaggctgggtgtagtggcttatacctgtaatcccagcactctgggacatttaggtgggaggactgcttgaggccagaagttcggccagcctgggtaacatagcaaaactgtgtctttacaaaaaatacaaaaattagccaggcatggtggtgcacctgtagtcccagctacttgggagggtgaggcaggaggattgctggagcccaggaggtcgaggctgcagtgagccaagatagcaccactgcactccatcctgggcaagagaccaagactctgtctaaatatataaataaaatggtaactggaaatctgatggtgtttaagcaaaaactgaaggcccacaataaataaaaagggaaaattttaactaaaaaccttgctgaagctgactggatatcacttcttccatacctgagttcctttgagaccaggaggtccaggaggtcctctatttccaaggagtccctataaaagcaatataaatgcacacaatagaaattttagatcaactgacattttgataaatcagcattaatgtggagatggacaatactctttgaaaccattcatttcccattaagaagtcctcaaaatgggttgcagtatgggcaaacagaaaactactgggcatctaaaaatataggataaacttatttttaaacagtaagttaatattcaaataatctgctcagtattttattcttcaacctccagacaccttttcagaaaaagtatttctaaaacggaagcaatgggtccaaatgttaaactgataagagtacagtaaaccgaatagagtgttcacaaagtctgaaaacagatggaggaaacaaacagtgttttaatatctattaagagatctgcagagtctggaactcagtattcgttagctgaagaatgcattagttcttcattactcattagttgaagaatattcttcaacttatttccctttttgatacaagatgataaaaagagaagaggaatttgcagaagaaagtgagtgtgaatttgaatagaaatttcaatactaaaaaagtattttgttaaacaaaatacatgttgttaaaaatcgattgctctctgaatgaaaactctttcaaagttaattatttttaaaaagtcttaaatcagaaaacactatacaacatctattcaacatggcaacattttcttaataagttctgttctcctaattattcaagatgccagcaaagttctaagtctctttttagaattatagtttgaatgattgcttttagtcattttataaccattaagaagttttatctaatttttaactgtactgacataatttttaaataactataccaaagagcaaatctactcaggtcacttttatcttgttctgaaatgcaacagagtgacaaactacatgggaatctttccttcatgttatattttgctctatactttctatactttaacacaataaaaaaaaactctgtcagtttaaaagtctataatatagtattgtaagcttattacataaacagcaccattcaagaaactgtattactttagacaataacctaactttttaatgaagctttcttatttttaaaagtaagatatggattagattatggaaatgggcacattgtgtcttatgccagtccaatgtatgttaatcctttttcaggcaaaagcaccctaattttccttaaggaaaaactctcttcacttttagtgcacgttgtttgaggggaggtgactccaccttcgactgtaactgtgaacatgtgacagacatctaagtcagtcagtatattgtgcatccccagaaaaaatgactggtccaggaatgagtaagggacccaattcagcccaactgaagcacgtttcaaacttcagtggcactgctgggaatagcattaagaatgaggtaaaactgaacagtgggaaaccatccaggggacagcctgagaatgaaatcaatgaattaccaaatggagagagttggagtgactgggctcttctgaaattgtttagagtcctgaattcagttgtgattgaatccctgaagttttcatatatttatgtaagcctgtttaagctgggtttccaccacttactgaaataatcctgattgatacaatgatttagaactgccttcaatatctgaaactgctctttcagaattcaaagtgaaagattttaagtgtctacactgactggaggtacagaattagaatgttgtgatatttgcattctaccacctgtcagctagtgtttaatcacttaattcatctgtttgttcatttttcatctgaaattttattaattttctactatgtataaggctcaattaacagcacaatattaggccctaagtatataattatcagtaagacagagtccctgttcccaatgaattcataatttattatggcagatggtccattaaaataaaaattattacattaagagttgtaacagaagtagaggtatatgcaaagtataaataagaatttagaaaaaggagcaaaatcctttctgggaggattagcatatttttaatatgtgaaaataattttgtattgagttatgataggctaataaaaacttgtagataaaaataagcatacaataaaaaattataaacaacttctgttctggggctcaaaaggctctaagaacatacaatattaagataagggtgtgcatgaaagaaacaggctcagctccatagccagagtgtaacctgcagacggctgaccggttaaagggaatgaggtccccctaactctctcattgaagctatttactcgagatggaaccacttatccagaaccagaaataatcctttcggtgaagcaggcaaatctaggctactttttctctcttctttcaaaaccaaaattataatcttaaaggaaaaataaaagttgggttaagagaaaaaaaatctagttatatgccatttataagaaacacacctaaaatataaaatatgcaaggcatttaccagcccaaaagagctgatgtaattacattattattagatctagcagacttgaaggtaaactacattgtttaagtgtgtaactaaatagtgattaaaggttatattcatcaagaagatataaaaaccatcattttttgtgtatctaataacatgaattccaagtataaaaagtgaaaattgatgaatatgtaaatagagttgggcaaatccactattagagagggaaattttaagacatttttctccagaagtcaagcagatagagaccacaagaacagagaaaacttaaacactaatattaacaaacttgatctagtggtcatctatagaatactgaatcctcaaatgggaatttacatagtttacaggcgcacctggagtatttgtgcaaaccaaccacaagaaaggccatatgtgtttatcagcagtagtatcaattaaaaaattatagcacatctatatagtgggttatactataaaatgtaaattaagaatgaacctataattacatgtatcaacctggattaagatgaaaagacaaaattgaatggaagaagaaagtcactgaagaatatgcatagtagaattccatttacatgaatttacaaaacacgcaaagtaccagatattgtaggagtatatttatagatggtaaaagcatggcaaaaacaaaagaacatttacctctaaatgcagagagggaggaggtagacacaattagagagagacacacaaggggcttccaatgttctatttaatatccttaatagggtttgttttatcatcattgtttaagctgtgcacatatgtttcatatttatcatatgttaaacacaaactttaaaaaagttaaaatgtgcagaactggaagtagagtgcagatttgaaatccagttctgcactttactagagatgtaaactatttcttaatctatagaatcatgttaccatcagcatcataaggttgctgtaggaataaataaaatgatacatagaatataacaggaacttaataaatatcagtttcctttctccttttatatcagacattaattagtagacatttctcaaagggagacatacaagtggccaataaataaatgagaaaatgttcaacattgctagtcatcagggaaatgcaaatcaaaaccagaataagatatcatctcattagaatgatcattattaaaaagacagaaaataacaaatgctggtgagaacacagagaaagggtgatttattggtgggaatgtaaatcaatacagctaatatgaaaaaagtatggagtttcctcaaaaaaataaaaatagaactaccatatgatttagcaatcccactactgagtatatataccaaagaaagaaaatcagtatatcagagagataatctgcattctcaagtttattgcagtgttactcacaatagccaaaatacagaatcaacataagtatccaccaacagatgactggataaagaaaatgtagtatattatacacaatggaatattattccaccataagaagaatgaaatcctatatttgccacaacaaggctagaatgggaggatattatattaagtgaaataagccagacacagaaagacaaatgttgcatgttccaactcatatgtggaagctaaaaaaaaattgatctcatggagatagagaataaattgaatggtggttagcagaggttgggaatggtagtagggaaggggcttccacttggacagaacagtgtatggagactcacatcatggacttttgctccaagaaccactacagtaaagtaccaggaaaacttaaggatttcatagatcctctgacagaaatggcatgctgctacaaattctgcaagacagcaaaaaaactgtgagttcccaaagtgtgtgagggggaacacctgcctccagacacacatccccactggggaccctgaaaacccagattacaggagaaggatttaaccttacctagagctgaaactgatttagcgtgaaacataaaagtagaagcagcagcaggaagagcattgtaggcactcccattctccagctcaagccaagggaagccatccttgactatatctcactagggccctcagggaaggcagccggcagaatctgggaggggtcacaggctgaaaaaagattccaactgaactttgtaataattttgactgaatgcaaactctctagagcagaatctgagggtgaaacggaactgttgcagagagtagcacaggagccaaggccaacagtatttgaaggcagggaggggcgaggcctgaaagccttgcttgctttctcagcagggaagcttatagcctggggcaaggtctgaatgctgagcacaggctacctggagacaaactcagtgctgttagtagggcacattgtcaggggcaaaaccgacctctacatgggagctgggtaagacctaatgctaccggctttcccctacttctctgatgacagagggtattatggaacaaaatgccctctggaacataaccccattggcccaagaaccacaccccctcccccacaggagtgtggcaagccctgcccaaggagagagtctgagctcagactggcgtaaccctgctcccacctgatggtacttctctacccgcctagtagccaatcacaaaagacataaactcttgggagctttatggccttgcccatcacctgagaaacccaaatacttattctggccaacttagggcaagcttatatcccccttccactactgcagctggtgctctcttgaaagcaatacctcctggctggaggccaaccaactcaggatattatggcaactcatgacaaaataacctgacaaaataaccctactccaaggaagtactcaaaaataactcatgacaaaataaccctactccaaggaaggagaaaacaacagctaattccactgactgcaacaccctggctaaccagaggtcctgagtctgttcactgctagcataaccagcatttgagaaagccagcacgtgaaacgtatctacaaccaaggactcttacagtctacttcactcccctgccacctccaccagagcaagtgctggtatcgacagctgagagacctgaaaatggattacatcacaggacactttgcagacaatctccagcaccagcctggagcctggtagccctgctgggtggccagacccagaagagcaataacaatcactgcagtccagctctcaggaagccccattcctagaagaagggggagagcaccacatcaagggatcaccccatgggacaaattaatctgaacagcagcccttaagttccaaatctttccactgaaacagtctatccaaatgagaaggaaccagaaaagtaattctggtaatatgacaaaataaggttctattacaccccaaagaccacactggctccccagcagtggatccaaaccaagaaatctctgaattgccagataaagaattcagaatattgattattaagctactcaaggagataccagtgaaaggtgaaaaccaacttaaagaaatttaaaaaaacaaacaatacaggctatagatgaaaaattctccagagaaacagatatcataaaaatataatcacaacttctggatatgaaagacaaactcagagaaatacaaaatgcactggaaagtgtcaataatagactaggacaggtagaagaaagaacttcagagctcaaagacaaagcttcctaattaactcaatcagacaaagacaaagaaaaaagaacaagaacaacaaaaaaagaagaaagcctccacaaattttaggatggtgttaaatggccaaacctaagaataattggtgttcctgaggcagaagagaaatctaaaactttggaaaacttattttaggaaataatcgaagaaaacctccgtggccttgctagagatagagacatccaaatataagaagatcaaagaacagctgggaaattcatcacaaaaagatcaccacctaggcacacagtcatcaggttctccaaagtcaagatgaaggaaagaatcatacgagctgtgaggcaaaagcatcaggtagcctataaaggaaaacatatcagatttacagcagattcctcagcagaaaccctacaagccagaagggattggggtcctatttttagcttcctcaaacaaaataattaccaatcaagaattctgtatccagcaaaattaagcttcataaacaaaggagaggtaaagtcgttttcagacaaacgtgtgaagagcattcaccactaccaagtcagcactacaagaactgctaaaatgagttctaaagcttgaaacaagccttaaaatacaccaaaatagaacctccttaaagcataaatctcacaggcctataaaacaacaacacacacacacaaaacccacaagatattcaggcaacaactaacacgatgaataaaatggtacctcacatctcaatattaacgttgaatgtaaatagcctaaatgctccacttatggcagaatgaaaaaaaaatccatcaattaagtatctgctgtcttcaagaggctcacctaacacataaggactcaaataaacctaaggtaaaagggtggaaaaaggtatttcatgcaaatggaaaccaaaagcaagcaggacctcaataacagttaaaaaaaagacaaagagggatattatataatgataaaaggatcagtccaacatgaaaatgtcacaatcctcaatatatatgcacctaacactggagcttccaaattgataaaacaattattactagacctaagaaatgagacagatggtgacacgataatagtgggggatgttgatactctactgacagcactaggcaggtcgtcaagacagaaagtcaacaaagaaagtgaacttcatctatgccctagaacaaatgaacttaaaagatgtttacagaacattctacccaacaactgcagaatagacattcttttcatcagagtatagaacattctccaagatagatcacatgagagactgcaaaacaagtctcaataaatttaagaaaatagaaattatatcaagtaccctctcagaccacagtggaataaaactggaaattaactccaaaaggaaccctcaaaaccatacaaacacatgaaaattaaatcatctgctcctgaatgatctctgggtcaacaatgaaatcaagatggaaattaaaaaattatttgaactgaacgataatagtgacacaacctatgaaaaccactgggatacggcaaaagcagtagcaagaggaaagttcatagtattaaatgcctatatcaaaaagtctgaaagagcacaaatagacaatttaaggtcacacctcaaggaagtagagaaacaagaacaaataaaacccaaacccagcagaatataaaataaataataaagatcagagcagaactaaattaaattgaaacaaaaaatacaaagataaatgaaacaaaaagctggttctttgaaggataaataaaattgataggcaattactgagattaacaaagaaaagtagagagaagatccaaataagttcaatagaaacgaaatgggagatattacaactgatactacagaaatacaaaagatcattcagcctactatgaacacctttacgcacacaaactagaaaacttagaggagatgtataaatttctggaagtatacaaccctcctagattaaaccaggaagaaacagaaactctgaacagattaataacaaacagaaagatagaaatgatcatttaaaaactgccaaaaaaaaaaaaagtccaggaccagagagattcacagctgaattctatcagacattcaaagaagaattggtaccaatcctattgacactattccaaaagacagagaaagaggggatcctccctaaatcattccataaagccagtatcaccttaataccaaaaccaggaaaggacataacaaaaaagagaaactacagaacaatatccctgatgaatatagatgcaaaaatcctcaacaaaatactagctaaccaaatctaacagcttatcaaaaagataatacacaatgatcaagtgggtttcataccagaaatgcagggatggtttaacatatgcaagtcaataaatgtgatacatcacataaacatcattaaaaacaaaaatcatatgatcatttcaatagttgcagaaaaagcatttgagaaaattcagcatcattttatgattaaaaccctcagcaaaactggcatagaagaaacatacctcaaggtaataaaagccatctatgacaaacccacagtgaacattatggtgaatggggaaaagttaaaagcattcctgctgagaattggaacaagacaaggatgccgactttcaccactgctattcaacattgtactggtagtcctagccagagcaatcagacaagagaaagaaataaagaatcggtaaagaggaagtcaaaccattgctgtttgctgatgatatgattgtatacctataaaaccctaaagtctcatccgaaaaactcctagctctgataaatagattcagtaaagtttcaggatacaaaatcaatggagacaaatcattagcactgctatacaccaacaacgagcaagctgagaataaaaatcaagaactcaaccccttttacaatagctacaaaaataaaaaataaaatacttagaagtatacctaaccaaggcgggtgcggtggctcatgcctgtaatcccagcactttgggaggccaaggcaggcggatcacaagaccaggagatcgagaccatcctggctaacaaggtgaaaccccgtctctactaaaaatacaaaaaaattagccaggcatggtggtgggcacctgtagtcccagctacttgagaggctaaggcaggagaatggcatgaacccagaaggcggagcttgcagtgagccaagatcacgccactgcactccagcctgggtgacagagtgagattccgagactccgtctcaaaaaaaaaagaaatatacctaaccaagaaggtaaaagacctctacaagaaaaactacaaaacactgctgaaagaaatcatagatgacataagcaaatggaaacatatcccatgctcatgaatgggcagaataaatattgtgaaaatgaccatactgccaaaagcaatctacaaattcaatgcaattctcatcaaaataccatcatcattcttcatggaactagaaaacacaatactaaaattcctttggaaccaaaaaagaccctgaatagccaaagcaacactaagcaaaaagaacaaatctggagcatcgcattacctgactccaaactaggctatagttaccaaaacagcatggtactggtataaaattaggcatgtagaccaatgggccagacaagagaacccagaaataaagccaaatatttacagctaactaatcttcaacaaagcaaacaaaaacataaagtggggaaagaaaggacaccctattcaacaaatgatgctgggataactgcaagccacatgtgaaagaataaagctggatcctcatttctcatcttacacaaaaaatcaccttaagatggatcaaagacttgaacctaagacctgaaaccataatattctagaagataacactggaaaaaaatcttctagacacaggcttaggcaaggaagtcatgaccaagaacccaaaagcaaatgcaacaaaaagaaaaataaatagatgggacttaattaaactaaaaagcttctgcacagttagagaaaaaaacaacagagtgaaaagtcaacctacgtaatggaaagcaatattttcaaatcatgtatctgatatggggttaatattcaaaatctgtaaaacactcctataactcaatagcaaacaccaaattactgggctaaaaattggagaaaggactttggagtattcatcaaagcaactgaaaacaggatctcgcaggagtgcaagtatcctgtttacatcaatgttaacaggataaaaactggatatttatatcttgttgatataaacaggatatttgcactgctaggttcattgcagctttattcacaatagccaagaggtgtcaacaacccaaatgttcattgacagatgaatgagtaaagaaaatgtggtatatacaaacaatggaatattattcagccataaaaagaaggaaatcctgtcatgttaccagatggatgaaccttgatgacattatgtgaaataagtcaaataagccagtcataaaagaacaaatgcataattccatctataggcggtatgtaaagtagctaaactcatagaagcaaaaaataggatgctaattgccaggggctgtggggaggagggcaatgagaagctgctgttcaataaatatagaatttcagtcatgtaaaatgagaaatgtctacagatctgttgtacaacagtgtgcacacattttgttacaatactgtaaacaaatcagtaaaacaaatttactaagggggtgtatttcatgttatatgcttgttcttatttaaaccctttaattttctatttaagatctgtcacaatctgctttctacctttttttttttaagtcaggtaggtttacttctgctctccattccagtgttcattttgtatctctcatccctcggctccacttggcctgatccaaccaatctgactaaaatcccaacttctctattttctcagaaaaatgatcatacagattatcctctcctctgaactccctcctactcacttatcatatgttgcccagttattgtgctttttaccttttcacttatgaagggctcatgtttccagagaattacaagttcctaacaaaaagaagaccatgttttaattttgtttttgagtcactgcttaaacacagtacccttcccattgtacaaactcaataaatatttcttagctgactaaatgttacctggagaataaatgtcttatacaagaaatctgtgtataaaatcctgttatagtatatagaatgtaaatcttcaggactgggtcaaagtaatcttagaaaactgtgtagagttatacatcttcctcttaccaagttagcttacctctctacagataaatacatgacatactgtaataattcagtgcaagaactatttccatatattacacaacataatcccacaaatagtaagctttctataaaaacttatcaggtctgctatgcaaaagacaataacagcctcttttagcatccctaattccatagccaaagtaaaaacacaaacctttatagcaacaaataaattattcctctgtttactggagaatagagaatatttatttgctactcttaccttctgcagtaagcagcaaaagatctggttttgctaatgttacgggattcttgaaagcggattcccaaactgtgtagttctcaaaaaggcttactgatgtatgttttgtatcttaatacaaatatacacacacatacaaatccacaatcagtagaactataattaacacaagtttccattcctactttgaggtttttagtgaactggcagaaaatgaacagaaaataaaagccttctttattgctgtgccaaattgctctggaaagaacccaaattgtttgcaaatagggtaaccatgtatttcaaatacagtgcacatgattttctcgatgaccacattgtatagcctcaacagagctttagcagtttttatcattcccatttgccaaacaagacatgtatataaaaatgaaagaagtttcaagatgcttgcttctatgatacagtacacccagctaaagaaacacatcatgttaacagggtcagtatgtttggctgtttttcccctctgtttctagaaacaatttcaacaaaaatgagaaggaccaagaagatagacaaaaccagatccttctcaatctacagaacagaaaattattattttcttgttcttttgataaaatcatcccaggatattcttttaaaattcagtgatgtgtataacatcaattagtctcatgatgttggtactaatgactctacatactcatgtttattaaataaacttagataatggttgaatttccagtgggtagtaagtactaacattgttgttcattaaaatgtctagctttcaagtcttttgccccagttttgacattctaatttcaagactaaaagaattagtgagaagaaagttctaaagatcactgtcataaaagaaaattaaataggtcagttggctttcttcagttctctgacacttaaacttcaagagaaacaaaattcccaaactgaagagaactttgaaagttctctggttcttcacctagtatgatatgcacacttaaaaacattaagttctattattacttccacctgaagtacatatttctcaattacccaggagagaatctattgctcaattatctaggctctcagagcacttcaccaactcttttatatagaacttcttatatttcttaattatgattattttttatctctcccactaaattgtaaccttatctggaggagggatgagagtttagaaatctttataatcccacatttattacttggtctaacacagaagaagctcaacaaaggttgaataaataagttattgaatgaatggataaataaatgtatttatataatgtataaagttcaagttcctatgtatgcaccaggtgaagggctaaagttggcaggaaaaatccgcaactccattctctacactatttgtctctctcaacttccttcatacttctatttctgcttttcaacctggtttaccgcgaactattaattatttctacctctagatgtcaaacggtacctcaaactaaatataaccagaatcaaatttcttatcatccccatcctccaaaactgctcctcttcctgagttgcctatttaagttcaatgacatcagcaacccaagtcaaaggctgctttatctttgacttctctttcttccatcaccttctgttaatcagttaccaagttgttttgtttttatttccaaaacactttttaaatggtcattcaattaatcatccattcaaccactattcactgagttatttatatgtgctatccatattatagttattatgatgtatataaaatcaattaatctttctcaaaaagattacagtctaatagacacataagcacatcagaagttataatacataaagataagtgcttgataggttttttttcaggaatataggaaaagaatattccaattagatttgggaggaacagaaaaagcttcctggacatgttgcatgtgatgtgtaggtattagctagatgcagaagggcataggaacatatatatccagacaaaaaatatggcatgtaagaagctgtgagatttgagtaagtatggcatggtttggcactctaaatagtttggctgaagtgatgcttttggaagagtgatggtggatatgactgtataactacagaattatacagagagggtttggtcataaagaacgttgtataaaaagttaaaaagtacaagccttaacatggaagttgtggaggtcactgaaggatttaagcaaaagagtgacatgatgagatctatactttaaaagattattccatctgcagctggaaggtagataggaagaaatgccagattggaggcaggaagaacaactactgaaggacaattacactatcctggtgaaaaataaagggtgcctaactacaagattggcactgagaatgattttaagggtaaaggggaaatttctatcaaaggagagattgggataaaggtgataattgatggcatgaggtcattgaagagtcaggggaggatttgatgcaaaacatatgcagaacttgaagaggtgaatgaatgcttctgtggagacagaaaggaagtgggaaagatccctgcatataggtataagtttgtaggtggcaggtggggttgcctgataaactacaggatgctcaattaaatgtgaaattcagataaacaacaaataacttctattataaatattttccaaatattgcacctccaccttttcacaagtttctttttcctgaataccatacatccccttgtctgcttcacaaattcctactcattcatgtaggttcaagtgctatcttccctgcaaaacataatttgacttccctgaccctgtgctctcacagtattgctgattatatattattcattatgattattattaaggttttcctgaatatctttctctagattttaagtttcttgaaaacagggatcaggactcttttttttcttgaaagtagggatctctgtagccttatggtctagcacaatggctgccatgagaggcagccaatatctgctgaatgaatgtcctgtttccaatctttattatttattgcctagttttcctgtcttcaatttctcccctctttaaaccatcctccaaactgacataagaggtatctttttaaaatataaccattgaagatactttactactcaaatatctttgattacttcaagatgcccgtctgatgaagcagaaactcttcagcatggtattgaatgctctacgtaatttactatcaaagctaagggtattagagctcagactttgaaatcatatctgtgttagaattctggctatatagcttaaagttatgtgacttcaagtgaataacttaatcatctgtaaaatgggaataactacctcataatgctgttgtgaaaattaaatgagataatgactataaacgagataatgtctatgaagcatttactagagtactgtgctgctcaatattaagaacactaacaaatatagctataatcaagatcctttccagcttcatctcctatcatttcatctctctctactcccattgatacctccatagcagctacatttcataacttgccaattctcccaacttcaggctatttcatccttacatgtgaattcataatgctttatttgcttacagtgcccattctacatcagcttgcatggcaaatcttggtaattaaaattttgctagggatatttcctagtatacatacaaaccagtaagtttgtatatataccatagtgttaaataaaatctgtgctgggaaaaggcctagaacgttgctttaaaatggttagattaaaagcattgccgaaataataaattagtatgtgagtcatcatgatgagtttcaataacggtaataagctaataattgtggtttcacttgtaagttaaaaatgcttgggtttcttcaggtcttttgtgctatgtagaggttcatggacaccacaggctttcttttatttcaatcaatggatatcttatgtccccaaaagatttttttagtggtcagggaattctcatccatttacttattttcagccttttatacgctatgactttttagagttttttctcctcatctcttccaaaaaaatccttctgggtgattttgcaaatattgtcacccttaatctcagttcatatcaaactagaaaaatcatttgcaactatctgaaacctaaagtttattaaatgtacctgagacagcttaaaaatatccagaaatgttctgatattcctaaaatatttttcccatttattgagaatcaggagctctagataaccataattgtttagtctctctcttcttcttcttcttacctttggtccttcagggccgttttgtccaggaatcccaatatctcctggaaaaccctagggaatataaaaatgtagcgtttattccatagaaaattactttaaatccatttagcatataaaattccctttgctattcctccatatccagttaaagcaatttataatcctcaaaaattcaatattgaagattaagttaggcagttgtttaacactggaatataaaacttacaaagtgtactaaaatagaatttactccatcagtgattcacaaacaatcctgaggtcctctagttcagtttaagagagtagaagtctcagtccaaaattatccacaatgtggaaataaggcaaaaaggtgtatgacatgttctttcaacatcatatgggatatagggctaccaaagattaggtgaatgtactttgttggactcactatttactaactacatgttaacttatagatttttgttaggcagagatgcaaacaacttctgtctgataaaaaaaaaaaacagcacccaaaattatggcttaatatacaggattaatcagttttgtatctaacccaactatcttattctaacatccccatatttaattgtctataaatacttaagtcctcaaaggctctatgaaccattatcttacaagttccatcattaattaataaattgaataaaatctttgacctgtgtttactttaaatttgcatgagaatcatgattttacttttttggaaattatattagcagtctaaaatacttggctcaagaaatgaaaaagaaatagaaatggatcacagtgttaaatacaatctatgctgggaaaaggcctagaatgttgctttaaaagtatcagattaaaactcttgctgaaataattagagtgtgattcatcaaattatgattcaataattgtaataagctagtaattgtggtttcattttattgattttgtcatagattattttccattgacattagtgaaggaaaaaagtaaaagaagtataagaatcagcatctttaaaagtaaagaaggctgaaattaaaacgtgaacatccacaagaaaaggtagttcagtgaagggataagttgtaatgggaataaaaaatatgaagtaagatggaacagcaaagttgtttctgggatattcattctggaaagaaaaacaaataataagaaaatgataccaacgtatccagtctggattaggacacgaatgcctcgactcagatttaaagcttggattctgtgaggaaaaatataatttggggacatttctggcaaaagaaaaagcagtggcaacagaaagatgatcacaagatcagatttctgaatgttctggaatagtttaatacagatatgtttaatacaaacttgttgattgctttactaatcaaagaaaatcaggctcacctatgctattatttgtatatatggcaatttttaaaaaactagattcttttcctgataattttacaccctttctctagaacacaccttttgttagtatgtttttttgtgggggggatttcttgtggacttgaatcaagacacttctagctcctgctgtaacactagctagtctaaaattgaacttactaccttctccattatgttcctccctcatcctctgttcactatttgagtgaatgtcaccttgaggtaatccaccagtttccaagccaaaaatctgtataacagatttttcatatgctttgaatactttcatatttttgatatactctgaatacttatttttccctccccaccaccaccacgaccatcttccaatcatttactaagccccatccattacatctcctaattcactgtcagtctgaaccacttttctacaaacctccctccacaaccctagggcaagtcactttctctattttcctattgcttattcatgttcctatcccctgtaaaattcattttcactccgtagccagactgatcattctatggaatctgagcatgccactttgttactggcctcagaatagaatccaaattctttaatacacagtttacagggtctttcgtgatttggtggtctctatttatctctcttctttactctctaccacccagcacttcagtcactgaacaattttcatactctgataatatatactctctttcaattctgggcttttgcatatactgtttccctcaccttgaataatgttcccttaagtttcctcacctagaacacttatgttttaactagacgactgaataacattttacttgcaaacttttctttgacctccataccttgaattaggttgcttctaagaactctcacaccatcctggggtcctataaggtcccttaatgtagtgttttggcttgttttgttttcctaatcagattgtaaactctttgagtgcagttttatgttattcacttccatattctctgcaactagtacaatgcctgatacacagtaagtgcttaaaaaatgctttgtcgttgttgtagttgctgctgttgaatgactggtttgttttttcttttcttttcttttttttttgaaagaaagtacatgtttcgtggcttgttgtagcccctcagtactggctttcagccaatttagagcatttactcatagcatctgcatggataaatcaataaatcctgtccatcctccagataagcctggaacacactatcacagcagtctccaacctttttggcaccagtttcatggaagacaatttttccataagattgcggcatggaggatagtttcgggatgaaactgttctgcttcagatcatcaggcattagactctcataaggagcatgcaacctagatccctcacacgtgcagttcacaacagggttcgtgctcctatgagactctaatgctgccgctgatctgacaggaggtgaagctcaggcagtaatgcttgctcacctgccactcacttcctgctgtgcagcccagttcctaacaggtcacaaaccagtacaggtccacagcccaggtgttaggggcccctgcagtatcatgccagaaaacaagaaagctttcgaaggtatcaaaagtagagtcatattaaaaacgcttagtaggtgcttgaagaggatcccctcggccagatatgggacaatatgaacttcaacaaggataagaactacaatggattgaaacacatcaaatatgtttaagttcataagttcataatgatacaacaacaaaaactgtccacgttcaaaggatgaaaggaggctcactcattatcttgaaacatggtaaacaaaggtgaagaatcaagaatttgttctgccttagtgtaccactagtaaccaaacagtagatgaagggatgtattccagccagtaagtgaaaaagaaagaagaggattaaaaaaatctccattttgcaatgatacaaataatctaattgatctaggcactgagcatcaactattactaacatcacacacacaaaaagagatcaccagacattatgtgcttcctgataaaagaacagaataccactgattgtcttgccaaaaacaaacctgaatatggtaaggtctctatatgtgactaccaatttgcaggaaacacacaggaccaagaaacaggcagaactacaccatgagactataatcagcaaaatccagactgtgggaaactacagatcaaatgattggggagcttcaacaactaaattttaagggggaaaacagggaatagagagagaacttgtagagtgaaagacataggaaataaaacaaataagcctaaattatagtttttaaagatgcacacttgtgtgataaactatgttttaaaaaggaggaactgcttacttttgggaggagagctgggcttgtggtttcatggggcacataatggcttctggtggtaactgtcagttttagtcttgacctgtgtggtagttacaagagtctgtcttataattgtttgtgatatacatttgttttgtatagttttatgtgtctatgttttactttacaataaaacggtaagaaaaaatttgctggggtgacttctgggtaaacatgcaacactgaatatacgtgtgaatctctgctccttaaaacgtcattaaagtatcagtggagaaatattaaaaagacaaagtggtaaggtcaaggataatagaagaaaaagatgtcaacacagctgatctcatagtatagtcatacaagctgaatattttaaaattgaaactttattgaaaagctaacaaatatataagcacaagtttattttttattttttatttttattggcttgtatttatttatttattttattattttattattttttattatactttaagttttagagtacatgtgcacaatgtgcaggtttgttacatatgttacatatgtaacaacatgtgccatgttggtgtgctgcacccattaactcttcatttaacactaggtatatctcctaatgctatccctctccactccccccaccccacaacaggccccagtgtgtgatgttccccttcctgtgtccatgtgttctcattgttcaattcccacctatgagtgagaacatgcggtgtttggtttttcgtccttgcgatagtttgctgagaatgatggtttccagcttcatccatgtccctacaaaggacatgaactcatcattttttatggctgcatagtattccatggtgtatatgataagcacaagttattaaaaggaggagaaagatctctatttccttcccacataggagagcttagaaccctggccaaagaaacttttcattattttaaaaattcatacctagattactaccaagtagagaccttgccttttaaataatacatttcaatatgttaaaaccagagttaactgtatcaactgaacattaatgataacgtacctataaaggaaaccttttttttaaacacactcaaaatgtacatcaaataacatggacatctttgccaagtagcaaaatttcagaaagcttacagattgaaaaataaaaagtacgtcattagagtccatacttttcatttctaaaaactacattagcatgaaacgatacaggaagaaaagtaaaaacaaaaatctgataaagatgctctaattcatttttataaatttaaaataatttagaaaacattaataagtccaaacattttctctcacaatgtgttttaccacctcagttaagtcatcctatcagaatttaaaatataataccttagtgaaggaaagaaacagcagtctggcttctggtgtcttcttaatagaactagtctgaccaccaatttttaccaagaagcagaaaaaagaagtagttttaaaaatagtatgtgaaaatatgtcttctgttttcagacccttcacatctgtttgccgtactgagaagagtgactcagcattctctccagtaaaaacaaagttttattattctataatcactagaggctggagactaattcacatgcattttttttttaaagcaaaacctgggaaccgaagcactagcagattccattagtttcctgggaaatcataaaagtaaaatattatcattcttatttggcagtagccagaagcttggaagctagagtgtcctaacagaatacattatattatgcgctacatacattgagcactttaatagttttccaatagaagtgttagagtatctgttttctattgaaatatatagtccctcaagttaaaaaatggtaagtggataaacttatacacatatacacaaactaattacaatatatccataaaacgaacagcctagatgtggcaacctagacgaatctcaaatgtcttatgctaagtgaaagaagccagacaaaaaaaaaagagtacatactatgtgagtcagtttatataaagactttagaaaattccaattaatctcgagtgacaaagagcagatcagaagtagcatggaaagggagaagacaagaggaacagaaataaagtattatataaaaagtgaacaagtaaattactgggtttgacagatatgttcattatcttgatcttggtgatggtttcacaggttatacatatgtcaaaaattatcaaattgtaaaatttaaatataggcagcttattatatgtcaattatacctcaatgagcctgtaaaaagaaaggtatttagtattgggtattttagataaccatatgctttatggtaggcaacattttttaaggatttaaagatctttagagagaatatataatatattagttgaactagttttcagataaaatcagtgttgctcagattttggcttgttttagaggtaatagcatgttaaattataataacagctttaaaacaaattacatattttggaaaattgaaacttttctgatattttgcaaggtagctttaagatgtcctgttgttatagataagagtgacacttgggccatttaactcccatggaaaatttcaattattgatttaatatccactgtgctttaaatatacaagaacacagcatagtttggcttaaatgtatcttctgagtagtttataagtctgaacaaagtagagatgaatatagcccttggaaaaacaatcattaaaaaaagctaaaagataaaattaataaaggcaacatgtaaattatgaattcttgagggcaaagttatgcaaagccttggctggtgttgtgtatatatagtattattgaatatatagtttatattcaataaacattcaatggcctgaattgatgaccaaattaaaaataaatcctatttgaataataactttttcaattaggcagtttcaaagttatcctgaaaaaaaaaaaaaaactagcctagcttctacagacaggactgaaattttacatattcaaacgagtaagaatgtatgcagagggagagaggttttgtaagaggataatttggtctgagacaaggatgcaggttacactcacaagattttgttttctaacatttatggaagcacatgtcatgtcagtaatatgatgagtccaggtaggaaagtaataataaaaaagaaaaacattaaaatagcctttactgagtgagaataacctatccaaaagttaatgccaaaaaaatttcaaaaggcaaatgtaataaattcactttcccagtaatctatagaaactaaactttagcacagggaagcatgcaaactgcaaatgaaggaaatattctgtcttctgaggaaaccacaaacagaaaatacagtttcttgaaaatgcaaaataatccatctaggtatctgcctctccttcattttcttttgctgttttagatctaaaagccatcaaaaccaggtattttccatcatgatactgctgagaaatttagtgactactgctattcatatattttcccttctgtaattctatgtatttgagcagaaaatatagcacagctcaattccatatgtgcagcatcctgaaaactcaacagagaaaatccacaaaactacaaagacaataaaattccttatgacaaaacatatattctgtgttccaaataagacttttgtttagatagtatttacagtattttttttaaaaaagattgattcttgctctgtcaatcaagctggagtacagtggcatgatcacaggtgtgtgccaccacgttcagctaattaaaaaaatttttttttttttagagatgtggtctcgttttgttgcccaggctggtcttgaacttctggcctcaagtgatactcttgcttcagactcccaagtagctaagattagagatacaagcgatctgtgcccagatattcacagtgtttttaacatcacttttaagggaaactacaaagttagctggaaagtctacttttagtcttctaaagtccacataaaattatagttaagttataattcaaaaataaactattctggccattatttgatatttaggtttggataatccatagtgacaaaaagcagatccccccatggtaccctgaggagggaggggggaaggagaggcagaaaagaaggattacaaatgtaaacaagaaaatttgggggtttgatgggtgtgttcactatcctgattttgttcattgatatggtttgggtctgtgtccctatgttggaggtggggcctggtgggaggtgactgaatcatgggggcagatttcaccctcagtgctgctctcatgatactgagtgcttgcaagatttggttgtttagaagtgtgtggcacctctcccttctctcttcctcctgctccggccacgtaagatgtttctgcttaccctttgccttctaccatggttgttaagtttcctggggcctccccaaccatgcttcctgtacagcctgcataactgtgagccaattaaacctcttttctttataaattactcagtctcaggtatttctttatagcagtgcgagaatggatgaatacagtgatggtttcacaatttatacatatgtcaaaagttatcaaattttaccacatataactttgttatatgttaactatacctctataaagctgcaacaaaaaaaggtaattggtattaggtgtttcagatgctcctttttggtaggcaacagttggtaataattcgaagatcttttgagagaaaatagaaattatttattgaacttgtccccagataaaatcagtggagctcagattttgaattgtttgaaggtaacagcataaccattatttactgcatatttttggctaagtataattataggtactcaatatctatatatctgtctcagaattcttataaatatcttaagaatatcaattcggctgagcacggtggctcacacctgtaatcctagcactttgggaggccgaggcgggtggatcacctgaggtcaggagtttgagaccagcctgaccaacatggcatggtggtgggttcctgaaatcccagctactagggaggctgaggcaggagaattgctagaaccctgggggcggaggttgcagtgagctgagatggcgccactgcactccagcctgggcgacagagggagactccatctcaaaaaacaaaacaaaacaaaacaaaaaacaaagaagaatataaattaacttagtcaagacaagacgtagttactatgtatcaggcactgttcttgcactgatcacatactagaaaacaaacaaaaagattccttggtttcatagaatgtatattctggagactgtttatctcagagattctctccctttcaatgtgtgtatgtttgcagcatggagtgggaagttaggtgattaaaaaagatttatattgttatgaggaactggcatgtctcaattacctacttttgttttagatacacagctatgggtctatggtcactctatgttgtttcacattctctctttcttcaaatgggatatcttgttttctttcatatatatatgtgtgtgtgtatatatatatatatgtgtgtgtgtgtgtatatatatatatatatatatatataccagttagtagaaatgtatacaggtacttaggcctcattgaaaataatgcatcttaccctgagaacttggccttagacatgtaagcaataattggccagtaccttggggtactttcctttggagaaaggagagtgcattttcagctgtgtaggtgcctgcactatgttaggcaaaggcacgtttaaaactgtataagtagcaagagggtataagtagatattgggcaataaagatgtgaaatgtagaggacatgtcttcaatctgctaaaaatctctttggggaaacattattccccatttctcagtccatgtactctcgtccccatcccagtttccaggggtgggaaaatgacctaaatcttgcaaattacagtattcctattccattgctattgcaattgattgaaagatgatcatgtgggccgggcgcagtgactcacacctgtaatcccagcactttgggaggccaacttgggtggatcacaaggtcaggagttcgagaccatcctggccaacatggtgaaacctcatctctactaaaaatacaaaaattagctgggtgcggtgacatgcgcctgtagtcccaactactcagaggctgaggcaggagaatcgcttgaacccagaggcggaggttgcagtgagccaagatcgcgccactgcactccagcctggctacagaaaaaaaaaaaaaaagatgattatgtggtcaaagcctgattggctggagtctcctaagaacttttgctagagatataaggaaaaaaagagtgctttctttttgcttagattgctaaatctgagggcaacagaagcctagagttgccaatgaccactttttctacagtgtgttcctgtgaatgtagccaacagagaaatgccaggataagatttacagagtgtcttggttatattcatcaagttcctgtacctagccaagtctctagacacatacactcctggacttcctgattttatttgccaattctgatttttttaacttaaaactgttcaaactgagtttctgtcacttgcaatggaaaaagacctgactaaaacattgaactatttgcagttttctacatacatctagcttcttcacacatctgtgcttttacaaatgctgtttcctctggctggaatgcccttgccctctgtttctacttgataaatccctactatttcttcaagtcactgctcaaacacccatgtactccatgcccctggttcttgcaccacgtaacttgttacccactcaaatgtaatatgatctatgaaaactttcacaatccaccttagtcagaatcagcactgattattttatatccatacacaactctgttaatatggctagttagcattattcatactatactgtaattaagggcatgtttctctattccaataaaatgtaagctcatgcaggaaaaggaatgtatctgacccatttttgtacctccaatatttaacttcacatgtcactgggagataattcttcattggtcccttgcatttccacacattctgcaaatgaggtattgactttgcattattccagtcactctcttcagagatttttgcattgcttcctgaagcaaagggcaggaaggaatgcgtactgtccaagataacgagataatatctctctggaatacattatcttttctgactgcccattataaaagatttaggctccttaaacttcagattcctcttatgtaatgcaacctaccgcatatgcaagtatcatctagccctcttcttgtcaccctgtgggaagtggggctcagtgaatcagtgcaaaaaagttgacactctggaaagtgcttttgccaagagtaataaactatcttttgtcattgttctaggagcttgtgtcttttaccagaatcattgaaactgtcaggctaaattgttggcttgcaaatggaataaaatctccgattctgacaattttggtgatgaagatgggatactgatagagacatagctttctggaggaggaagtattagggcctcacagatgattaacaggatttgagagaagcccatgggaaatggcaatgaatatgtaaaccaaatatatggtcaaccaggcaataaatggtcctccactttattgcctgtttagaggaggtactgggagagacagcttcaggccaagtacagggaaataagttcaaagggcagaaagacttcctcatcaatctggtgaacagtttcaggtttgcaacattgtaacaactagtactaagattccagctgggggcagtggctcacacctgtagtcccagcactttgggaggctgaggtgggcagataggcagatagcttgactagcctgggtaacacaatgaaaacccatctctacaaaaataaaaaataaaaaacttagctgagtgtggtagtgcatgcctgtggtccaagctatttgagacgttgaggtgggaggactgcttgagcctggaggctgcagctgcagtggccgtgatcacgccactctagcctgggtgggcaacagaacaagaccctgtctcactaaaataaaataaagtaaaataaaataaaataaaataaaaaagaaaagaaaagaaaaaaaagattcatcctgggtaggcagaagactctatctccttgtagataatagttacagagactcccatctacaatgagtataaaaggatgaacatttgtgaccagtatgagcaaaaaccaggcaaagaaatagaactttggttggttcacctgggagatgagaggggggtctcatagtttttcacaacacaagaattgcaacattagcccacattgcctaaccactgaatatgctgcctctgacatagcttgaaatataaggtcttatacaatttgatgccaacctacttttacagccttatttgtcactctgtgccaacacacaaaaaaactgtatcagctagccagtgtcacccactcctgtaaatccaccatgcattaacctaggtctctaggctctgcttatatggttcactgtgcttggaatgccctcctcttttcctgcaatttattaataaacaatctaattcaaggtccatcatttctgtaaacccttccatcttctctatgaacccttctctatcctttcattttatgttaatctatctctactaacactgaactataacaactccttaattctcacatgatgccttcaccattacctaacagtttacatatagatttcgttcttcccaactagactaaattttcctaaattattgataacattttattttttaatatatcttacagtgattactaggcacatatttgcacatagcagaaacctaatactttttttattgactgatttaatcacacgtgctctttcagcatgacttaagtgacaattaaaaacatgaaatttctcatccaaatccaagtcataaaagatatcaaagaagtaaattgtttaggcaaagggattccattacattctaatcaattaatacagctggccacagtctagcttattccagttaagtccactgaagtactaaaaatgaagtttaaaagcatgcttttacttgatatagccagatttttgaaactcacttcagtctttgtctctaatgaagaccaccctgacggaaaaagaggacccactgtttggccacttctggcactgctgtgattagtggtcttgattcatttttgtcataaacaattggctccatataccaagtacatcatccaaaattcaaatatttggcaatctctgtagcccagggggcttaatagctgaatcaacaaacattccaaccatcctgctaccatataagaaggtgctctgctgccagaactgagaggatacatgggattagtgctcaaaactgatatgactatgcttaaagaaatagaaatgattcctgtagagcattttccatatgtttttattaaaagcagacaaaaaccagtatggaaaaaataaatctatgtattaaggcaagtgatgttttatcttggaacacctctaatatttacaattccatgaaaagctaaatgcactgatcttttcacttcattgttacagcatatgcaagtatcatcactgtcacattgcctagaataagtaaaacattaagaagagaaaaaaatctttgaagtggtttgaagtcacatttgctcagctggtctttaatgatgaacagttctcttcaatgccaatggcaaatagcatttacaacaaaaacttcagagtactttgctttcaccaactcttatgaagatttgagtttcctaactagaagtcactagcaagaaatggtggccagtcctgtcctgcctttttagttgagtagatgaccatttgcatggtatggttaagttgagaggtatgaaagtttctagtcatccataagtttttccctgctcactaaatgacaccctaaattctttgattaatgacattttgcattagtttcaggtttctgttcattgctgaaatgtaaatatccttgaaagaggaatacattgcagttagctcataatcatttactgctgggactgaaatatatttatcaggtctttccatgaaaacaggctttgatgggaagggcaaattataggggaaaaaaaagagcacaccgattgtttgagatggaaaagaactcatgcccaagggaggaaatatatatacacacacacacaaaggagagactaagagcctcaggaaaaaaagttcttcaacaatttacaactttctctgaggactgcactgattctagactttcaagggatgacctgatttttaagttttaattttatcaaacctaatcaaacctgatgtctgggaaaaaagacagacagagacagtagaggctttgacacggaatgataattgaatattgacttcttgactataagctcctgaagtcaggacctaatcttattcacctctgcactttttttcttagtaattgacatatataatagatatccccaaagatctgttgaaaatgaataataagaattggattgtctaaagaggagcataaaaggcagagatattcccataggtggatctttgggttctgatgatcagccaatcacttacatctctatgactgtcagtcacattgtgtgtggggggatgtcatagattagtgccaccattaaaaacctaaaagatttaggggtggtggtccctattacagcatcgctgaattcaccaggcgcacccctgcggagatcgcatagattctggagggtgactgtagactaccacagccccagttacagctgctttgtcagatgtagtatcattgctagagaagattactaagtcttcccataaatggtatatagtcaccaattaagcaaatgtaactttttcctttaaaattaaaaaagataataaaaaactagtttgcattcatgtaggatggacaatagtcacttacagttttcctgtgttctcctgcctctgtcatatgatacaggttcagtctgaagagatctgaaccttcagtgaataccacagaacatcaccccaatccactacatacgtgatgtcatgctgattgaacaagatgagcaagagatggctagtacaatagagaatttggcaagacacatgcactcaagatggtaggatatacacccttcaaagattcataagctggccaattttctgaagatttaggatcccagtggttagggatatacttgaatagcccctctaaggcaagagcaaattgagagtcttacatactccaccacaaaaaaaggaaaggcacaccttttggggtctaaggagcaaaccattctatacctaggaatactactctagcccatataccaggtgacactgtaggctgctagctttgagcagcacccaaaacaggaaagggcaacatcataagtctaggacatggtacaatcagtcccgccacttgcatatttaatccagaagaccctttagtattggaggtattatggtgggagaagatgcagtatggagcctatggcagtttgcagtgagagaaacaaatgctgcctctggaattctggagtaaggccatgtcatctgaagcagaaaatactatgctttttgagaaacagtttttggtgttactggaacctggtaaaggaaggacacttgactatgggacattaagtaaccacacacttagaacttgccattatgtcctgggttctgtcaggctgccaagacataaattcagatgggcactagcagcaatccattatactggagaaatgttatatacagaattgaacccaagtgggaccgggggaacaagtaagctgcattaataggtagcccaaaccccaatgtcaccttcacactcactgcagttaccttctcctagcttataactacaggaatatgtgttagggtgagaaaatagctcccatatgactagctggaggaggagaaaaagcttcagcttgatttatggttgggtcagcttggtaggcagttctagctgaaaatggatagcaacagcaaaaaaggtacacttatgcatactctgaataacaacagagaagaaaaaagtcatcctaaggggtagatctgtgagcagtgtaccagctcatcatcttttgtgtggcaagagaagtgacctgaagtgaggatatatagattcctcggcagtaatcaatggcatggctatctggtcaggggcctgggaggaaaaaaaaatagaggaagagagatctgagacagagtcacatgactagacacatgggattaggcaaagagtataaagagttcgccctcacacattaatgcccaccaggaagcatataccatgaaggaggttataaaaaaccaagtagacaaaatgacttggccagttgacattagccagccttcatctttggtcactcccagattggcatgagtatcaaatgaatggagaagacatggtagtagagacagaagttatgtatgagcccaacagcatgtactatcacttaccaaggatgttccagcttctgctgcctctgaaagttccatttgtcagcaaaaaaagaccaacaaagtccacattatgtcaccattccacgaagaaggcaaccagctactcggtggcaaatttcttacattgggcaccttccaacctggaagtatcagcagttcatcatcacagagacagatatttatttgggtaagagtttgcctttcttgtctctaaagttctactagcactactatctagaggcttacagaatgcctgatccacagacatgaaacctcacagaacacagcatccaaaaatggagaccctctttacattgaaggaggggcaaggagtaggcccatgatgtaatccattagttttaatcctgcccaatctagaagcatccagcctcacataacattggaatttccttctaaagttataattgatgtgccagttaaaagaaaataatgtgaaaaaatggtgtactaccctttagaacacagtggatttgttaaatcactgacccatatggagttttgtcccaaataggatgaacatttgggtctaaagaccaaggggtggaagcaggtatggtcctatttaccatcactcccaatgacacactgtattctgtgcttccttcaccacaccctgaactctacagggctgaagatcttgttacccaaagtggggggtctctcttgacagaagacacaacaaaggtcttaataaactaaaaattatgactgctaccagagcactttggactttttgtcaccaggtctgaacaaataaaaagagaagtcaccacactggcatgactaattgaccctgataaacagaaggaagcaagactgcttcaatccaataaaggcaggaaggaatatatgtgaaactcaggtgatacactgggcaccttcttgtactcctgtcaaacatacatgctcttcagcaatgaaggtttaggttgtactaccagataagctaccaagatctgctgaggtgatagctgagggtgaggggaatgtaaaatggacagtgaaagagtgagaaaagtaccagttgtggctctgagaacaactggattgacagaggccacagttcatcctattaacacagtcagatcacgtaaaacaaaaataagttaagatacagcaaatctaaataacataatcaataaggaagggcaaatcactacataccaaactttgcacctgataataagaatataccatcttgtcaagaagacattgaacattcacaaaaggtgaacatatattaggtaaaaaagaaaaagatcagtaagctccataaagtaaaaaaaaaaaagtctctgatcaccatgcaatgaaaccagaaattattaacaaaatcaaaactgaaaaagctctcccacttgaaaatttaaaaattgcctatttaaataattattgggtgagaagggatatacaaattgaaatgacaaaataccaaaaagtaattttaataaacatactccatatggagtctactgaacacatttaaagtaatgatcagagaagaaataacagaccttaataattttatgaataaaaataaaagaataaaaagaaattagaaaaggaacaaagcaagaatatcccctcttatgactccttgtcaacattatactggaagtcctagataatgcaatatgacaagaaaaagaaaaaccatacagattgagaacaaaaatataaagctgcctttgtcacagatgacatgattggctatgcagaaaagcagaaaaaaatgaacaaaatcctcctggaatgaataagcagttatagcaaggttgtaggatacaaggttaatatacaaaagttaactgacttcttgtataccaagaacaaactaatgaaatttgaaattaaaaacacaatacagcaccaactgtattagttggttattagcaccaactaatacttagttatgaacctaagaaaataagtacaaaatttatatgaggaaaactataaaattatgatcaaagaaataaaaaagaagtaaattcttcccaatgtgatctatagattcaatgcaataccaaacaaaatcccataagttatttgtggatactgacaaacagattctaaactttatacagagaggcaaaagacccaaaacagccaacccaacttgaaagaggacagagttggaggactgatactactggacctcaagacttactataaagctacaatattcgagacagtgtggtaatgaagaaaaaaacagataagtagatgagcggaacagaatagagaacccagaaatagacccacataaatacagtcacctgatctttgacaaaggagcgaaggcagtacaatggagcaaagatagtcttttcaacaaacggtgctgaaataactggacatctacatgcaaaaaagaaatgaatttagacacagaccttacacctgtcacaaaaattaactcaaaatagatcacagacctaatgtaaaatgcaatattataaaatcctagcagataatacaggagaaaatctagatgaccttgggtatgttgtttttagaaacaacacaaaagacacaatccatactgaacttcattaaaatttaaaacttctgccctgcagaaaacaatgtcaagagaataagaagacaaaccacagacgggaagaaaatatttgcaaaaggcacatctgataaagaactgttaccccaaatatacaaagaactctgaaaactcaacaattaaaaaaaacattaaaaaaaggccaaagaccttaacaaacacctcaccaaggaagatatacagatggtaaataagcatatgaacagatgctccacattatatgtcattagggaactgcaaattaaaacaacaatgtgggctggttctggttgctcatgactttaatcccagcactttgggaggccaaggtgtgatgattgcttcagcccaggagtttgagaccagcctgggcaacatagtgagaccttgtctctacaaataataataataataatagctgggcacagtggcacatggctgtggtcctccctactcaggcggctgaggtgggaggatcacttgagcccaggaggttgaggcgacagtgagccatggtcactctactgaactccggcctgagtgacatagtgaaactgtctcaaaacaaacaaacaaacaaacaaacccaccaccaccaccaccaccaccaaaacccagtgtggtgccactgcacactcactaaaatggccaaaatccagaacactgacaccaaatgctggtgaggatgtggagcaaaaggaactcttattcattgccagttggaatgcaaaatggcacagccactttggaagacggagtttattacaaaactaaacatacttttactgtgtgatccagaagccacattccttaattctacccaaaggagttgaaaatttatgtccacacaaaaccctgcacatgactatttacagcagcttcataactgccaaaacctggaagcaactaagatgtcctttagtcggtgaatggataaactgtggtatatccagacaacagaatattattcagtgctaaaaagaaatgagctatgaagccatgaaaaaacatggaggaaccttaattgcatattaatatgtaaaagaagtcaatctaaaaaggctacatactgtacgattccaactgcctgacattctggaaaaggcaaaattatgaagacagtaaaaagatcagtgcccataggttgctgagggcagggaagaggagggatgaacgggcagagcacaaaggatttttagggcagtaaaaatactctgtataataatataatggtagatcattatatatttttccaaacccatagaaagtacaacttcaagagtgaacactaacactaatgtaaactatggaccttgggtgatagttatgatgtgtcaatgtaggttcatcaattgtaacaaatgtgccactcttgtagaggataataggatcactacaatcaagtagaatatatttcaagaatgcaagttgagacaataaaaaatccattaatataccatacacatagatccaaacagaaaaaatacataattatctccatacatgtaggaaatataaaacctttaatcaagtatatatatttgacaaaatataataatgatccctgatttaaaacattcaagaaaatattaatggatatttctttcttttttttcagggtcttgctctgtggcccaggctggagtgcagtggtgtaacctcggctcaccaaaacttctgcctcctgggctcaagtgttcctcccacctcagcctcctgaggagctgggactataaatgcacaccaccatgccaggctaatttttgtgtcttttttgtagagatggtgttttgccatgctgcccaggccagtattgaactcctgggctcaagcaatccccggcctatttctttaatgtaataaaatatgaatattttaatcttcatgccagcatttacttcatgaggaatcactataatgtttccactaacaccaggaacagagcaaggatgctcaccacttctttaacattgtactaggggtattacaatacaattagccatgagaattaacttaaaggtttaagaagtgggaaagaagaactaaaatgatctctatttgaaaattacatgatagcatgtctagaaaactctggaaaatcaatggcaaaacgaactaaaaaaaaagaaaccattaaggtaaccagatataaaattaacattgaaaaatcaacagtctttggacacataaacaaaaatctattagagaatataatggcagacaaaaccccttttactataacaacaaaaaaataaaatgcttaagaaaaaaatttaacaaaaaatgtgcaaaacctaaggaatgttaacacaaaaatagatctgaacaaatgaaagacaaccgttgttgttgaaaagactgagtcaacatcataaatatcccagggctctcttaatttataagtgtaagttgaagccaagaaaaatactaacaatattttttaatgaagctagatagattgatgttaaggtttatatggaaaaacaagaatgcaaatgtagccaggaaaacactgaaaaaagctcagaggacttaaaacctttccagacatctcaacacaccataaagtttctatcattagaacaaggtaggacttgtgcatgaacagacaaccactcagatggaatagaaaataaagtacagacatagatccaagaagtagaaatttagtacaatcatgtgtcacttaatgatgggtatttgttctgagaaacattttgtcaggcaattttgtcattgtgtgaacatcatagagtatacttccacagacctagatagtatagtctactacaaacctaagctatatggtatagcctattgcttctaggctacaaacctgtacagtatgttactgtactaaatactgtaggcaattgtaacacattggtatttgtgtatctaaatctatataaacatagaaatggtacagtaaaaatgtagtataaaagataaaaaatggtacatctgtatagggcacttaccatgactggggccaacaggatcagaagttgctctgagtgagttagtaagtcagtagtgagtgaatgtgaaggcctagggcattactgtacacttttatatgactgacaacacagtaggtttgtttacaacagcatcaccacaaaacatgtgagtaatgatgttatgaaggcattatatgacatcaccaggtgatacaaatttttcagttctgttataatcttatgggactagggttttatatgaggcccatcgttgaccaaaacaatgcatgcagtgtgtgactgtgtatgatataggtagcatagtttaaaataaactatgatactgaagcaaagacagattgtttaacgaatgattctgagaaaactgattagccatttagaaaaatgtgaaatgaaatacataaatcacaacattcacacacacaaaaaaaacttttaatgtatcagagacctaaatataaaaaaggaaactagtcaagaatcagaagaaaacataggtgatttctttaaaatctggatataggaaaaggttctctaatgatgactcaaaatccaaattccctaaaagactgacaaatttggctatgtaaaattgtaaagctgctttctgtcaaaaaacactacaaacaaagtcaaaagacaagtgacaaattgggaaaaaatacttgtaatagttatcaaaggtaaagggctaatttccctaatacccaaataattcttaaacatttagagtaaaatgaccaaatacctagtagaaaaatgggcaaaaaacataaacagacttttgcaagaaagattataaaacagtcctcaaacaaaaaaaagatgttcagtgtcacttatagtgagaaaaatgtcataattagagaaatgttgattggaatgcaattctttcagagaggaatttggcaatatctaacaatatcttctttcgacatagcaatccaattctagcaattcaccatgaagatacacctccaaccgtatagaaatacataagaagcacaagtttattcactgcaggagtgtttttcattgcaaaatgctggaaacaaactaaatttccatatgtaggagaatgattgaataaactgatacatccacacaatgaagtactatgaagctacaaaattacataaagagctccatgaattgatatgatttccaggatatatttttaaataaaaaaagcagagtgtcaaaaagtatctgtggtatgtaaccttttatgtaataaaaaagtgtaagaaaatacacatacatctgccccttaaacaagcaaaacatacacacatacacaactcacaagaaagatacaccagaaactactgagattggatacctcagggggcaggtgagaacactgaaaaagaataagaggatgaggacaggacagaaaggtagggagggtagtacacttatctaactttgtcctatatagctttgccctgtagaataatttctctaacttttctggaagaaagtacagttaaaattaaagtttaatataattatacttttaatatgagtttccttacatggttttaaagaaaaaaaatatgaattatttttctgcaccttgtagttatccatgaataaactcagcttaaccactgattacactactctaaagtggtaacggtggtggctactgaggaaggcttaacctctgattttagccttatagaatttaacctaattactcggtggaaataataatgattaataaatacaattgcaagatattttatgactgtaaaatatcaacatgtataattagttcactgggctaactcagattattttttctgtctgtgagactatcttctaagttacctgcccttctcctactcttatctcaggctccttcatatgctcttggtactataaaacttgtgcttttgaatcacattcaccctgtactgcaaaggcaatccagctctccttctctgttccagctcctgtgcaaattaaatgtcaatggaaaaaatccatagcaaagcttattagtgtctttcttttatcactttgtttttaaaaacatttatagaatgctatctctgtgccacgctttgctgcagtaaatagtagtaataattttcccaggctgctaaaacagaatcagatgataatttccatgcagagaacaaggagaatgttctgacttcttttgtgatcttataccttactgggttgaaagcactctcattctattggataaaggttctgctgccataaagaacagaaaaataagatgtggttctttattattgctgttaatcacctgtggagcaacccccaatgattctgattcaacatttttgagattggccctggcaatctgtgtgtgttttttctttttagtagagacaaagcctcactatgttgctccaggctggtcttgaactcctaggctcaagcaatcttctcattgtagccacccaaagtgctgggattacaagcataagccaccatgcccagccttaaaaataaaaaaaataaataaaaataaatttaaaaaaagttctacaggtgatagtgatgcccagtaaaggttaataaatcactttctatagctggcagttttattatcaaaaactaaaattactattcattcaaataagttctctgcttagataagtaaaataatctccttaaatcattgccctactggccaggtgcggtggctcacccctgtaatcccagcactttgggaggccgaggtgggcagatcacgaggtcaggagatcaagactatcccggctaacacagtgaaatcccatctcaactaaaaatacaaaaaataagcctggtgtggtggcatgcgcctgtaatcccagctacctgggaggctgaggcaggagaattgcttgaacccaggaggcggaggttgcagtgagccgaggttgcaccactgcactccagcctgggcaacagagtgagactctgtctcaaaaaataaaataaaatagaaataaaaaatcatgtccctactttcagcactgtttctccccacagtcttatgttcacacagcagccagagtaacctttgaaaagcataaatcagatcagatcatgcctctgccctatttaaagcctctcatggcttcctgctgcacttagaaccaaatccaaacttctcactatcctctatgagggcatacatgatatatctcctgcctacttttccaacttcattgtataccactttcctcttcattcattctgctcactccagttacattggcattctttctgatcttgaactggccaggcttttctgccttaggtctagacaatgtgtcctgtcttcaattatggtggtggtggtggtggcagctaatacatactgaacatttcctattaactacatgctgaagtgttttacatgtattaatgtgtgtaataaaacaactttatgaggttggtactattaatatttctgttttacagatgaggaaaggcccagggaattgaagtaatttgctcaaggtactcagactaactcctcaattctcactcagaagatgttaaccccaaaattctgtaattttcagatattaacttaaaccttttatcacccagttattaacaaaagctatcatagaagtatatatgtaggtctcatcattttggcccctaatagaattactttcactgaattatgctttcacattgtaacatccatctatactgaatagtggaaatgacacaatacaatgaattgctaccctccttttgaataattaatatgttctaacccaaaagaaaggagaatcatataactgatcatgtgtcatccttttggcagtgggaagatcgtattcaaatctgaaatccccttacaacaaaatgtacagagctttgtgactatatttcaggcaaaagcctcttacatttcaaactaaccaaaaactgggccagacatggtggctcatgcctataatcccagcattttgggaggccaaggcaggtggatcacctgaggtcaggagtttgagaccagcttagtcaacatggcaaaaccccgtctctactaaaaatacaaaaattagccaggtgtggtggcaggcacctgtaatcccagctacttgggaggctgaggcaggagaatcgcttcaacctgggaggcagaggttgcaatgagcccagacggcaccactgcattccagcctgggcgagagagtgaaactgtgtctcaaaaaaacataaacaaaaacaaacaaaaaaccttatccaaaaattaccttaaccaacaactcagaaattattttattagtccgcagtcactctctcacttacttttcaaagaactcctgcagctcctttctcctgcacagtccccttactcttgagatttagtttcaagactaagaaaacagagactatcctatctgacctctttcaacttctttcttcttttgaaacaaatccctacagttatgctgtgtataactcatttattttttaccttccttgctttcaagagaaatgaatttgtatataagttgtcctctaaatgttgcttcagctgcaacactcaagtttttatactgattcgttctcattcacttctaaatattttctaatttccattgtgatatttcttctctccagaccataagttactaaggaatgtatttttcagttaccaaaatttattttactgactttttattatcaacttaaaacttaactgcactgtagacaaagactgtagacttctaggggtgagtttccaggtgtagtatttttaaactttgttttaattcatctgttacattgcttcatctaatacctttatgcagatgattatataaatatgtatctctagtctacttttctgagctttaggcctacagttttaagactcttattagactaattttctatttctcctaaaggcctttgaaccctaacagattcaaagccaaaacattatttcctgccactctgaatctcttccttctcctcctcctccttttcctattttctatttttggaatgatgatccacattctacccaacttttcaagcaaaaagtgttcaaattgccttttattcctctctcttacaattggaatgaactgttttatgtattgtgaattatattttctagttctctctttaagctatcctttcctttctattgtcacaggacctcatcatcaatcccctgctctgctgcaccatccttctaaataacctttagttcatctccttggcactcctccttcccttcttctcttttatccttccccctgctgctttgcataaagcacaactctgataattcctttctcttgcttaaatatctttggttaacgcatacaggataaagtctgaatttagcacaatgcataagaccctttacctgagtaaaattcatccactatacaagcagaaagttttcaggcttggtttgctaccaaatatactatttaaaattcttggacctgcaagtttattaaaagcctaatgttgacaaggatttggataaaagtgttgtctcacatatagttgcctatgtactatatttttatgatcaagaaaaagttatgctccttgaattaggccccatttcccaaaacaatctagcatcagttcttgacagagtacaggttacatttttagccccatgaaaaaacttaatacaggtgaagaggaaggattggtactctgaaaatgctggggctcaggaccttatattagtggtgctaaaatcagagataatgagataatgttttcagtgttgatggatattatgaaattttaaagggaagagagaaataaataaacatctttagaagaccaagtagtaagtgaaaacatggcgcatgcatcctttaaccaagctttatgagaaagaagaaaaatgactcaaaaccatacttatagcaaggaggtaacatagccatttctagtgtacatatcacctgtaactgcagtaataataggacaatacagtcataataataacctttaaagataatgaaaattaaaatagattctgtatcctcagtatgacaaggcagtaaatactattcattccaggaaagctttcattaaaaatgattaaaataaaaattgtaggctcatatggagaagcttatactaatctgaagttttaattactcaatttccttcctatcagaatgctgagatcaatatactactgtattttacttcctattacctctctattggtaaaactagctacaatgaagttttgaagactctactttttcttttttttttttttttttggagacggggtctcattttgtcacccaggctgaagtgcagtggtgccaccccaggctcaagtgatcatcctacctcagcctcccgagtagctgggactacaggtgtgagccaccatgcctggctaacttttaaaacattttttcttttttttttttagcaacagggtctcactatgttgctagggctggtctagaactcctggactcaaggcgatcctctcacatcagcctcccaaagtgctgggattgcaccatgcccagcctgctttttagatttttgaactgtcaatacccaatgtgttttgaaatcatacagtaagtaagaataggcattttctaaagaaatcagccaaccttgaaggacagctgtgaagtaagaagtagatcttatggtttacaaagagagggagacagcatcagtacagcagtagtcttagaaactctgcctactactctgacactatgacattattgctctaacttatttattctgatgccaattattttctcagccttctgctgaatctatgactctaaattaaatatgtatgtacactgatatgtgtgtgcttgcgtgtatgtgtgtgtgtgtaggcacacacaggcacacacatatcaatatgggcatatatttttgaaactagagtgagcttcagaagtttcatctccatgtagtatatctttgactcataggtctgactcatagtaggattttttaaaatccaaatgttttatctcagaagcttatgttctatatagacttttagaaaagaaggccactgtatatcaaccattaaaccaaagtcaaaaattttaaagtatatacaaacaaatttgatatatgtactacagacttaattgtatttattttagaatactgtatgagatttaaatgatatatggatatagcaataattggaaacattttgcattaataattcagtggagtttctttcctgaaatttggttccaagcctcaagtacttgttattaatagctgtgcagaacaaataaatcagctgtgatcctaatcagtgtgaaaatgtggctaatgcacttttctgtttccctaggatccctgttgcatacctcgtgacataacagaaaaaatgtagtccaaactatttacggagatctaaactttaaagaggatctttcttaagcttgctatgttgaaacatgttttatcaaacaagtttaatttccaccattttgtttcaaatttattaactttccaccaatattttacctctggtcctggagggccagatggtccttggagtcctgggtcacctgtttggccctaaaatggggggggaggatcaaagtataaacataaacttaataaacacaattaaaagaagaaacaggcatatggtaaacaaatagcagtcagtcattatattatcatgtcaaacaaggttgtaatgactttttagaaaaatttgtaaccatcattactgtaaaagtttttaaataagatgtttatgggtttaatatacattcactcaagtgttaagtgatacaaacaaattaatgagtcaagtgctcaaatcaagaaaagaattgtatgtttatatgtgtttcacagagataagacaataaagctggactcaacaagatagggaattctagaggagaaactgcttttataaataaccacagtcccagggctgtctctgaaaattcctctctcctttgatactgtaagtggcctgaattagtaattaagactcacctggattgaaatccttgttgcttaatctctctaagcctcagttttctcatcaataaaatagaaataataattatagtactaacattctcaaagagtcattggagagttaaattagataatatatgtaaagtgctaagcacaatgtctgacatatgaagtactcattaaatgtcaaccaattttacaatcattattccttctcttcacaccctttctgctttcctggctcacacatagaattcctagactgttttcatcctttaattgaagttttaaggattcagtttcagtatctctgaagctagtttctgacattcatgataaagatgtgaaatcagggttaaaggagaaagtgacaggaaagagaagtaggtataaagcctgaaactagagaaggctagcaatgctctcgagagatgaaagtttggaaagggaggacagtagtctgatatatccattttcataagaaaaactattgcattcattatttctgtcatattaagtttctatatgagcttcaaatttaatttaaataagcctcagatcacctaaacttgcaagttacaatacgggattgcccattttccaaaacctaaagcacagtttccaatatgcacttaattcattctcagtgctgaggtatctggacataaaacaggacaccataaactactgcaatcaaatccagagaaaggcagtgaaatattatggaaaggctcatttaagtttccctttccaaataaacaaaaacaaaatctgtgatccatcagaatcagtatactgaagttcttaaaatgacaagcatctctctttaaagagatagagaaaggggcgaggggctctcattggagccctctagtggcaaaatccaaccacaaagctaaatttctaagcagtgaggataaaatagcaataccctagggctttgttttcagaaaagctgattgacaatcacatatttaaaaacagaaattgtgtaatgattttatttgatcttcagaataattctttgttttgtaaaattttgattgcaaatttcctatgaatgtcaatttttctttataaaagctgacattttaagtaacttatagataactaatattaaataaacctctacaaatgacaaaaatccctagctaaaaaatggatagggcataacaattgtgtttgttttcttggtctaaaggaaagtgtatttacgaacaacctcagagtggtagttttctctatttttttttaaaatacttgtagagcaaaagcttccctattcaagaactgtaacaactttccaaatcaggacattccttcttatatcttgaaaatattatttcatgttacaacttagatctacttggaaacaatattagttagtaacaccaacctcttaggtaacagaaaattaaaagtaggatctataaaatagggaagacatccttatgatgttggcattctttccacgacagtaaacaaacattttagataggcattaacttatataattgaatgtgggagtttgtttcttaatataataactgattctgcataagcaacttttcatcaaacaagtgtctccttctataagaaggaaaggtttcctggtcaaacacctacagtttttctattaataatatatacagccaggtgcagtggctcacacctataatcccacattctaggaggccgaggtaagaggattgcttgaggccaggagtttaagactaacctgggcaacaaagcaagacctggtttctacaattttttttttttttaattagctgggtatggtggtggacctgcagtccttgctacttgagaggctgaggtggaaggaccacttgaccccaagagttggagactgcagtgagctgtgatggcaccattacactctatcctgagcaacagagggaggccctgtctctaaaaattttttttttaattaaaacaaaaagatacaaacaagtaataaatacaacaagagacaaaatacaaggctatctcactaattttaattcatgaatgcttatcttatcttcggcccaaagtagttttcaaaagtttgataaaacaaataaaaaaaaatcaattatctccctaccaaagtaattcctgctgacattaattttctttattagaacagtacagaaaggtgtaaaatgagtaagtaaaagcctcactctcactgtctcttgctccctgccctaaaagaacatcattagcatttattgtgacttctttcaggaaaaaaatactaagggctttaagataatgtgttaaaggtgaaacaggctctctgccttttctttagcttacactaggaggaatattagtaagtactatgtctaaaagagaaaaacatcataatcacaggactataaggaaccttacatatgatatggcctaaactttcttttttcattctttcttttttttttttttttttttttttgagatggagtctcactctgtcgctcaagctggagtccagtggcgcaatcttgacttactgcaacctctgccttctggattcaagcgattctcctgcctcagcctcctgaggagctgggactacaggtgcctgccactatgcctgggtaatttttgtatttttagtagagacagggtttcaccatgttggtcagggtggtctcgaactcctgacctcgtgatccacccacctcagctgcccaaagtgctgggattacaggcgtgagccaccgcacgtggccctaactttcattttaaacatgagaagctggtaccatggtggttaaatacccaaggtgatagccagtaggttaagtgccagagctgggaccagaatccaggtctttgtctctctagccaatgatttttttactcccatcaacatgttataaatataaatttaatcaaagagtaaggaacactaaaatggtttgccttgtgtaagcacgatacttgactctagttttctcaaaaaattaattgtaaagcacaaaaaaatacttatattatttattagttaatagtgcccttagagcatgtattgtatcatttcatcctatttggtcaagcgctagaaaaatgtcacattatttaaaaaaaagaatatgtaaaaagtatcttattttgccaatcactgcaaatatcagagagtctttatatggtttagaaccatccttgaaaaacagaagttgtttgttagcttcatgacctagtctcatgatccaatttatgcactctagagtttctgagattcaactcaagggtacaagggagggtacacggcttattaggttaagcccttatggcaataagcccagggcaaagaactagtataagcaaaggtcaccactaacatttcatcgaatagatgccaaaaattgttctttgggttaaataattcctaagagatgtatataaaatactgtcactgttagaagtcacaaagaatggggtaaagttctgtaatttaatactgcttcctgagattaaaaaaataaataatcctgagatggaagggtagagttagagggaacacaatgaactgctcaggaacataacacaattattttttaatgtatattttaatgtgacattaataaattataatcctatatgtattttttgtatgtataatcatctctacctttttcatagaattgaatcctatatctaattttttctatctgtaatcacctttaccttcacagagttgtaatcaatattaaactcctaaaaccatcttaaaatattaaaccctaaaacagtatggcacagtagctaaacgcatgagctctgacatacctgattgcctaggtttttctgaatggtcacctactaagtaggtggccacccaggtgaccttagatgttttctaacactgtgtctcaattttcttaatataaaaaataggaataataatagtaccaactttgtaggattgttgtgaagattaatttagatgtatagtccttagaatactgcctggtattgtgtagatactcagcaaatgttagctataataattatgatttttaatatttagaaatatattttctcaagttttaaccattttatttaaatagctttaattattaagtaattttagatttataattttttgagttttatgttaacagcaatataaggtatctttttctttcgtctaattgatgtccaagggtcaggaaaaaaaataaggatttagaatattttggtccacaagagagtgcaaacatgctaccttttcttcagactgtttccttaataaaattgatattttgaaaagttaaaatattatttaaggtgctttacattttctggcttcaaagcctattgttttaatttaaatattgtctatattaaattattcagtagaataatatgaccaagatctttaggactctcagaaacttggctttggcctagggttgggagtagagggaagtccaaaagtctatggaatgtgaactgaatacctgagggatttgctatattctaaaactaaggagacaaatgctcagtaggcttataccctacttagatcaacagtgtcgagactcatgccatgacatgcactctgtcaattacaaagagcaaagcaaaagttcaaacctactgaaggccctgactttcctctcatccctggtggtcctggtaaaccaacagcaccctaagagaagagaataacagaagagaaagttattataccacaaaaggcagacataccactatttacaaactgctaaaaaatttcataaagtatgctaaaatattgagacaaaagtttcaaacaagaacttaaaaccatattgataccacattctaacacaatacatggataaaataataagcagttctttcttttgaatttacactttttcatatttacataaaattaatggtataaacattaccttgtctccaggatacccgggttctcctagctctcctgctgtgccttgttcaccctggaaagcacaatttcatgcaaagatacttatgtatcacaaacatggcaatattataagaaagcaaatattcattgtagaagaataatttctctatttttcttacttctgaggaaaactaatataattgatactacaaattagactccataaaaacaaaatatttcataaattgtgttgactgaaaagtaaaagacaaatgtgataaaaattatttttataatattaatatttaaatcaccttatcacctttgattccaggtagtcctttattccctgaaaggccctacaaaaaaaggtgacattttgtgatatcatagacagattaaagggaaatatccattatacaaatagaaccataccattgggccaggaattccagcaggtccaattggtcccacagggccaacactgccctggaaaacagtaagaaagaaatgcatcattaagcattcattaggattagaaagaaaatgtggcagaattaataaattaatgaacccaaaacagccaactcactaagctcctacacgtgccttgttcttcaacaacttatttttctctccacatttataaatcataccaatatttcaaaccttagtgaagtccatcatttttctgaaaccttttcatatttgtctagtccacagagattctttcctcctttgagctcctataatactgtccatgacattcatcttgcaatatttctccaactagatgagacctttaaaaaatattttagtgccatattcccaggaactagtcaacagatacttcatttgattgtcttagagttttatttcacccacttattcagcaaatattttttgaggagttactatgtgccagacatcctaatgatttgattttataatttcaaatttgcagaatgagaaaatttatcataatttcagggataaactcagaggcaaacaaaaagctctactcttctgggcttatctcgtttattcatcatttaatatttactaagcataatatgtacgagacactgttgaagaaaaaaagagaaaaaagacataatctctaacatcaaggttctcaatttaatgctctaattcttcagaaacattaccactattatcttctgcaagcaagagacttagaaaaaacttcaatatgtcatcttagaagacaaagggcaatagcaacataagggtatgaaagaaaaatttgaaaaacaaaatggcacttcttggtggtttgggatcagttataatttctgtgtcactgaggtctcctttttcttctttttctcacgatctttctttgcctggcttccttactactctttataatggaaatccaagttagttcaaacttctctttctagtttctaaatattaaggaactcttaaagttgcatttgtgaaatgctaagaatgttacctcttgtagttagaattctaatttcttaggatagcatcctaagccctctctattaggcttccatcaaactttccagtctcctttccttccattgtcctcatttcccttccactttacttctccctccccgaaatcctccattctagctgcagtggactgtctttcattttctgaatagctctcccttaccaaatgctcagaacctttgacaagacagttaccagtactagaatgcacttctactacgctacttagtacatggcactgtactttttttttcctgccttcctagtctgtgcattttgtgacagcggaaacacgtttcattcattttttttatttcccagacccaacataataactggcagataatggttctgaaataaagtgtagaatgaatactgaagggattaatttgaaatggtgatttctagagctcaatatcctaacataacagcatttctaattgtctacatttatataatacaaatttcagaatggaaaataagacatcatatggatgagtcttaaagtctgtgaaatacagctaagataaattatttctaacatgtttaatcctgaaatatataacaccgttagaggcaaagggtaatactttccaacttaatagatatgcaatattaatacatgatgcttgtaatttcaaattatgtcaataggaaaacttgtgcttatgattacagtggctagtttattcaaagttcatagctttaaaacttatgataggttagaaaaatacaaaaatatctctgtttggaaattatgcaaaagtaatccaagtaagtatggaaaggactatcttaacaaacacacacacaaatctttctttgtgtccttttgttttcttcatagataaaataatattcttaacttttttcagtaagtatattactagcatcttcagatgaatgtactttgtatatataatatcctattttacttttcagtgactctacatgaaaaaatcacataacagtaagtattgggagatatgaaaaatatattataatgaacttagaaaaataaagaactataaagtaaaattgaatactatggaattgaaatttccaagaaacagcatgtcacaaattgagtggaaatcctagtcctgagaaactatagccttctgaaagcaactcagttctcagttctaccaaggtaacctgaaagtccttcagcattccctaactaccaactcatcttccataagaacatggaacagacagaagaaatactttcatgcgtgggagccttgttgagggtgtttgggatatggcatcagagacagaggagcctcccacacagctcctctgagaacttctgagttaagtcaaagaaatagagagacccagaggataagttatttgtattaaaaagagcagtcactggccaattaataagggttcatatggtatactgtagaaaggactgtgagttccacatggtgcttttaaatcacacccaccatactcacacgtgatacacattgtcactagtctaagaaagcatataacaatgacaaccaactgcatggaaaaaataatttagataaagcaatagcatctcttatcagaaactatacctgctggaagggaacacctgagagataaagcagaggctgctgctccgggcaagcagacaagttgtttactatgcaatataaagggtcttcataatccttcccaattactttcaaaacctcaattccttccattctgctcccaagcccttacttcctatgctacaatcccactactcctctttccagtcccaaacattcatttttccccatcttctgtgtatttgaacacagcatttttgtacctaaagaaagcttttccccctttcaccccaccccattcatatacaatcttcaagatatagctccaaaaatatctcctttgtgaagcctactctgactttctgagataacagaaattgctccttttcagtggttttacatttaatcaattatagcagtaatcacagtatatgacactacttatttttccttctatgccattagattgtaatgttgccaaaaataggaattttaacttgttcatattattaggcctagcagttagttcagctatttagtaggtgctcacattgttttaattttaaaaagtaatgaatgtaaaatggaagtaacaatacctgctttatctactttacaactcattgaggagcaaataagatatgtatataaaactactttgaaaggtagaaaggaccatctatatcagtttagaagagatgaggactacaaagatgactcttactatctgatatggtttgggtgtgtccccacccaaaatttcatctgaattgtagtctccataatccccacatgtcaaaggcaggaccaggtggacataatcagatcattggggaggattcccccatgctattctcatgatagtgagtgaggctcatgaaatctgatggttttataagcatctggcatttcccttgttgcactcactccgtcctgccaccctgtgaagaagtgcctgcttctcctttgccttccaacatgactgtaagtttcctgaggtcaccccagcaatgcagaactgtgagtcaattaaatctctttcctttataaattacccagtctcggatatttcttcacagtggtgtgagaactggctattacagtaaactggtactgcagagaatggttgctgctataaagatacctggaaatgtgaaagcaactttggaactgggtaacaggcagaggctggaacagtgtggagggctcagaagaagacaggaagatgtgggaaagtttggaacttcctagagacttattgaatggcttttatcaaaatcctgatagtgatttggacaatgaagtccaagctgaggtggtctcagggtaagatgaaaaacttcccaggaactacagtaagggtgactcttgctatgctttagctaacagactggtggcattttgccctgccctaaagttctgtggaactttgaacttgagagagatgatttaggatatctggcggaagaaatttttaagcagcaaagcattcaagaggtgtcttggatgctcttaaaagcattcagttttatgcattcacaaagagtttggaattggaacttatgtttaaaagggaagcaaagtataaaaaagttcagaaaatttgcagcatgagaatgcaatagaaaagaaaaactgattttctgaggagaaattaaagtcagctgcagaaatctgggtaagtaatgagaagccaagtgttaatccccaagacaatggggaaaatgtctccagggagtgtcagagatcttcacagcagccccctcctatcacaggcccagaggcctaggagaaaaaaaaggtttttgggctgggcctagagccttgctgctttgtgcagtctcaggacttggtgccctgaatcccagctgtggctaaaaggggtcaacacagagctcaggccggtgcttcagagggtgcaagccccaagccttggctacttacacatggtgttgagcctgcaggtgcacagaagtcaataattgaggtttgggaacctctgcctagatttcacaggatgtcaggaaatgcctggatgtccaggcagaagtttgctgcaggggtgacaccctcatggagaatctctgctaggacagtgtagaagggaaatgtagggtcagaggccccacacagagtccccactagggcactttttagtggagctgtgagaagagggccaccatcttccagaccccagaatggtagatccacgaacagcttgcaccattcacctggaaaagccacaggcactcaatgccagaccatgaaggcagctgggtgggggtctttaccctttaaagctacagggtggtgctgcccaaggctgtgggaacccacctcctacatcagtgtgacctggatgtgagacacggagtcaaattgagatcattttggaattttaagttttaatgactgccctacttgattttggattttcatggagcctgtagcccctttgttttggccaatatctcctatttggaatgggagtatttacccaatgcctgtacccccattgtatctaggaggtaactaactgctttcaattttacaggttcatagatggaaggacttgccttgtctcagataagactttggacttagacttttgggttaacgctggaatgagctagaactttgggggactgtcggaaaggcatgattgtgttttgaaatgtgaggacatgagatttgggaggagccagtggcagaatgatatggtttggctatggccccacccaaaatctcatcttgaattataattcccataacccccacatgccaagggcaggaccaggtggacataattggatcatggagatggctgccccatgctgttcccatgatagtaagtgaggctcacgagatctcatggttttataagcatctggcatttcccctgtttgcattcactctgctaccctctacagaaggcacctgcttttcctttgtcttccaccatgattgtaagtttcctgaggcctccccagcaatgtggaactgtgagtcaattaaacctctttcctttataaattacgcagtctcaggtatttcttcatagctgtgtgagaatggactaatacagttatcattagccatttccttttctgtagaatctcttcccatgaactgaaaggtgaatggagaaagagaaaatacagaagatccacttatttttactgagtacttttatgtgccagacagtgtgctaagttttggagcagaaaagtagagatagagtgtttcaggtagacaaacatgtgcaaaaccttgtagcaaagatgctgcatagcatctgagaattaacagctttgctagtatacaaatagtatgtcatggacatgtgggtaagaactaaaccagactagatatcttgggccatatttaaaaaatttggtcttaatcttgacagtaacaacagaagctttttagctaatcaactccatgctaatagattaaataaaaactgcatgaagagcatctttggaatctaactccttttgcctacttccttactctacccactgactaatatctacaggtttaaccctattctaagttctcaggaaaaaaaaaaacatcacacagagtttctcagaaaggactaaagaaatctcataaggtagataatatacacataagggagtataagttttaaggaggtggtacagaccaacgaaattctggactctggatttagatcacctggcttcaaatctgggctcaaacacttatcagctaaatagtcatgggttggtctgagaatggaatgacttaacaattgtggctagtccactgaaaatagtaaacaaatgtgaggtgccctcagtaattttattattactactactacaaatcttaccattatgttagagaaaagtttaaatgtttcagactcacacaggttctttgactctaaatcccatactcatgttatcccaagatggcaagttaaagcttatgctgacttaaattttaccacagttccaataactaagctcctgacttatttatttttatttatttgatttttttttttttttttttagagagatggggtcttgcttcatcacctaggctggagtgcagcagcatgatcatagctcactgctgcctctaactcctgagctcaggagatgctctcacctcagcctcctaaacagcagagactacaggtgtgctctacctcacttggctaattaaaacattttttcagctttatttttatttttttcaacgttttttatttaaataaggagaattcttccctatggaaagagctagcacaatcacatatttgaaaggagaaacaataggtactgaaccggagggaaagggcgaaggctgagtgtaccagcaccagcctggagaatccacaattccacttcctatccaaggtaagtttccgaaaatagtatataaacaagttgcacattatacctttagccatcatctgccctttcaaatatctggtctacatgaaaagagaaagaggaaaggccaaaacgaaaacaaaaggaaacaaaaacaaaacgcaaccctctcaaaaacaaaagaaaaaaaaacccaaaatcttttttactacacagagcataaggtcaaaaacttacagtaccagtgtccccttcaagccatggaagaaaaacatccacataaagccttagcaagaatttccactctgaggctttgtaacatgctgaagacagggccctgggggtgctgctgccattttggaggccaccaactggggtggagaatcagtgaacagcacgtctcatgcacttggaagatcaccagccaaatatgcactggtggcctggtggagcatggctaggtgactgcctacccccaacactgaaccactcctatcctggatgacctacttcttaggtctgtctcacatttcacaaaagagctggaagtctgcatttctcattcatcacaaaacaggacaaagcacacacactctagtatctttggtcatcaaaggccatttccaacagaccctcaaacccacgtttgctttgcaagaagtgaaaagggacaaatgaagatttgaagggcagcctgcagccacttggcagaaggaaactaaatggcagggagggggctccaccagagctgccatgctgccacagtgggccaggctaattttcttttttctttctttttttttttttttgttgttgttgttgtagcattgggatctcatcatcttgcccaggcttggtctcaaactcctaagctcaagtaaccctcctgccttggcctcctaaagtgctgggatcataggcatgagccaccatgcctagccgtgacttctttgaccaagctgtcaccttgtgctttgggacagctaaaggtaagggaaagaagactgaaagaaaggctatcagcatactgaacagatatttgcactcccatgtttattgcagcactattcacaatagccaaaatacagaatcaacttaagtatccatcagtagatgaatgaagaaaatgtggtacatacacacaatagaatattattcagctataaaaaagaatgagattctgtcatttgcaacaacaggaatggaactggaagacattagtgatataagccaggcacagaaaggtaactaacacatgttctcacaaatatgtgggagctaaatatatgagaagggtaggagtgggggttataaaaggtatgataaataggtacaaaaatacagtagaaagaataagatctagtattccacagcacaacagagtggctatttttaacaacagttgatcacagatttcaaaataaaagagtgaaattagaatgttcctaacacaaagaaataataagtgcttgaggtgatacaagcaccaattattcaaatttgatcattacacatttttgcttgtaacaaacatcacatgtacccccttaatatgtacagctattatgtattgaaaataattaacaattttttaaaaaggaaagaagagggtcttctatgtcttatgcttttgaggaaactttgtcttaagtatcctttagcgcacaggtacaaatacatacatataggtctataaaaatatatcattattttttcttatcataaaatacaattaattttttgacttatactactggtctaattattcatatctggttgaaaaaaatacatttaatcaaggttgataaccaacaatgacagtaaaacctctcatttccctaagtttcaaaaacacatctaacacatataaattgcacaataaaatattttcttaagaatgatgatatttagtgatactcactctaagcccaggaaaccccggaggaccagtgccacctacaagtccctattgtaaaagaaatttgcaatacttattaaatttgattcccaactactaagggtatttctgaagataaacacaaaactttctagctaagaatacatcaaaatgtaccttctactatagctaacttctgaaactcccctaatctatgcatcctcctgagaagcacaaacctatggtggccatttatgttcttcacaagtgcccttggctaaatgcttttggatgccaggactaccacctagcttaagcagagtcccctctgcctcctatgtatttaaccaaggaagtaaatcctatcaataatcaacactgtacacttaattatgctatccattctatgaaaagacaggtggtcagcacgtagggttagaaaaacattttcagacggtttaaaacactatggactcttttgaagtacattatttaaattctctaatcttcatttttctcattaaaatagaaataccaatatttgttctcactgtaaatatcacaatgaaatttgtcatatgtaaaggcaccataaaaatgtataaaattttcaatactgttaaattatttatataagtatcagatttttcatgatcattattaatttttccagctgatttgtgattggtcttttgaactcattgtcattacactttatagtctttaagataattcctaattcactttatgtcactgtcacattatttacaaggcacaaagtacatgaatgtccttctttttttgcatttcaaattctgtttggaaacaaaggcagagaatatactatagagaattataaaccagtaaactaaatatatccagttgactattgtattttaaagattttaaaaactcaaaatgctcctgaagaaatattattatattttaaatgaagagcagatttcaaaaaagaaaactttaaatattctaggagtcttaacagacttcatggatagtaactgacaaaaaattatgtaaaatggcttcacactaggtacacaagtgcacaaatggcattaaaaataaataatgtctactttattatgcttgaaatgggaagctcctcagaatcatatgcaagaaaaatggtaaacattccacttaaaacaacattcaagtttttaacaatttatttgaaaatcagttctacttttatctgctatgccttgtaacaaatgcagtcttggctgaattcactgaatgagctaatatagttttaatttggaaaagagaagtaaaaaagaagaaaaataaactattttaaactcttcatgctagtgatttacttacgtgtaattattggaactattcccaatttaggctacagagattttgtgtttttttctaactcactttaaaatcttatgaaaagaatatgtgaatggcttaagattggggaatagctattggatggtttttaagagcaaaaactaaagcttttctacctagcgccaaaaaatagcaatccatcatcattctttgatgatataattaaactaattttagaatagtaactctttctcaatctgaacattgacagctaaataatcccaaagtagaataattttctataaaacactaagaagtaaggtggatcaatgacaggtttgagtccaaagagcaatcgctgagtgtaaaatttttatataaggcttgttagtactttcatgtataagagacagtattgtgatcacatatttttaatattttacttaagcagttatacttaacatcatcaaaataattaatttaaagattgaatgtcatgatgaaatttgaaatatttttggttaatttcctaagctgaaaaatcacaaactggaatgtgcacagtggtgtggagattgtttttccaatagtgtttattcacaaatatgataataaggactgtaagtgcagtgctatgaagtatgaatgatgttagaatgcaaggctgaaccaacataatgtactcacaggactgccatcaagaccagcagggcctctgtctccaaagtcacctggaaaaccctgtcacagggaaagaggaagaatgccaacatatataaataattcatttttgctgtattttctaacaaagaatttagtaatagaaaatattaatttcctaactcttaaactgtaatgcaacaaacattcttttgcataacacgcttaattgattttaaatacaatatttcaaaaaataaaaaacgaaatacagtatttctatatgttataaaaattattttatatgccacataacatatacagaaaacaaaattggagaagtttgttcatcatacataaaaaatcaccaaatgaaaggaaaaacaatgaagatttctggctgaacaatcttcagttatctctgctattccaaactattcctatactcaccccatagagaataaaatagctagtattattaagcacttgccatgtgctaaagggtttatgcacataattatatatacacacttcatttcatcttcataacaggtctattcaatagatactaatattctcacattgttgttgaggaagttaaagcacagagagtgtaggtcacttgctcaaggttagaccattaaaaatgggtgggactgagatgtgaatggaggcagaccgattctagagtccatgtttttcaactatgctatactgaatactttaaatcatcattccaagacatacatgtaaaacaaaaagtcctttaagtacagttttattaaggaaacgaataatacacataaatactacaaatttaaaatgaggtgaaaattaaaagcttcccaaatgcctattgagaattctgcatggtaaaactatgaaggatggtaaaataacaaaccttctcattataaattctattgtaaaataactcaacgctcagctactcttactttacaatactacatttttctctaaagatttaccattcctcaactttaaagctcactttttaagaggctattttataaaaatgtttataagacttactattgtaaacattttcataatattcatttacaaaaactaggaataacaaaaataaaaatctatcattagattcttataatctctttacataggcaagtcagtattaaatattatgtttaacagactgccaaaaattactggttcccagagcaaatatgaataggttaaacttaaaagatagtttaacaatggaaaaaatgtacaatgtttctaaaatatagttaactcctactagaagcacagtttctcttattctgtaatcaaaggataatgtaaaaaccatctgtgtagtcaaatatattgtagccatactcccttcaaagtcagctgaagctcaagcattttactttcgttgtctttggaagtcaaattttcttgtcaacaacttgcaaatctgcaatatattatcctattcagtatgagctaacatggatacttgaaagtacttatgacacacaggtaatggaaaaagtagaggaaatatactacagtaagtctgaaacataagagatgattgattttttttagatagatcattagtaggttttccagaaaccccagtgaaataataaagtgtaggggacacactgcatgattccattactgtgtaatgtccagaataggcaaatccacagggacataaagtagattagtggttgcctacggctggtgatgtgggggaggaatggaaagtgattcctaatgagtacaggatttcttttgggggtgatgaaaatgttataaaatcagatactgtgatggctgcacaattctgaatatactaaaaactgccaaattatatactttaaaggtgaattttatggtatgtgaattatatctcaataaagttgttcttaaaaaacaacctgaacaaggagtgggattgctgaaaaacctttgggaattcactcaggattgcctagagaatgtgctgttctcccaatccttcccagtcccttgcatccagtgggagaaactgttctctggctcaccttccctcaaaatgagtaatttttccccacctaggagagggaagatgagaaagagaagaggggaaagaactgtgatcagttcttcccttatcacaaaatacttactttctacaaccagcagaaaaataatgcaatattcattaatttcaacttcttattcttccagtagttcacaaacatgtgtattggttgttcaccttgactttgcccctgaaataatttaattgaatatctactttaaatttttaatgtatttttctttattattattattatcgttgtcgagatggggtctcactttgttgcccagactcttctcaaactcccagcttcaagtgatacctcctgcctcagcctcccgtagtgttgggattacaggcataagccactgtaccaagccgttgtgtattgtttctcttctcactttattactcattaaacatttcattttaattctctattcttgatagagataatttattcttttaatccctcatatgttgatcatgtattatcaatttttgaaataatttctatgaaatctagacacttcttgttttatgaaatattgcacagttaataccacaaaggcattatttggctccttattagacacataatattttcttttaaagaacatcataccaatgttttatattgttgaatatttccttgcttgtttaatgtttattcagttgtttttcaatgctaataactgcattaatattttaatacaggtgaggttctatattcttttaatcatgaacttaatgtttgcagccacatagcttcattgccaaaaaatggtcttcaagattggttgtgaaatatggaacagtagtgacaaaatacatatctttcctttaattttataatacaaaagacagtctctataatttctttctccagttgaaagaatgttgaagaatgaaatattttgttatattttcctggtagaaaattattatcattaatttaaatcaaattgtgttttcctaaaaatactctcacgttgccaaaggacaaaatggccatttagcaggattatcatgcaacagagataggaaagctcaagagttttgcttttcttgttcaatttgccagtttcacaaatgttaactttcatcttctaatgagcatgccagagtcacattgttgcttctgtgttgtatatagttctcttcttcacattttgatcagttaaaatattttatgtgatgaagaatatgatgtttcaggaatttcaaaaaatctcttcaagttgtaaataattttctattttctcatttatttccagtgatcagtgtggtggacagtttaaaggatctccaaagattcccatttcccagtgttcacacttttctatgacatcctccctttgagtgtagctagcacctatgacttgcttcatctaacaaatagcatatagcaaaggtgatgagatatcactgccatgattatgttacactatataagactgtcttagcagcctggagctagagacttctcttatgagtttgatgaagtaagcagctgtgttggagaagtccatgtggccagaaactgtgggtgactctgcaaactctggacagtctataggacctgagagtggcccatagccaagagccggcaaaaagccagagccctccattctacaacctcaaggtaataaattcttcctacaacctgaatgagtctggaaatgaactttaccccagtcaagcttccagatgataatgcagcctgtctgacactttgattgtaaacttatgaccagagcagaagactcagttaagtaacacctagattcctgacccatgaaaactgcaagataataaatgaatattgttttaagctgctaagtttgtggtatttgttatgtatcaatagaaacagaaaaccaattaaattggtaattaaatcttctttagagaatatataatgtcttatttccaaattttaccataggtaatgttcaatataagtctactgttgtttctagttttaaaaaacttagatcatctctgaagattttctactgctgtctactttctattacaaattataataacaaaaagtattacaatttttatatttacttttttgaaaatttgactttatcttgttaaatatctgtattttaaactttatcattccagcattttatgtccacctgtcgccaatgtaaaaaaaatcttatcatgcttcatgaattttgtctatacttatgtaaagacaaatttaataataatatgcattgtttaataatggaaaatgcttgtcagtctccaattgcaactgtttgcaaatatcacactaattctattacctcaggaagaataaatcataatagaaagaaaagataatagaagcttaaaattaccagaaaacagtatttttattacgtaagattctattgcattcatgctgagagaaaaattagataattaatttctctttccttttatcaaaatgcttctactgcctgctcgaacccttagcacaatcttgagcagtttctgtctccaatgtcagcaatggtaccacttaaaaaccttcatggcattcagacatgaaaatacaggcaagagatgtggagaatttctctgaagcctaaacattattaaactgtggtacccagcctcaatgatggacctcagtgatctttgattcccggtattcatgctgttatgtagtccagacgcaccctgaattatgtgggcctatgtgaccaaaagaatatagaagtgacaatgtgtaatttctgaagctaggtcataaagatactacagctatcaccttgctgtagtatctttacaccactcactctgggggaagccaaagctatgttctgaatacattcagcagcactgtggagaggtctccatggggaggaagtgaggcctcccatcaacaactagcaccaacttggccagcaagtgagcctccttaaaagcaaatcctccaacccccagtcaagccttcagatgacagtagccctaaccaaaatcttaaccataacctcatgaattagaaccacccaactatgccactaccaaattcctgacccacagaaactataaaaataatacatatttattgttgttttaaaccaccaacttaatttgtttcatagcaatagatagctaatacatagtaacaagagtgactgtctaggattatggggcatgtgatgccagtgctaagtgctggatcctgaatgacagaggcactcaagtattttaaatgtatgatatgcaggggccctctaaagctcagagcccagagcaagtttctctgttgcctgggtctaacaatggtactgttatcaaacatggtagttattaaacactaagaccaaaagaagtttgttagacttgataggcctgaatacatgtatgtgatattaatattttagatcactcatagatactacatttggtagtctatttaaatatgtttaaacagtggaaaacttcttgcttagcatgtccagtaaaagcattattttcctagctccacaaataatatgtttaaatgtatataaaataactaggaaaataagaggaccaagataaccataaaatggtcacaatgactatatttacagaatttttaaaaaacaaaagcaatacaaaaacccttctggagaacatattttgttctttctagaggaaggtttagaaacaacatatttaatctgaagtagaaatgaataaaaattatcatagaaggttatatactaaacaagcattaataatcataacagaaatcatttgttccaaaactaagcattgaaaacacaggatcagactaacttgtctagaattagaaacactaaaatttaacctagaagttatttttacacattctgcatatgaatacatattaccaggaaattctgttattttaaaatccctcaaatataaaacaagatcactacaggaagaggctggagtgtgaagtattctgtgatgatctaatcttttcacccttcttttcctcacagcaaggacaatttgatccacactcagggtcaaccctatcctcataattgagactaattctaaacttcatcagaaacatgagtaggtttggcccaattcatgggggtttggcccaattcatggagatttggcatcaaggcaggcttaatgctaacctgggcctcagttcccagattcaagttccggccttgttcttaaagactgaataccacgttgtgtcctttttcttgtgtccaaaaaccagatgtggtatacaacatcatgttctgtccctcaataataagagtcccaccttattcttgccatttgccctcctagagaatataatccctgagcccaacctaggcctaactgccatatatgcactcacacttctgattttgataacctacaaggctcttttttttttcttttcttaattttatttattattattacactttaagttttagggtacatgtgcacaatgtgcaggttagttacatatgtatacatgtgccatgctggtgtgctgcacccactaactcgtcatctagcattaggtatatctcccaatgctatccctcccccctccccccacccctacaaggctctttgagttgtcccttatgttatccaccctgaagataattgccatattcccatccattggtgtcacatctctatgaaatcaattatgttctgcctggacttcctccaaattataacatgtagttcattgggtgtccttcttcttagtgtctatgccaaccctgtggtggggttaattcaaagtcctgaaatcttccatacaccctgtcatactacagttagccaaatatagctactacagactatgcccagtaaagtagaatccagaaaatacatttttcctgaaggaggcagaatcccttaagaattaataacaactttttcataatgttctagctagagttgtactttatgatagaattaactgcattcttttcctaaaacaaaaacaaaacaaaataaaaaacactgtctctaaattctccacaaaatgtatgtatctgagatgctactatgcaatatgtatttaagactgtcttgggctaaagataaaaactaataacagatgtccaacaccaggattttatattctgaaattctaactctagatttagaagccaaaatacagtttacttcaaatacactcttctaacagaaaaacatatgagaaaagaggagcaggctctcctttctatagttagaaaagtaaacatctctgaagtctgggtgccttaagggtgttattttgcccaccattctaggctgtgatatttttatcttcagaggaagaaaactaagtacagttttgctctttgtcaaactttaaatgtaatgtgatttgattatttataatccattctaagggtctgaaaaattccttgaaaaacatcagcattcggatagcagttttctaggtgttgttgaaagcaattcccatctccaatttcatgtttattttcaatcctggcaagtcagttctagcataaattttttaggtctgtggagccatataaatttgcatggctaacttggtacaagacagagactactgattaaatcaagctgagagctctgtaaatgctttttttaaaagcaactatagaatttcctgattgtagcactacaaaataaactttggaaactttgcactaaaaaggaagctacttggagtgaggtataagaaatctaaagttatcaaatacataacaaatcccctctccctgcctcccctattttttttaaacaggattcttcttttctgttatgaatcagtgtacttaggcttttaaaaaatctggctcacatcagatatgttccaagaagattctcaaataaagacattaaagcatgtaaaacaaaacagtagtagttctatggtgtttaaaggctcctgaccaataaaggttgtccactgtcttgtcttttcctgaaatctccagagaatgaacttgagttgaactcaaatatccacagatagagagcaaaaggatgaatcaataatagcctcttgagcttctctatcttcaacagttagttttattgaaggcacagagagccccagggtatcctctaatattaattaataataagggttttgatccaattgtgacatgtagggagtgcaggagggaaggagaggaagaagtcagaactacacctcgctatccaaaagcatgagtatacacatacattgactaatattaactgtgattacaggaagtctttaaaaataattgttgtggttagtaagtacttatgctaaaatcctgaaatcaaaaatggcttaaaatacaaggaagaaaaaaaacatttcgaatgccaacagtataagaccaaggaacaagtgaatttgttaatataactatttttaaataatctttggttctaaaatataccaaattcctaacaaaaacaattctcctacttcaaactaatggcccttattgaagaaagaagtgtgttacaaatatcaattaaatctaataaacataacatttcattttgggaaaaaagaattttctgggaaataagatttaagtggaaataaattttaacacaaatgttaaatttgaacataccattatgaggctaaataataaataattttctctttttaaaaaataattacctcttgaataaccaaagtaatatgctattctaaaatgtgtccatttcaattgcattcataaaatatttatactaagagaagatagctcttatttgtaagtctataagttcattaaaagaaaaatacagacaccactaagctcattcatgacaacttaattccgtgctttgtgtttactcagggaaataagtgatcatttggttagcagtatgagcacgtgatttatagtaacatcttcccaaatgtaaaattagtaatgttactaactcattggacaattttagacaagacttttagtccatttctgtgctatatgtatatataatataagtactatttttgcaaactattcatatgaaacatgaagctttactgtgtagctgagaatccaattcagtagtccaaagaaactgaccctgatcaataggtagaaagacctgaactcagattttgaagtttttcatggctattgctttcactgtattgactgttagactgtttcatataatacataaaacagaaagtcaagtcatttactaatttctgggcttaaattcagaatcttaaaaaatctaagtataaaatgttaataaaactttatagatttctctaaaaatatctactattgttctataaattatatgttgtaactatttaaaactgaatcatactccatgctcataagactgactatatcgctctacctaaaatgtaaggaaaccagctcatttaaaacccagaaatcaaaacatatcgtgtacctaataattatatacaccttctatcacccacaaaaattaaaaaataaaaaaattagaaaaaaacagaaatattaatttaaaaaattaagggtaatagttgtgataaagtacatcttctaatacgattctactaatgatagtaaatgaaataatattgcatctacacagcagcactacaatgaaacatcaatccaaacttcttctttttatttttatttttcattttttttttgagatggagtctcgctctgttgccaggctggagtgcagtggcacgctctcagctcactgcaacctccgcctcttggattcaagcgattctcctgcctcagtctcctgaggagctgggactacaggcacacaccaccacgcccagctaatttttgtatttttagtagagacagggtttcaccatgttggccaagatggtctcgatctcttgatctcatgatccgcccgcctcggccccccaaagcactgggattataggcatgagccaccatgcccggctcaaacttctaaatagctctcaaaccagcagaaaattaaaacagtttttgacttatgcaaaaccaaaagtttctcagatactggcacgttcagatttcagcatttccaggtttctatcacattcaaatgtataggtgtcatccatctacttcatagtagcctggaatcttttagttctgttctgtatttcacaattgatagtacacataatttaataaattaccaggagaacatgaccatattcatcttctacacacctacttttttcgacatcaaagagaatggaaagattatcaaaagatcttttccttttactgttattaaaacagtaataaatgaccatgattctcatggaattttaaccatctaaattgaagtacaagaatcctatggtgcataataccttttgaagatgattttatttataataaacagaaagaataagggggccatttatacataggataacatattctgggacagtctctaaggtcacccttgccataagttgacatgtggctataactgtattttattctaagtattcacattttccttataaatatagacaaatgattttacagtaaaaatgagaaaaagtacatatagcatacataatatattacggtactagacagactttaaaataaacattagtcagaaaaaatgaatattatgtgtttttcaaatacaatttttctaaagatctaaatctattacaaatgcatatattttaaaagcaataaaactttgaaaattttgtaataagaagaacagtgcaatcaaacaagagccccataatcatttcattcactatttttcagctgtcttcttaaactccttttttaaattcaatagactcctgttggataatttcataattccctatggattacaaaaccagaagttgtctataaaggtctctgaataattttataattcattatagtaggaatagaaattacctgtacattgccaaagccaaaatcaagttgatgtctacatgagatcagcaatattatcaaatgaaataattggtggttatctaagtgatatataacaagggttttgagaaaatactcaatttgctcatcaatgtctaaaattccaccaatgcagattagttattttttcttaagactattttatttttaatttatttttatttttgtttttattttttgagatggagtcttactctgtcacccaggctggagtgcagtggcacgatctcagctcactgcaaccttattctcccgggttcaagtgattctcctgcctcaacctcctgagtagctgggattacaggcacccaccaccacagccagctaatttttgtatttgtagtagagatggggttttgccatattggccaggctggtctcgaacacctgacctcaactgatctgcccgactcggcctcccaaagtgctgggattacaggtgtgagccaccgcgcccagccttcagactgtacctacttagtaaagggtaaggtagcattttaagcattggaagtaattcgtgtattatggcagatgattttattggtccttttattaatagcatacattgataggagaagggtgaaaatttgaagatacagaatggagtaaataagactaaagaaaacaaaccacctattgttaatttttagaattttagattagaaattggatacccaataaatagaaaggtattttctgttgggatatgtgtatgagagctaaaacataaaaaaaaaaattaacacaccaatgtattcaagtgtaacagagtatagttaaatgagatggcatacaaaatacttatcacagtgttgagaacttaaaaagggtgataatagcaacggtgatggcagtttctactgttataaccattataagattagcttctacgttcaatgtaaatgcagggaaacaaaatgtttggcttattttgtatttcttgacagtttggtaagtttatcttaatacactaaaatctttaaactttaaaataactgtatctcattttggccagacgtcatgaagaaacaattcatgcctcttctaagcactgtgagtagaagacagagcagaaatatctaggcagtaaggaaaaggattctggatttagattcagtggagctttgctcaattactgattttaccacttttaactatctgatctgagcaagtcttttaacatctctaagctttattttactcacctatattatggtgacattaacacttactctattttcccttcaaagaatattgcaaagcttgaaggataaatgttacaaaatgatttgagtattctggtgagagctgcagtcctttagtattatcattaagattttattcaggtacacaaaattttagaaaagttgtaatgaaaatctcactttttatcttcacagactatactagcttaacaagaagaacctcaggatgcctctctggaccacatttttctcatttgttaagcaatggggtactggatgatgtcacaatttcctcccatctctgaaattattatattacctagtaaaattcactttcctggattttttttaacctgaaaatatgagaagctgttgcaaactaatctctgaattaacagctgaagcacgcattttaaaaacctccagaacatgagattgaacctctacaacatctggtcatgtagagtaggttaagagtactaccatttgtgttttaagttcttcacgtattttctgtgacattttagctccttgccgtagagataagggttttcccactggtatagtgaaagggttagaagtgttcaaagttcagttattttttaatctaaattttcctttatatcctcaggtattatttgatacactattcaagaggcaaaaattaaaatggaatgattataaacaacaacaaaaagcaaaaagtatcttcacattttaataagtaagaacacataaccaggttatattgctgtaaaataaacctcaaaaaacacaaattaagatacctgtctccccttaaaacccttctttccacggatcccaggaatgccctagaatatagaaaagaaaaaggaaatatttgttgaatgaatgaattaggtactatagatctttttctcccaatataaagcaataaagtatgaaaaagacaaaaacaaattgttctataaactgatgtgatattcagaaaagcctcaatatattaatttaactgaggcagcccctttccttcttcaaaacaaaattctgcttttattcaggaatctatcccatctatacttccaaatgggatcttgacatttccctggtgatagctatttgtccagagacaggcatattaccaaagttggcacaactagatgaacacgaaggtcttattttccacatctaagggacaacgccctcctctctgccttcccctctctatctggatataaacaaggacacatttaacctgtgcactggcaatcttgcaatcatataggaaataagccttagggtaaagacaacattagaaaaggtaaagcagagagatgaatctacagcccacctaacctatggatttctggtcatgtaagaagcagtagggtacagtacttaagtacccaggctttggagccagacaaaaccttgtccaaatcctgggtctgctcttacttcctgtatatagtctaagacaaaatacttcctctgtgtgtgcctcattttcttcatctatgatgagaagaataacaatacctatcattcaataaatggttttatttataaagaagttaattcatgtatatatacacacatatatatgtttattaaaatcttcatgtatatatacatatataaataaagaagttaattcatgtatgtaaaaccatttattaaaattttttatatatatgtacatatataaaaccattcagtaaatcatttgctattttcatcatcatcattaaaaatatctttatatttaagccagtttgaattgtggttttctgttacttgcagattaaagcatcttacttgatactatcactttgagatttgcagactaagcagtctgtcacaaccatgtagcttgagattaatagtacatacaggtaagttagaagacatcactggctgaaacaatccattcactttcaagtcaacagtgtttaaaaaatactcatgtatctgatcatcaaaaaagagttcataggtgagcaagaggactcatttcattaagactttatgtatatttacataatacaaacaatcttttttaaaaaaatagaataattatttcctaaattttcagtagcctccctaaatctcatcaagaagccaaataatgcagacagaattatataagcatttttcatatatatacatgtatatatgtgtacatgtttcatatgtgtacatatgtgtatacacacaatatgcatgtaatgtacaatattgactcccagaaatgacttctttccatttgttttcagcaatagttagcattactctatcttattttcttctgcttttttgtacttaaacattttataacgtaacacccttttagctacatcattcacagttttaatgaaaattttgacatagccaaataatattaggacacagtacccgtgaggggcccaatatcacaaactgatcttgtgtatttatatgttaagacaggtcttgattttttttttttttgagatggagtcttgctctgttgcccaggctggagtgcagtggtgcaatctcggctcactgcaagctccacctcccaggctcatgccattctcctgcctcagcctcccaagtagttgggactacaggcgcccaccaccaggcccggctaattttttgtatttttagtagagatggggtttcaccgtgttagccaggatggtcttgatctcctgacctcatgatccacccgcctcggcctcccaaagtgctgggattagaggcgtgagccactgtgcccggccaggtcttgatattttcatatagactgctaaaaattagtgagtgtgattacagcaatgtgcctattgatggccagtgtcaacactgggcttaagatcattaaatccaagatgacaacattttacaaggacatataattttggtttattaaataatttacaagaaataagctcatgtcaaaggatcagaaaaggattgttatcacgaacagcagagtaattaacaacgtaaactggaaccattgggtcaagaagtagcagatcaattctctgcgtgatcggtgagatacatcctccgttagtttgctgtagtacatgaaggttaggtggcttagttgtggaattatgcttaagatgttttttgctattgaacaaaacaacttgctatgttcaccaggggaaaatctttacctcatctcaccaaagatggctagacattttgattgtcattacagcatatttaaactctttgattatttcttctctgcaggggcattcacaagtaattacaagaaaatataatttaactcactcactgaaaactatttatttgaaaaattcatttagcaatgaatctggttcactttcatttgcaaaaatcacttgccagaaatgaaaattttggcctgaactacattcttataatgataggggtgaaggctgaatgactctctaatttcaaattctatgacaatctactaatattgttcaattctactgttttcaattaatactggcaatgtaaatgaaggaatacaaagataaattactgcatacagattgcatatagcactgaaaactagatatgatgaagctgcaatgccataactcccataattaacttcattaatctttttagtataacaaaccattttgcaaaggttctatctttacttataagtacccatatttattaacagctatctcccattattaaattaaacaaaaatatatcttctgaggctaaattctttactgtatattgctctcaaaatcaagacctgtcaagaatttatactcttgacatatacttttgtaattcattataatgaattacaaaataaaaatttcataattagatattttaatattttggtgtattttcaaaaatttgaacttaaagtacaattatatttctatcatgctatattactttcctttaacaaaattcagtaagattttcaaaagtcaaattacatttctggcaggtgatttttcttcaacctggcttgctaactcagtaagattacttccctgacatctgattttatgacccccattgtacattatcacaagtatatcactttagaaatactatttgaagggaatggacttacccgttctccttcaggtcccagttgtcccgcttctccaggagagccaataaaacccttaaaacaagaaaatagtctgtatattagttcatttgaatattctccccataagtgattctgaatagaagtacttaaaattttatttgtagtagtacgaaattacaagacttacaagtgcgaataacttcccctcacctaattgcttttcttccagaagttaaagatcaatcttcccattaaaaattatacaaaatataatttaagaaatggtggctattaaaaataagcccaaataatttccttcactaaattttatagcgggcagaaaatatatgtatatgattagctaaaatttaagacagaatggaggtatcaaaagaatataagaatataagtataagaagtacagtggaggaagagatacatttcaatgtggcaggaggcaaaggcaatcaaagaaggcttcaaaggagattaccacttgagataggtctagagaataggtaaaatcttggtaaatagagacataataggaagtctttgttaatggtaacaattggggagtgtttgtaaatagtaattgatcacattttatacataatatactttgtgtgtaagatggttttatatgttagctttatgtgtaagacccaccctgccttaataaagattccaatctgatctgagaaacaagggatacatataaataacaatgcaaggcactttattctaatgtaacttagttatatctcacttgtgggaaataacccatttcatcaattttacagataaagtgtatggtagtttaggggctagattaaggagagtcttaaatttcagaataaaaattttagactgtatatattagacaaatggaagctactgattttagggagtatggtaatgcactgatgttatgctgtatttctaaaagattaatctgttgataggatacagcatacagccatgacaggaaacactgaatataggccaacctgttagaaggctctttaagtggtctaaatttgaaggtttacgggtccagatcactggttcaacaaacattattttagtagccattttgtgtctataaagatttggggtttataaagatgcatatgaaaatcaatgccctcaaaaagtacatagtttattgggaaagagggtcatacaaataaataactgtaacatcatttgataattgttacatgattatgcaataggtgatatgacaaatagacaatgggaactttggaagcagaatgaccaactttgcctagagagaagattaatggtgctttgctttactgaggaagcaacatttgagctaagtcctgaagaaaagaaaaggcagggctaacaatgtgccatcagtcaatcaatcagaatgaaatgacacagcatttgcaaagaattgcaaatagtctgtgtgattggtgggcaagaggtgagtttggaaagggtggcaaggggtcatgtcatgaagagtcttttttgttatgatggaaagtctgcaatttacactgtgagtcattaaaaaaacttaagacacagttttcatataatcatattttcactttataaattcacttggattacagtgggtcacataggtctctatctgtctataagaatcaagagaaagatgactctaaagtttacagctggactgatagacaaatgttaaccactgatagaaatatggaaaacaaatagaaaacctgagtttgatataaagaggatgagttttgttagttattttgaatttgtgattataatgagatattcaaatgtaattatcatggcagggagttgggagatgtggggttcatagaaaaagctcatagagaaaaaaagtctgaaggacagatatgtctgaagtcttaaagacagactaaagctttgaggagaaaatattaggaaaaattatcactgatcagacagagggtgaaataggggtgtgagagaagagtagttttatggatgcagagaaaagccaaagtttaaaagaaattgaagtagagatacagtaggtcaattttactaagttctaaataaaggtttcttattttgaatcacagaatgggtgatttttcagagtaaatacttccataataacaaatactgaagaattcaagcattaaaaaagtaattgttatttctatacccattccagcattattcacaattatcaaaagatagaagcaacgtaaatgttcattaacagatgaatgaataaacaaaatgttgtatatacatgaaatggaatattattcagccttaaaaaagaaggatgctgataactgccacaacatagatggaccttaaagacaattacgctaagtgcagtaagccagtcacaaaaggacagatagtgtatgattccacttgcatgatgtacttatagtagtcaaattcatacagacagaaagtagaatggtggttgccagggactgggagtggagaacggggaattgtttattgggtacagagtttcagtttgggaagatgaaaaaagtttttaagatggatggtggcaatggttgtacaacaattggatgtacttaaggccactgaccacatactttaagagggtttatacatggaaaaaattttatgttatatatattttatgttctttattttaaaaagaaagagataaatgtctcaagaatcatatctaagttgcctggaataaaacttttggaaggttttatttccttagaatttagttaagtattgccattaaaaaagttgccaccatccatcttgaaaacttttttaggtgtttttccttgtcaaaggtgcctgaaattgccttatgttccacagattgtatgaacaagcaaaaattaaaagaaaagagggagagagagaatttgttcctttatacataactttaataaagtgaaacatctatgattttcttacttgaaagccaagcagttggagaatgggaaatgtttcttttaaagtgaatcatacaaaagtatttctgatactagagcatttaggattatgatgacaagctgtgtacattttcagaatcatctgttgatgacttcaagtgtaaagtcagctaacatttgttttaatatatacaacaggagttttggttataaataaaaagaaaagacactctaactggtatatacttatcagtgaactaaataatcaattgataactcaagaactgaagtcagaactccaacatagcctgtacagagtgtaaagggaacattttacaattagatattttaaatagaataatgttataagtaattgcttaggtgtttcatagaggtttcttgatcatcattacactgattctaacagaaataagatgtcagcagtaccaaagaaaccacagagttgaggtcattctcaaaataccaccatgaaactagagtttaccgtgtaatgaaacaaagaacattaaaaataataacacatgtttttgctttttggtttgaaggttgtagatccagttagaagcaattttgtgtcaccagcaggaccaccagaaggtcgggagaggttctatatacttttacttttgggggcagctagcacattattacataaggaaatgccaaagaagggtttaaaaattatgatgtgttttaaacatttacatttgacaaaatatttctgctaataccaaaaaataccaacaaataactgccaatgaaaagctaatttatcatgattcatgaaaatattcatgtacaatgcataacatttagaatttaccagtaacaggacacaaattaagtgaaaaacatgtatcctatgagtgtgtttctatgatttttgcctttttaactagattttaagttaatgctaaaaatctatacttgataaagctgcaccctactacccactgatcttcgacaaagtcggcaaaaataaataattgggaaagaataccctgttcaataaatggtgctggaaaacttgctaaccatatgcagaagaatgaaattggactcctacctctgactgagttaatatataaaaattaactcaagatgaattaaagacttagtatgtaagacctcaaactataatcctagaagaaaacctaggaaatacccttctggacaccggcctaggcaaagaatttgtgactaaatcttcaaaagcaacaaatgtaacaaaaaatttggcaattgtaacctaattaaactaaaggtcttctgcagagtaaaagaaaccatcaacagagtaaatagacaacttacagaacaggagaaaatatcttcaaactatgcatctgacaaaggactaatatccagaatctacaaggaacttaaacaaatcaataagaaaaaaacaaataactttattaaaaagtggacaaaggacatgaatagacacttctcaaaagaagacatataagcggccccaaaacatgaaaaaatgctcaacgtaactaatcagagagattcaaatcaaaaccacaaggggataccatctcacaccagtcagaagagctattattaaaaagtcagaaaataacagatgttgatgaggtttcaggaaaaagggaacacttatacactgctggtggtaatgcaaattagttcagcccctgtggaaagaagtttggaaatttctcaaagaactaaaaatagaattaccatttgacccagcaatctcattactgggtgtatacccaaagaaaaataaataattctaccaaaaacacatctgcactcatatgtttattgcagtactattcaccatagaaaagacatggaatcaacccaagtgctcatcaacagtggactgcatgaagaaaatgtggtacatatagaccatggaatactacagtgccataaaaatgaacaaaatcctatcctttgcagcaacatggatgcagatggaggccattatcctaagcaaattaacacagaaacagacaacaaaatactgcatgttctcacttataaatgggagctgaacattgggtatacatggacacaaagacaggaaaaataaacactatagattccctaaggagggagggccagaaaaaggcaagggttgaaaaactacctattgggtactatgttcactgctttgacaacaggatcactaaaagcccaaacctcagcattacacaatatacccatgtaacaaagctgcacatatacccctaaatttcaaataatttttaaatctacatttgagaccctttatgaatgtgaaattccctccttattccaatcacactcccaagtgtgaaacctaactaaagtgtgaaaacttaactaaaagtacaacttaagagggttacagcctagaaaacaattttcaatacaaatgggaaaaggaaaaaacaaaaggatgtataatacaatgcaaaaatggtacatggaagaacacagttatatggatcactgaagcaagatgacaaaacgcagtaagagtaagttgtacagtgccaaatatattttgcatatattccttggagttactagttattgaacagaagacactctcaaattcaaataataattatagaatctatatagtaaatacatgcatacactatgccctataccttaagaatgctcatcttgtttaatttttcacaactacctgaaaagtaagtttcatcatgaccatttaataaataatgagataagaaaaatgaagcacagagagactgaataacatcaaaagtcacaaagctagtaaaagaagtattaaggggctgagcacggtggctcacacctgtaatcccagcactttgggaggctgaggcaggcagatcacaaggtcaggagttcgagaccagcctggccaatatgaatccccatctctactaaaaatacaaaaattagctgggtgtggtggcaggcgcctgtagtcccagctactcaggaggttgaggcaggagaatcacttgaacctgggaggtggaggttgcagtgagccgagatcacaccactgtactccagcctgggccatagagtgagactctgtttcaaaaaaaaaaaaaaagcctatctaactccacagcccatgttcttgaccactaatctcttctggcttcccaaatccaagtcaacatgtgttttcagtgcaatttctaataaaaagtacatgacttttcctcattatgtgattacttaatgcaagaacaaagacagcatgagctcatgaaaagaggtcagggctaaaggtgaaaagacattggttctagttctagccagctataactttgccagatcaagtaagttccttagcttactatttttctcatcagtaaaatggggatgacaggcctgttctcctacatcacagggctgatggcaaaataaaagaataaaatacatatgaaagtatttggaaatgtttaatacttttttaaaatgtaagacatcattattgcacatattgtttaaataccttatgctttacttctttttaaaaggcatgttaggccgggcctggtggctcactcctgtaatcccagcactttgagaggctgaggcaggcagatcacaaggtcaggggtttgagagcagcctggccaacatggtgaaaccctgtctctactaaaaatacaaaaattagcctggtgtggtggcacgtgcctgtagtcccagctacttggaaggctgaggcaggagaatcgcttggacccgggaggcagaggttgcagtgagcctagactgtgccattgcactccagcctgggcaacagagtaagactctgtctcaccaaaaaaaaaaaacacaaaacaaaaacaacaacaacaaaaaatattgcattttagataatataaggcacaaatgtagactttgaaaaatatttggctattaaaaataaagaattttaaaaacatattttttattttatacactacatatatgatatggtttggatgtttgtcccctccaaatcgcatgttaaaatatgattcctaatgttggaggtgtggcctggtgggaagtgactggattggggggcggatccctcgtggatggtttagcatcatctccttggtgacaagtgagttctcaactcacatgagatctggttgtttgaaagtgtctgggaccttccgtttttctctcttactcccactctcgccttgtgacattgtctgctctcccttcaccttccgctgtgactataagtttcctaaggccctcacaagatgcaaatgctggagccatatctgcatggactgcacaactatgagccaattaaacttctgctctttataaattacccagcctcaggtatttatagtgatgcaaaaagtgactaatacaatataatatagaaatgtttattttgcttccttagtgaataaaaatggctaacatttcctttaatggtttgggagtgaaatgggatgttctggatacaataaggttatttctttctttgtagatatttctttactcctgacagtttttgtataataaaatgatctcagccttgaactactatgaatttctttacctcttcatattttttccatgatgacttccttaggtctgtatccattcatatataaataacactacaaatgtttacagagcacattctaacatgccagacattatgctatggaaataaatataaaataatgatgcaaaacctaccacaatgagactgttttctgtcatcatagaagtgaaagcaactgcagtaagcaagtatattcaggctacatttgaattaaattcaaagctactaagagagtgtaaaaatgctaagtgttttatatatttcattctacttttaggcaagcatgcttaacagaatgatggaaatgcctacttacttgtgcacctttaggacctggattaccttctggtccagctaaaccctggtgtaaacaaaagacattgtcatcatactacagtactttttaaagagttaataaatagattaataaaaaggccatataaagagctatcattttcaaaactatagaattcagaactctgtataactaatgaagattaccaatgttcaaggaattttagaatttctgaatcaaaagaggcactggaaataatctatacacaatatattttagatatataaataaagtacattaacacattgtcagatttttaaaatttttttcattacattatttctcattggaagactgtgttgttttaaaacatttctaattaacttattctaaaagataggcccataaattttttttaaaatttattttaaactttagatcaatgtccatatatttacatattcatgttttatatttattatataacatatattatcacttgagagtaagagtctaatatagagtacctctaagtgtttttaaagtcctaaaaaatggaattttgttaacaatttttttcttatttccctcattcttgagaataaaaaagataaatgtaactttatacatttaattaattttagaagtaatcaattcatgaaaacttatgaaagaaagcttgttctattattaatctacatgaagtacagaaagttagaaattataagggaatacatttaaaatgattagaatgcattttaaaaatagtatacaaataactgaattcagttcagataaaagtgtttggtagtggtatactgtttctcaaatttttataactgtgttattaaaaaatgatgtttattacagagagtcttaactcttactattacttcattttgttcagtgacagtattgtaaaatcacaatcaggactgttttaagaacttattaacacttgtgcattttaattttgaaggttccattgtacatcacatcaaacatatttaaaatcccccttccaattttaaataaaactttctgaagaaaaattgtaatggatttctacaactttgattttgaaattatttctctatgagttattcattatttaataaaaaaactatttgaacattaattctcaaaatcagaaatacaatgtattaataaataggaacacaaagagaaaagtctaaatatagttactgcacctgcctgccagggtaaccgggtgaaccaatattaccagcaaatcctggaattccctgaaataataaataaaatgaacagtatagcaaagccaaaggaaacaaatttggtatatttacaatacacaagcttggaaataatttttccccataaaaatacggagtcctacacatggcttatgtaactgaaatcacctacgtgaaggaaaatggacaaaaattgctaaataaaatcagtaaactattagattagggccctaaatgatatatgatcattaataatcataaatctaggatggaaaaatccatactaaaacagacatttattctagaggaagagctggtatatttcttaattaccagtaacttttttaccagtagattgaattctttcttgtttcgatcatcctacaacactccttaacagtctgagcatgagccccagaagactaagaggggcagtaaaccacaaaaccaacctctacttctttcctaaagtaaacttaaccttacagtgagtctgattaagtaaatgaatattaagtggcaaataccgttatcatgacatgggtctgatccagtaaatttgaatggtgctgtggactgaatgtttgtgtgcctcaaaattcatgttaaaatcctaaccctgctgataatgcctaacagcattaggaggtggctctttggaaggtaattaggttggagccctcatgaatgggataaatgaccttataaagaggccatgtgagaatacaataaaaagtcagcagtctgtaatccaaaagatagcccccaccagaacctaaccgggctggcatgctgatctcagactttcagcctccagaattgcgagaaatttctgttgtttataagccacccagtctatggtcttttgttatagcagcccaaactgacttagacagatggtaaactcctttggaatttgcaatctgtattcttgatttaaaacaaggtttgctcagggaaggctgatagatggagacccaaaggcttaagaaaggaaaactgctacagaactgggtgaaaaagtgagacaaaatattataactttttttttaaaaaagactctttttcattgatacatcattcattccttcatttactcatcagtttattcagagtttgggtctattaaataattcttgacacaaggaaatgtcagaagaaagtgtgttgagctgatgacaacaatgtttaagttggctagatttcttatttatcacctaaaatttctttcctgtttgtttataaatgatataatggaagataattgcactttgtccttctgctctgaagtagatagaagagtgttaccttcactttaagtacagatatgctaaaacttctaaaaatttggaaaatctagagaaagaacagaccaaggaaatgaaaaatagaggataatagttgagtttcttctctctacttttttcagaattcatctctcacttttttccctctcatttctatctctcatttcctcttcccttcccttgatcaaaattaacatttactgagcactttttatttgctaagcgttttacatctatgagatacacttttcttcattctacatttaaagaacctaagatacacagaagtatgacaatggacaactgaagagaatgtgaataaacaatggccttctgaggattacagaagaaattcttgtctatatgtagagagattatatcctatgaatttcagaaaccatatgtatgtattaaatgttcccctattgatattaaatattatatatttacataatattttattcctataacatttattgagcacttatcatgggccaggcactatttcaagtattttatagatattatcttattcaatctactcaaaaaccctataagatagatatctttattcccatatgagagatgagaaaaaatgagacataaggtgtttatgtcaccaatgggaggatacttagctaataagtaggaagtcaggaattaaatcagcaagtctaattccagagaccaccattcaaaggcccgtctccctagtgtgagtttgaagtgcaaaaaacatccaatagcactccaaggaaagtcctctaattatgagatttgctctagtatatttacaaccaccttcctatatgccccatccaattccaaaacacataggcccacattctagagattcacaaaaccttatatttaggtatgccaacagaaaggagtaagacaaatgtaaaaggctgtttttattctgtaggccactatctatctggctaatgaaaaccaccatcccttttccattcctttcctagtcaaattaagttaactaacctcgataaaaagtcaatctgttatagaacataagtgaaatcctatttcgaatggattgtcacagagggtgttaaagcaacatgtagagatctagctaacacattttagctatgcagagaaagacacaaaagaattccactcaatgtctaagttctgctatactagaacagcagtaaacaaaataaacaagtaagacttcagcataatctttatatggcataaacgtattctgagccaaccacaccctagaatcactgagacaaccacagaaactcaaaagaaactcaaaacaaatatcatgacttaattcactctgcatttaaagatagatttttttaaaaagttggctcactcagatctgcagattggatggagtaatagagatacagttatatcaacagccccttgagaaaacaggaacagaaaattaggaagcctgccctaatctcacttaaaatacacattctgagtcagttagacttcattcagaattccggcactgctccagcactgctactatagtttctctgttttttcattagtaaaatagaataacagcactcattttgtggataaaatagaacaatgcgtagaaatatatttaaaagtggaagtaactgtaataactcttagtattggtgacattaagttaattaacatatgtaaaactgaataattatactactagaagttgtagttaatagtaatatagtttggcaaataataagggctgtaagtaaatgacagctcttattactagagctcacataaataatataattgcctttccaaatgtttgctgaacaatttgaagatatttacaaattttcaagacaaatgtcttccagcaagtcagctatgctcctctgaatgtccacagtattttcacaattaaaatgcaaaattattttagctgtttctcatagttaacacaaattttgcctgttttttttttctggaaacaaatagaatagaaaggaagaactgactacaatatacattttctaacctttaaaattggttttagactgttctaaaaagtatattaccctcagagataatatatacaccaccagtactagtttatggagcagttttgagtgaactcgtcagtaatgacacatggccaatttttcacttgtgaagtatcaggtttcctccattggaatccacgtttctgccaaagcagtaacctacaatttttttctccccagggactaatcccactcacccttctcatctttttctcccataaatgctcaaatgcttttcagtacatgtttgatttgcaggaaactgatattacatgtgttagagatacatatatcacttcgcttgccatgtctagtaattagcaatcttgaaaagttgtgcttcagggactgaacagagtgtactgtctaacttaacatgaatgaaagggaaaattggctttgtttcttcatttatagctttccctcaggtaccaaccatcacatttcttcctggatctccctttagggtttcctgagtctctgtgctgattctttaataacggtatccatcaccttagtcagtttctaatatcttacccttttcactgttatattcatattatattttcaatatagtacacaccataagacatatgactttatttttttctgtgacataatgatatattattttctgatgagagaaaagcaataacatgatcaaaaactaaatagttccaaaactattttgacttttaaatattgtgtatgtgtattatggacaatgatatatgtaccattctaatttggactgttattgaaatttatttgcatttcctcaggaaaaggtcagggaacaaacagctatggattaggctttagtgaactggtaagttcctgacattgtacaaaaaaaattaagtctctctctctgtgtgtgtgtgtgtgtgtgtgtttgtatgtgtatggatatgtatattttctgggaaaggattcatagtatttatgagactctcaaaggggtctgtgaactacagaagtttaagagctactagtctgaaacatatggggcaaaagtaaaaaatgattaacagtgaaatattatgttatagttttttaaataaaaagatctacagctaatcaattaaaaggttgtcctgcactaaacagagtaaaaaatcactgagaagaaaaattgaaaaaatgggggaaaataatctctcaaaggagttctctaacatgtgtctttttcacacatgatacaagtcttataaaggaagtacctacttgttcacctggaagtcctgggagtccaggatgtcctttgagaccctgtaaaagaataagtggagacatgctatgaaaagtaaactcatataagccaaataacgaaacataggttgcaagttgccttatatcccaacttttggttgcctcatcaatacaaatttaattgttactaatttatttcttattaaatttaatcttctttatttaataagaattacttttttattaaataaaaaattaattcttattaataatttaatcttgcatgttattttaatgacttgttattatcaactaaaatggtagcatagtactgaatagagactaaagcacagtatcttttataaaaggctcatatctagcaatggatatgttaagtttgctgaagcttttaaaaagttagttttagttgaatagtgctaagacaaatggcctcagacataatctgtttgtaattattgaaaaactggatcatatccaggcagttcctctaacccaaatcattgtcataacaccccatgaatgaggtaactcaaaaaatcatgaggctgcttacaggttcatcaaaaggggttctataaagttgtctagggaattagtaacaaagaatattttccaaataatagaagcaaaagaaaatcttaatctctataaattaacacccaaagctataaaacagacaatatccttcttcctcaagaaagatataggagcaaaatgaaggaaactaaaagaaaggatggcaagaatgaaataaagaaaaattttggagcttatttgtacagttctacataaaaatcagtggtttgatctactgtttaccaaaggattttggtgcatataaagaacaaaagaaattccttttcttaaggacttaaaatataattcaaaagcctgaaataaatcatagtttatgaatatcaaaaatttccaattaatatactgcaaactaaagacaaatttcctgggtttcagaatatagcctaatggagtgaaagaattactcagtattaatcactgagggtttatcagaagagatgaattcggattaatggattagagaagggaatgacgctttggttgaaaaacgtcatttagaagaggtgcctatttgaaaactaaaggaatgatttcaacagcttttgcgatgttaaacttaaaacagtttaactgtttttacatttttaaagggagttcaagattagcctaattacataacatattacatattgtgctcagttgcccaaatgtttacacaaaattccacaagtaaaaatatccacaaagctaagttttttcactttttacaacaggagataagaaacatcctcagcgctaagacagtggtggtggctccctgggatgaggcagcagctctaggagggtgtgagctggaagtttcctggaggatgacaaataaagagccagggtaggaggctcataggttacagagactctgccatgagcctatttccttttcctatttttttaaagtgtgtgtttatttatttacttattttaaattctgtgaatccttgagcctagctacatgcttgattttctttggccaacacctgtttttcagatcagagttagtttcctccctagcctataatgaaacaaaatgcaatcgtggcacaattttattttagcttattttccccaaatcactccataatagtgaactatgtgtatatatgttaatcatggtatcttttttatgcacacttctctttaaagggattcttcttcattcagagaccctgacaaggtggcagcaccatgcagtcatgatctgttttttatgaacttactccttccccacctcagccccaggacttgacagttaatctaagggaggacaatataagtcaggccagtagcctataaaatgacttggaataaagagttttatttaaataaaaacaagctgggccaggcaaatggcattcctgtagtccagctactcaagatgctgaggtgggagggttgcttgagcccaggagctaaagtccagtctgagcaatatagcaacctctaaaaaaaaaaaaaaaaaagagagagacaagctgggccaataaaaatctcttttttaaaaaaatgaagttgattaaaacaacaacaatagaaaaatgcaagtacttaacagtgggggtaggagggagctggaaagattcacaaagaaagactaagaggaagagtagggtcgctgagatgctacaggaagccaaagtatacacaaaaattaaaattgaaattatgttaagacagttgtcagaggacaagataacacaaaaaagcagatgcagagaaagtagataagcactggtagaaaagtacaacaaaagattcacaaactaatgctgctaagataagctgctttgaatcagtgtgtatgtcagaccaagtcatattacagtacctagttttagattccatgggatccctgtttccttattgctgcagacaggattgaaataactcactcttttccttgaaatatcctaagtctcctttttttttttttttttttttttttgaggcagagtctcgctctatccctcaggctggagtgcagtggcacgatctcggctcactgcaagctccgcctcccgggttcgcgccattctcctgcctcagcctccggagtagctgggacttcaggcgcccgccaccatgcccggctattttttttttcctgtatttttagtagagatggggtttcactgtgttagccaggacggtctcgatctcctgacctcgtgatctgcccgcctcggcctcccaaagtgctgggattacaggcgtgagccactgcgccctgctaaaatatcctaagtcccctttctacgcaatccgaagagcctaagtaaagcaatttttgtttgtttgctttactgataataacaatgaacagatcaagccatcttgatctgttctagatccagttttaccacaaactagccatattgtgaacctcaatgtcttattttgtaaaatgacagcattcaattaaattattgctaattttttattgcttaaatcctgtgaatactggaatctatcagaaagtaactacttttttcaatgtagctgtcactgaataaaaaacaaagcagatatgagttacttcaggaaggccgggcgcaatggctcacgcctgtaatcccagcactttgggaggcagaggcaggtggatcatctgaggtcagtagttccagaccagcctggccaacatgatgaaacccgtctctattaaaaatacaaaaaaattagccaggtgtggtggcgttttcctgtaatcccagctacttgggaggctgagacaggagaattgcttgaacccaggaggcagaggttgcagtgagccgagattgcgccactgcactctagcctgggtgacagagcaagactccatctcaaaaaagaagaaaaaaaaaaaaagagttacttcaggcttggagacataggaaggaagaattcacgtaaggtcagtggacatatcaggctcccacggggcacttctttaatgctctaaaacaaagatgggactctggagtgggcaaaatggaagagagtgggttgggtaggaggctagtatgacagtctaggtcaaagataattataagttagcctaggatagtagagtaaaaatgatacctaagcccttgaaaaagcttaagcttaatttaagttactgtactcactgtggtgtccccagtgcctggtacatagttgttgcttattaattaactggtggacagacatggatggatgaatgaatgaatggatgagtgaatgaaaagacttggatgaatttaagaatcacttaggtagaaaatagattctatgtatttaatatggtaactctattatccgaatgttgaaatgaaaggtgataaatagaataaagacttcctttttgttattttaaaatatatatttgtaatatactgaagttatctccactattatataaagactttcatttattcccatatgcctcatttattttctacttaaaaactagtctgtaaagtttttaaaagcaaaggggatacattccttggaaaactgcctacatgcaagctttggcatagctccaatctagggattttattttaaaaactagtatttgagtcattattttctatactcatacaggaagaataacaaaaaagtttccataactagcatatgatttttctctgattagcattctgaaaactgaatacattccttaaggaatgacaataggaaaatttacaaattgtttcaattcagatttaaaacacattacaatgaattacagaattgtctttaatttttgttgtaatataaaatcagtttacaaaggagggcagagcaagatggcaaaatagaagcttacgctattcgtcccctctccaacactggaacatcaaattttaacaactatccacacacagaaaaccacagtcacaagaagcaaaaatcaggtgagcaagagcaatcacagtacctggttttaacttcatattgtggaaagaggcactgaggaggacaagagatacagtcttaaatagtgaatgccacccctcccccatctcccctggcagcagccctgcagtgtggagagagaatctgtgcactctaggaagggaaagcccagtgactgggaaactttacattgaactcagtgcttccctggcacagcgggaggatttggaccagccctagccagaagggaatcgcacatcctcaaggaacttgagtttcttggcaagccttaccaccatgggctgaagtactctggggtcctaggtaaacttcaaaggctgtctaggacacgacaactgcaaatcctaggctattcctagtgctaggctgggcttacagccagtgaactagggtggaatgtgaactaaggagacaacagctggcatggctaatggagtgtgagcaccattccttccctaagcccaggcagtgcagctcataacaaggaaagtgactcttcccttctgcataaggagagaagagtgaagagtaaagaggactttgtttggcatcttggataccagctcagccacagtgtaatagagcaccaagcagagacgtgaggcccccatttgaggccctagctctgggataacatttctagatgcactctgggtcaaaagggaacttcctgctttgaagggaagggtctagtactggcaggattcatcacctgttgaccaaagagcccttgggccctgaataaccaccaatgatacccagtgagtgtgctgtgggccttgggctctgaaacatgctggccttcaggggtggtccagtacattccagctgtggtggtcacagtgaaagactccttttgtttgagaaaagcaaagggaaaaagagacgggattttgtcttgcaccctatgtaccagcttggccacagtagggtagggcaattagcaggctcttggggtccttgagaccaggactaggatcttacacagcatttctggaccgtccctactgtgctgaaggatgagtcacagtcctggcagcattcaacacaagctgatggaagagagcccttggcctttaagtaaacattggtgaaagcctagcagaaacccccatggactagtggtggtggccacagggaaggactcatctgcctggggaaattgctggaaagagtaggaaggactctgtattatggtttgaatgggagtttagccatagtagagtagaacagcaggtaagttgctaatgtctttgacttcaatcactggctcccacacagcatccttggacacaccctgggcctggggaaaactcatcactatgaagggaagggctttgggtgaggcccagtagctcatgtctgacccagcacagttccagtggtgacggccacagggtgcctgtatctccacacccacagttccagctggcccagcaaagagagagagagagaggagagactccatttgtttagaagaaattaagagaaaagaacaagaatctctgcttggtaatccagagaattctttcagattttatgtaagaccaccaaggcagtacctctacaaaaaccacagcgatattgggcttggggcccaagtcccttcaaacacttggaaagccttcccaagaaggacaggcacaaacaagcccagactatgaagactacaacaaatacctaactcttcaatgcccaaacaccaatgaacatctacaagtaacaacaccaccacaaaaacatgatctcaccaaatgaactaaataaggcacggggccaattcttgagaaacagagaaatatgacctttcaaacagagaattcaaaatagctgttttgaggaaacccaaagaaattcaagataacacaaagaaggaattcagaatgctgtcagaaaaatttaacaaagagatagaaataattaaaaagactcaagcagaaattccacagttgaaaaatacaactgaatgctgaagaatgtatcagagtcctttaaaagcagaattgatcaagcaaatgaaagacttagtgagcttgaagacaggctatttgacaaaacacagtcagaggagacaaaagaaaacagaataaaaaacaatgaagcacacctacaagatggaaaacagcctcaaaagggaaaatctgagagttattggccttaaagaggaagtagagaaagagataggggtagaaagtttattgaaagggataatatcagagaactccccaaacctagagaaagatatcaagattcaagtacaagaaggttatagatcaccaagcagatttaacctaaaaagactacctcaaggtatttaataatcaaaccctcaaatgtcaaagattaaaacatgatcctaaaagcagtgaaagaaaagaaacaaataacatactatggagcggaaatacatctggcagcagacttcacagtggaaaccatacaggccaggagagagtggcatgacatatttaaagtgctgaaggaaaaaaacttttaccctagaatggtatatccagcaaaaataggctttaagcatgaaggagaaatagactttcctagacaaacaaaagttaatggattccatcaacaccagacctgtcctacaaaaaatgctaaagggagtcattcaatcagaaaaaaaaaagaatgttactgagcaagaagaaaccatctgaaggtacaaaactcactggaaatagtaggtacacagaaaaacacaggctaatatagcactgtaatggtggtgtgtaaacttctcttgaattaagtggaaagattaaatgaaaaaccaataaaaaataataactacaactttacaagacatagacagtataaaaagacaaagaaaaacaacaaaaagtttaaaaatggggaaatgaagttaaggcatagagtttttatcagttttctttttacatgttttttggtttatgcaatcagcattaagctgtcatcagtttaaaataatgggatataagatagtatttgcaagcctcatggtaacctcaaaccaaaaaaacatacaacagatacataacaaataaaaagcaagaaatcaaagcatactactagataaaaatcaccttcactaaatgaaaaactggaatggaggaaagaaggaagagaagaccacaaaacaaccagaaaacaaataacaaaatggcaggaataagtctctatttatcaataataacattgaatgtaaatggactaacctctccaatcaaaagacatagagtggctgaatgaatgaaaaaacaagttccaatgatctttgcctataagaaacacacttcacctatatacacatagactgaaaataaagggataaaaaaagatattccatgccaatggaaacgaaaaaagagcaagaatagctatacttatatcagacaaaacagatttccaaacaaaaactataagatgagacaaaggtcattatattataacaaaggggtcaattcagtgagaggatacaatgattgtaaatatatatgcactaaagcacccagataaataaagaaaacattactggagctaaagagagagatagaccctactacaataattgctggagacttcaatacctccactttcagcaagactgggactggttagtcagtgggtgcagcccatggagggcaagcagaagcagggtggggtgttgcctcacccaggaagagcaaagggtcagggaactccctcccctagccaagggaagccatgagggactatgccttgtgggacagagctatccagccaagatactatgcttttcccacggtctgtgaaacctgcagaccaggagattccctcggacgcctacaccaccaagggcctgggtttcaagcacaaaactgggcggccatttggggagacaacgagctagctgcaggaatttttttcataccccagtggcacctggaacgccagtgagacagaactgttcactcccctggaaaggaggctgaagccagggagccaagtggtctagttcagtggattccacccccacagagcccatgaagctaaaatccactggcttgaaattcttgctgccagcacagcagtctgatatcgacctgggatgcttgagcttggtggggagaggggtgtccaccattactgaggcttgagtaggtggttttcccctcacagtgtaaacaaagctgccaggatgttaaaactgggtgaaagctgctattgccagactgcctctttagattcctcctctctgcgcagggcatctctgaaagaaaggcagcagccccagtcagggacttatagataaaactccctgggtcagagcacctgggggaaggggtggctgtgggtgcagcttcagcagacttaaacattcctgcctcctggctcagaagagagcaacggatctcccagcacagcactcgagctctactaagggatagactgcctcctcaagtgggtccctgacccccgtgcctcgtgattgggagacacctcccagcaggggtcgacagacacctcatacaggatagctccagctggcatctagtgggtgcccctctgggacaaagcttccagaggaaggagcaggcagcaatctttgctgttctgcagccttcactggtgatacccaggcaaacagggtctggagtggacctccagcaaacccgcagcagagggatctgactgttagaaggaaaactaacaaacagaaagaaatagcatcaaaaccaacaaaaaggatgtccacacaaaaactccatctgaaggtcaccaacatcaaagaccaaaggtagataaatccacaaagatcaggaaaaaccagtgcaaaagggcagaaaattccgaaaaccagaacgcctcttctccagaggatcacaactcctcgccagcaagtgaacaaaactggatggagaatgagtttgacaaactgacagaaggaggcttcagaaggtgggtaataacaaactcctccaagctaaaggagcatgttctaacctaatgcaaggaagctaagaaccttgaaaaaaggttagaggaattgctaactggattaaccagtttagagaagaacataaatgacctgatggagctgaaaaacacagcacaagaacttggtgaagcatagacagtatcaagaatcaaaccaatcaagcaaaagaggatatcagagattgaagatcagtttaatgaaataaagcgtgaagacaagattagagaaaaaagaatgaaaaggaatgaacaaagcctccaagaaatatgggactatgtgaaaagaccaaacctacgtttgattggtgtacctaaaagtgacagggaagatgcaaccaagttggaaaacacttttcaggacattatgcagaacttccccaacctagcaagacagaccaacattcaaattcaggaaatacagagaacaccacaatgatactccttgagaagagcaaccccaaggcacataattgtcagattcaccaaggttgaaataaaggaaaaaatgctaaggacagccagagagaaaggtcaggttactcacaaagggaaccccatcagactaacagcagatctctcagtggaaaccctacaagacagaagagagtgggggctaatattcagcatgcttaaagaaaagaattttcaacccagaatttcatatccaatcaaactaagcttcataaatgaaggataaataaaatcctttatagacaagcaaatggtgagagattttgtcaccaccaggcctgccttacaaggagggagcattaaatatggaaaggaaaaatcagtaccagccactgcaaaaacataccaaattgtaaagaccattgacaccataaagaaactgcatcaattaatgggcaaaataaccagctagcatcataatgacaggatcaaattcacacataacaatattaaccttaaatgtaaatgggctaaatgccccaattaaaagacacagactggcaaattggataaagagtcaagacccatcggtgtgctgtattcaggagacaaatctcatgtgcaaagacacacataggctcaaaataaagggatagaggaatatttacctagcaaatgaaatcaaaaaaggaagggttgcaatcctagtctctggtaaaacagactaaaccaacaaagatcaaaaaagacaaagaagggcattgcataatggtaaagggatcaatgcaaaaaaagagctaacacttctaaatatacatgcacccaatacaggagtacccggattcataaagcaagttcttagagatctacaaagagacttagactcccacaccgtaatagtgggagactttaacaccccactgtcaatattagacagatcaatgagacagaaaattaataaggatatttaggacttgaactcagctctggaccaagcagacataatagacatctacagaactctgcaccccaaatcaacagaatctacattcttctcagcaccacatcacacttgttctaaaattgaccacataattggaagtaaaacactcctcagcaaatgcaaaagaacagaaatcataacaaacagtctctcagactacatggaaactgaacaacctgctcctgaatgactactgggtaaataacaaaattaaggcagaaataaataagttctttgaaaccaatgagaacaaagacacaatgtaacagaatctctggagcacagttaagcagtgtttagagggaaatttatagcactaaatgctatagggaaagatctaaaatcaacaccctaacctcacaattaaaagaactagagatgcaagaccaaacaaagtcaaaagctagcagaagacaagaaataactaagatcagagaagaactgaaggagatagagacacgaaaaactcttcaaaaaatcaatgaatctaggagctggtttctaaaaaaagatcaacaaaatagatagaccactagccagactaacaaagaagaaaagagagaagaatcaaatagacacaataaaaaatggtaaatgggatatcatcaccgatcccacagaaatacaaactaccatcagagaatactataaacacctctacacaaataaactagaaaatctagaagaaattgataaattcctggacacatacaccctcccaagactaaactaggaagaagtcaaatccctgaatagatcaataacgagttctgaaattgaggcagttattaatagcctaccaactaaaaaaaagcccaggaccagatgaattcatagccgaattgtaacagaggtacaaagaggagctggtaccattccttctgaaactattccaaacaatagaaaaagagggactcctccttaactcattttatgaggccagcatcatcctgataccaaaacctggcagagacacaagaataaaagaaaatttcaggccaatatccttgatgaatattgatgcaaaaatactcaaaaaaatacttgcaaactgaatccagcagcacatcaaaaagcttatccaccatgatcaagtcagcttcatccctaggatgcaagactggttcaacatacacaaatcaatcaacgtaatccatcacataaacagaaccaatgacaaaaaccacatgattatctcaatagaggcagaaaaagccttcaataaaattcaacagcccttcatgctaaaaactctcagtcaactagatattgatggaatgtatctcaaaataataagagctatttatgacaaacccacagccaatatcatactgaatgagtaaaagctggaagtattccctttgaaaaccggcacaaaacaaggatgccctctctcaccacttctattcaacatagtattagaagttctgaccagggaaatcaggcaagagaaagaaataaagcataatcaaataggaagagaggaagtcaaattgtctctgtttgcagatgacatgattgtatatttagaaaaccccatcacctcagccccaaatctccttaagctgataagcagcttcagcaaagtctcaggatacaaaatcactgtgcaaaaatcacaaactttcctatacaccaataatagacaaacagccaaatcatgagtgaactcccattcacaactgctacaaagagaataaaatacctaggaatacaacttacaagggatgtgaaggacctcttcaaggagaactacaaaccactgctcaaggaaataagagacaacacaaacaaatggaaaaacattccatgctcatggattggaagaatcaatatcatgaaaatggccatactgtcccaagtaatttatagattcaatgctatccccattcaagctatcattgactttcttcacagaattagaaaaaactactttaaatttcatatggaaacaaaaaagagccctatggcctagacaaccctaagccaaaagaacaaagctggaggcatcacgctacctgacttcaaactatactataaggctacagtaaccaaaacagaggcctcagaagtaacaccatacatctacaaccagctgatctttgacaaacctgacaaaaacaagcaatggggaaaagattccctatttaataaatggtgttgggaaaactggctagccatatgcagaaatctgaaaccagaccccttccttacaccttatacaaaaattaactcaagatggattacagacttaaatgttagacctgaaaccataaaagtcctagaagaaagcctaggcaataccattctggacataggcatgggcaaagacttcatgactaaaacaccaaaagcaatgccaacaaaagccaaaattgacaaatgggatctaattaaactaaagagctctgcacagcaaaagaaactatcatcagagtgaacaggcaacctacaggacaggagaaaatttttgcaatctatccatctgacaaagggctaatatccagaatctacaagaaacttaaacaaattcacaagaagaaaacagacaactccatcaaaatgtgggcaaaggctatgaacagagacttctcaaaggaagacatttatgcagccaacacacatatgaaaaaaagctcatatggtcattagagaaatgcaaatcaaaaccacaatgagataccatctcatgccagttagaatggtgatcattaaaaagccaggaaacaacagatgctggagaggatgtggagaaacaggaaagcttttacactgttggttggagtataaattagttcaactactgtgaaagatagtgtggcaattcctcaaggatctagaaccagaaatatcatttgacccagcaatctcattactgggtatatatccaaaagattataaatcagtctactataaagacacatgcacgcatatgtttattgcagcactattcacaatagcaaagacttggaaccaacgcaaatgcccatcaatgatagaatggataaagaaaatgtggcacatatacaccatggaatagtatgcagccataaaaaaagatgagtccatgttctttgcagggacatggatgaagctggaaaccatcattcttagcaaactaacccaggaacagaaaacaaaacactgcacgttctcactcaaaagtgggagctgaacaatgagaacacatggacacagggaggggaacatcacacaccagggcctgtgggggttggggggctggggagggctagcattaggagaaatacctaatgcagatgacaggttgatgggtgcaaaccactatggcacgtgtatacctatgtaacaaacctgcacattctgcacatgtatcacagaacttaaagtataattttaaaaaaattaaaaaaagaaaactgcaggccaatatctctgataaatattgatacaaaaatcctcaacaaaatactcacaaactgaattcaacaatacattaaaaagatgactcattatgaccaagtgggatttatctcagggatgcaaggatgattcaacacacacaaatcaatcactgtgatatatcatatcaacagaatgaaggtcaaaaaccatattatcatttcaattaatgctgaaaaggcatttgataaagttcaacaccccttcttggtaaaaaaaataccctcaaaaactggatataaacggaatataccttttcataataaaagccatatatgatagacccacagctagtatcattctgaatgggaaaatactgaaagcttttcctattagatctggaacacgacaaggatgcccactttctccactgttattcaacatagtactgaaaatcttaactagagcaatcagacaacagaaaaaaaataaagggcatccaaattggaaaggaagaagctaaattatccttgtttgcagatgatatgaagttatagctggtaaaacctaaagattccaccaacaaaacaaaacctattagaactggtaaacaaattcagttaagttgtagtatacaaaatcaacatacaaaaatcagtaggatttcaatatgccaataatgaacaattggaaaaagaaatttaaaaagcaatcccatttacaatagccacacataaaataaactaggaattaaccaaataagtaaaagatctctataataaaaactataaaacactgatgaaagaaattgaagaggacaccaaaaaatggaaaggtattccatgttcatgaattggaagaatcaatatttttaagatgtccgtactgcccaaagtaatctacagattcaatacaatctgtatcaaaataccagtaatattcttcatagaaatagaaaaaagcaatcctaaaatttatgtggaaccacaaaaacccagaatagccaaagctatcctaagcaaagagaacaaaactagaggaatcacattacctgatttcaaattatactgcagagctacagtaaccaaaacagcatggtaccagcataaaaacagacacacagacaaaagtaacagaatagagaacccagaaataaatccacacacctacagtgaactcattttcgacaaagttgccaagaacagacattgaggaaaagacactcttcaataaattgtgctggggaaactggatatccatatgtagaataatgaaacttgatccctatctcttgccttgtacaaaaatcaattcaaaatagattaaagacttaaatctaaaacctcaaactatgaaactactacaagaaaatattggggaacctctccaggacattggtctgggcaaagatttcttcagtaatacctcacaagcacagccagccaaagcaaaaatgaacaaatgggattgcatcaagttaaaaagtttctacacagcaaaggaaacaatcaataaagtgaagaaacaacccagaaaataggagaaaatatttgcaaactacctatctcatgagagatgaataactagaatgtagaaggtgctcaaacaactaatcaagtaatccaattaaaaatgggcgaaagatttgaacagatatttttcaaaatgagacaaggaaatggtaaacaggcatataaaaaagtgctcaacattattgatcatcaaagaaatgcaaatccaaactacaatcttaccccagttaaaacggcttatatccaaaagaatgctggcgaggatgtggaaaaaggagaatcctcatacactattcatgggaaggtaaattagtacaaccattatggaaaacagtttggaggttcctcaaaaaagtaaaaataaaactaccactggatttagcaatcccactactgggtatatacccagaagaaaagaaatcagtgtatcaaagaggtatctgcactcccatgtttgttgcagcactgttcacaatagccaagatttggaagtgacctaagtgtccatcaacagatgaatggataaagaaaatgtggtacatatacacaatggagtactattcagccatacaaaaaataatgagattctgtcatttgcaacagcatggatggaactggaggccattaggttaagtgaaataagccaggcacagaaagacaaacatcacatgttctcacttatctgtgggatctaaatatcacaaaattgaattcatggagacaggcaatggaaggatggttatttgaggctgggaggggaataggagatcaggcggaggtagggaagggagcatagttaatgagtacaaaagaatagttacaaagaatgaataaaacctagtatttgctagcacaacagggaaactatagtaaataataatttaattgtataatttaaaataaatagagtatcattggattgtttgtaacacacaggataaatgtttgtgaggatggatatccaattttccatgatgtgatcagtatgcattgcagcctgtaccaaaatatgtcatgcaccccatgaatatatacacttactatgtacctacaaaattaaaataataaataaataaattgcctcagcaagaattccaataataaatgaagcctataatctaattttatatagacttcaattttaataaatatgttaacaaaaatttgagccctaaaaatatgttatcaatacgttaccacacaggacaaataaaaagacacaattgaatcaaaatcagaaatattagtggttacaaaataaatcagtttcaaactactcccagtaattaagatttgaatatataaataaaatgtttaatcataaggaaaacagtagtatcatttatacacagatcctcctcactttgcactatagtataggaccataaaaataactgtgcaagctgaaattgtacaatgcaatcttaataaccaatgggaaaatttacaattgttccatgacctttaaatatttttgttaaagtgttaaaaactctcttactgttggttatagttgcacggggaaataaaaaaattatagtagtattaatttagcacagtataattgaaaacattagaaattaaagcatcatttatttgaaaaaaattatcaaaattagtttgaaagtgtttgccttcttgttgttgtctaaattatcacactaagcaagcatatttcctatgccttggcaaattgtcatactcgcttctaagtatggatcaattcccaacattttatcctttgcactttcaatgtcatgaaatatttccaagaattcttctaatgtgaagttttttttttttgaaagtgtcacttcctctggaacatccttgtcctattcatcactactactttactcatttatgtctaaaagttcacctgcaataaatttccctggctgcatatgtagaatcttaaatgtcagcagtgtctcatgtccagctatttgttttaaaattcctatgttatcactactcctttatttgctgttctttcatctttgttagctaatacttcttttgattattcatctgtgtaaaatatcacataggtttatcactgcaaaacaaggaagcaacgcaactttactgtctgtacatgattgaagaatcaccaacagactgaatgaaatgacttgtctggtaattggtcacgatgcactccattacttatgtagtgatttgtggactaaagggccagtagcaaagtctgtactttatgtagttaatcatacttaatatactgtggcaaatgaaatatgaattgtgttgttcgggaactgacgctatgtaattaaattgtggtaaccaaaatatatgtatattggaaccagacaaagtaaggactgcctgcatatttatataatgttgagaattattctcaatgcccttatgttattaagtttatatatcaatggtttgctccttttaaaagtttcctcttctcccattaaatgggaagaacttatattcatggggataaagacttttccaacatatgagaaactattctacatagcacaaggcagcttctgtataatcacccccactctctatcataagcctcctttcacaaacttttaggtttcagaaatgtagaagcatatctctcgaactcataaaaatgctaaagaaattctggagactaaaggatttgcctctggcactccccttcttacaatcctgtagtacctctctactacataataatatactctacatgctttaacatggcctataaatccctttataatttagtccttcaatactcctcaagctttatctcttgacacctcctccctcacacttcatgattcatgaacaaagaagtgcttcttacctctcagcctttgcttatgcattatctatgtgtagatagcatacttgtccactaggtgcagtatcattaggataacttctgctcatcctcaagaatcatcttagatgtcacctctttccctgattcctgtatccatccacctttcacctccaggaagtttatgtgaacctccactatgtactataataatcctttcatatcttcataatcacacttgccatagcataatttatttacgtaatatataaatataataatttgtatatatttatataaatatataacatatatttatatatactgtaataatttatatatttacataatacataaatacaatttacatatttatataatatataataattaatttattataatactttaatgatttacttttgtataggttacatatcccttgcctgaaatgcttgggaccagagtgttttggattttgaaatttttcagattttggaacatttgcattataccacttgagactcccaaatctgaaaatctgaaatcttaaatgctcccagtgagcatttcctttgagcatcatgtggacgctcaaaataattcggattttggagcacttcggatttcaaatttttagatttaggatgctcagtctgaattttaaagacagtaaactggccgggcacggtggctcacgcctgtaatcccagcactttgggaggccgaggcgggcgaatcatgaggtcaggaaatcgagaccattctggctaacacggtgaaaccccgtctctattaaaaatacaaaaaaattagccaggggtggtggcgggcgcctgtagtcccagctactcgggaggctgaggcaggaaaatggcgtgaactcagaaggcggagcttgcagtgagccgagattgcaccactgcactccagcctgggcgacagagcgaggctccgtctcaaaaaaatatatatatataaataaataacctacttgaaggcaggaactatatatatcatatatatagttgatatatatatatatcaactctgtatcatatatgtatatcatttacataatagtggtttgctgaacaaatttcaggacaaaaagatgtgactaaaacaactgcagaattttagggttagttacagaatttatctgaggaagaaaactgcccttttgtttgaggcaactttcctggatcttttgcctctgtctagtcttgggaagctgaggcaaaggtggactaacaatcgcgcataatcatgtaaaaggcaacatcactgagtgatgagtaacaggttaactagttctacttagctaacctgaaataaaatgataggtggttggagccagaggatcagtgaaaataagacagcagagaggaggtggtgctttgagaagcaagccaaggtgaaggggcacagtaaactgaatttaagagcaacattttcattcattcactcataatatgtgcttgttacatgccagacactgaactgcaataccacagtgaatgaaatgtagtccttacattatacttaagcaacttataccatatttcctaaatccatatattttcccttagccactgttactgcattgttgtctaaaagccaacattaaattttctttctctgcagtgtaatatccttattctacaaattaggtaactacaactctctcgtaaagtttgtcaaatattacaggactcatgtcaccaatgcattgaggaatacaacaaaggcctataaccatggtttgaccaaaataaccagagaaaactatggcaaaattgagaaatagtgataaaataggatggtatagttatcaaaaaaagaatccctaagcaagaattgagaacaagatgaaaatcaacaaccaaaataatgtaagcacttcttggggtaagttcataaacttcctaatgttctaagaatagagattttaattatttttctaaaaaacattaaataaaagaataatcccagatagctggagaactttgggagacttaaattataggatgaatacaacacaaacctctctattctgtccaccttctcacttagaacatacttccctcaggcatacaacagactcatgccaatgttagtcccaaatttctcacaatattgacttgctaatctctttaagtagtacttggctttttccttggtcccatcgatccctagtatctctcaactagctctcacacagaaaaacagtatgatagatgaattcttgaaatgatgctaaatcacagataacagcttattctaagaacacagaaatattttaaaagacttctggaaactgaaatatttttagccaaatgaatttgtcattaatgttggaatttcaatcatatgagccagactgagggaaatatctttggacacagggaagttttcaaagtccccaaaactacgccactttggcaaccactggcttgcctgttggggagttcagcactgtgataccttgttctcagcttcccctaccattagtgggaatggcagattgcagagatggtaacagtggtggcagcacaacccccaagcagcggcatttgtattagactcagtactgcacttgaattgggaagcaactcaaagtaaaacacacctctgcagatttttataggaataataagccagtgagagatgatctatagagctggctatagaacagtagaattctccattatctttcttcaggcactgatttttatgccaactctgatttttttgtcattgtgcttatctatattcagtattaatatagctccttagtactatccttgctttaaaaagtttatgaagaactgcatacttttggggtgactgataagtcacagtgcattccacttgatgcttttggttgtttattcctgtccaactttatacagatacttactgtgtacctcctatgcaatgaaaagattcttttaaaaaataattgaacaaattctctcaaaataaaataaaaattcacactgatttataattctcactaaactgagaggatttttcaatattcaggaaaatattgccatatattatttataaaaatttgttttaaaatgtgtgcatcatatttcacaactgctctgagttgtggtaagaggtgcttaactacttcaatatggcttatcttcttgaacttagaaaaactgtttcaattagattgctaatgttcttacaattataaataaaaggcttcccattctaatatagcaactgattggctatatcaaataatttaaaaatccatcttgattccaaacgcagaattaggactcttgtcttccattcaaccaagcatgcactctggatcaaacttacctgttttttggcaaaaattcagacactcagtaagaactaaaaatatacttcagttcctagtaaaataagagttacatgaaggtagctaagttaaggcaaaataaccagtcaatctagggaaaacatattgcttgttaaaaatgttaatactggtttcaaaaaatgggaatggatggataaaaggggaaaaagaaagaagcaaaccaaaaaatctatgaaagactgaagagaatactgctgctaatttgcttgccttctctatctcaatttcactttcagttttcaagactttttttttacattaatcttctctttatttacctcaacagtttttatgagttgttagtgtatttcacataactttcttgcagacattttagctttaaggattacttgagtttggtttatattagacaaattttaatatttacaggtactttccagagaaaaagaaaaatgaagtcactgttatctgtcatccaaaactatatttgtttccttggctttcatgaaaaccagtattttacttcctcttgcaacatgctagaggtacacagatatacttaaataccactgtctaacaaatatcgaattaacgtgcttctggccagagtaacagacccatagccccaaacccagctccaagttggctgacctaccatgtgcatgcacatgtccctgacctgagaaacagcgtggcaagcccacccctgacaaagcctcaccaccaccaccagaaactctctcagcctaggctactgagacactcataaatgtcaccagcatggattacacctgaagaaactacatggagactacattactgtgttcacctagaaccaaagccaatatatcccaccaaaacaacaccccaagacttattcatatgaataagtctttccctaggaaacctactccataaaattagaagaggtaatttttccaccagatgtgtagaaatcattgtaggaacacatcaaacatgaaaaagcaaggaaacatcaaacctccaaaggaacagaataattcaccagtaacaggcatcaatcataaggaaatattgtatattcatattaaagtaagacataccataaggagtatgacacaaacttgtcccaagcctgcgaagtggagaattagtttaggcttaaatggagccattatatccttttcctagttatacttgtttttcaaaaatctgtatatagtttccattaatagagacactctgaaaagggggaaaatattccaagaaatattacaaaataatctcaaatatttcaacgctattctgaactactgtcaaatcacagtgaaccagggattcttcctttatcagaaagtaagtcactttctaaatactttcaactaaaccttatctcaagaagatcctgcaatagctcttaattgataatacgccaagatccctgacttctatcaggtctatttctatcagctaatactaaaagccagattgaaagctttttaaaaaatcttataagagaaacaagaaatctgtgaaagatattcaattcatggcccagtatgtttaaaataatgctgttatatgactttactagaaaaaaataattcaaaataatgttacatagaccaaaaagaatatattcttactattttaaaatactgatgggccatataacatgtacacgggtctctgaaagttagtaattctgctttaaacaagtacaacttcaaagttaaaatgataatctgctctaatggttaaaatcaaagtattttttgtctatgaataatatttactcccagagactgcatgtcatatactcttctatacaaaaactactcaacatttacttaatgtgtccttttctggagtgctaatttcatgaaccacagatatcatttaactacagaaagtaatgagtagtttattcttctgtcatgtacagtgtcactgcataggatgcaataactgtatatttaatatcaactaaagtaattgagatcatatccatattatgaggtcttctttgatgatatatgtcagtacaatctcctaagagatatgagtagtcagatgtatactcagtagcataaaataaacaggttcatgactgtatatcaagatcaattctgtcagaaaagatcactgcagtttcatgtctccttgcgggggcaaccaacaatctcaagggaattaccagattctaactaaggtctaggatgaagactagtctgaaggacattaaaataatggtgtggtcactcaaggtaaaatactctcatgagtaccttttcattattttacaattcagcactatagcaggggttatgaaggaaagcaaaagaggccagcattatttccaaaaccagataaatagctgacggtttacatttattaagggctgacaatttatgtgacacggtgttgcaaggattatctcattctgtcttctcccaaactccctatgaagtggatagtattatcttcacaatttacaaatgaggtaactgaagcttagaagttaagcaacctgcccaaagttgatggaacctacaaaatggcagttggggtttgaacgaagcaaccagggcctgaataccacttgcaacctaagtctcccaataggaaaggaatatggaacactaagacaacaacacagctcattattatatgtatttagatatccatatcaagtcaaatactgccctacaatattttggtgcttttaacaccttaagaagaaattttttattttcctcattccctgtagaaaatcaataacttagtgtttgggaaaaaacaagctgaccaggtagaaaagaagttatacttctgttaatccaggaaactaaaagatatattttataaaataaatattgcaactgtgtcagtactcctttctacctcacaaaaagcttagtcatatgaacatgactactgtttttcactagctgtccccaatcctcacgtcacttccatcctacccttcaagcctcacatctgtatatacctcaagacagagattattatttcccagtaaaatgagaaccccttaacaaatccatatgtattacctataagcaagtaaacctcactttgggcatataaaagtcataaagtgacttcaagatctcagaagtaggtcatttccctaatatagttttaaaaaggaaagcttcaatattctatcactgactttctcttgcatgtgaattctgtgcccattattaattgaagggtcttcttttatttttcataagattctgccttttgtgggcaccagtttccgggatgatgatggcatcctaattttcttttgctgagaaaaggaattttaaaacattagttttagggtcaacttcaaaatgagatcatagtcactgaagacctccaagatccatatatcatccaattatgtttcagaacaggtatccctgaagaaaaagacaaaaaaaagaaaaaaagaagaaaaaaagaaaagaagtaaaattccaacttaccttatcaccttgcataccaggggggcccattaatccagaaaggccttgatcaccctataaacaaaatacagacgtttaatgtcatgaaagagaactgaaaattagaattctcttgaaaattaaagctccttttaattttggacatcagctcttattacaatcatttccaatcttcacaatctttgagcctgtttctgaggcttcctgcctttccttatctcttccagggcttaataactgaactgtattttcccacctccatatccttgctccgttttctctgatgttcttttctgtaataatgcccttgctgtcaaacttcgcctcagtccaaggtctaccatgttttaaaaattgaaagtagggctgggcgcggtggcccaggcctgtaatcctagcactttgggaggccgagacaggtggactgcttgaggccaggagttcaaaaccagcctggccaacatggtgaaacccgtctctactaaaaatacaaaaaactagccgggcatggtgtcgggcacctgtaatcccacctactcaggaggctgaggccggaaaatcacttgaacccgggaggcagaggttgcagtgagccaagatctcgccactgcactccagcctcggcaacaagagtgaaactctgtctctgtctcagacaaaaagaaaaaaaattgaaagtagtttccctaaaaaatctacaagtgcattgtgaaacagctgttgaggtgtcacccctactccgtttctgtgagcacctgcagcctggtaggtctcccagagagaatctcacgggctgtggtgggaccagctaggttcacgtgacgcacaggaggcacttccgcttctggagctgagctggtgccttccatcctgcgtgccagctacacagaacgtccctcaccccggagtaacgagcgaaaattgattgggaagtccatcatgtgcttggctcgaacagactaggcgttaccgattagcgctaccttttttacatttattactctgatagaaggaagataaaactgcacaaggaaagaggaaactagaggctggtcctcttccactagctttagtcatgaaggaatcatttaatttctcctcagattcctcctctggaaaatgaggttgataatgatgatggtgatgatgattatgtcaatgtcatctcacctgtcttatgggaaaggaaaaacttacaccatttaaaaacgatctatgcatgctctttttaagctcccaaagggcttaaaaccttgtgtatgatctattacagatgttacttagtggatgttacatggtgaagtactaaatcctgcatttatttttctctttcaccattgaccatacatttattgttaaaaatggctaaatggttaaaatacaattgtttgcccacccccttctacttccaccaagttaatgtttatattttatttgtattcagatttatgtgtataaccagtttcctttttcctcagtatatttgaatccaatttaatgtaagtacaatttctaacagatcatttttaaattttaccattttaggaatacctctattaattttaaaagttggattttactaaagctctatggcaatatactattaaattttatatcttaatatgtttctgttatagttttaaccacagttagtatataagtaactcaaaaagtgaaaaaagactaacatgcttccaagtctgaattcccatattgaatcaccctatattttgctcagagaagccacagggaaagataaaaccaagcatttgatataaatatgaatgtttaatctaggggttttacttaaaatagtcaccaaaattgagtgggcctctaatttctaaattttaagttaagaaatcaaatatattatgtttagatattttaaaatatggcacttgtgtttctcatattgcagaattttgtccttgcaataattaagacagtaatgaaaatactatgtttatagtaataatctattccaagttatttagactcagtgaactcagttccaccacaataataaaattactaaaattttagatttaaaacatgttgagtatgtactcccaaaatgtgtgtaactattgtataccagtaaaaaatttaaaaacaaaataaaataattttttgaggatttactctttcatatagtatctgtagagtaattatgtttttttttaagtttacaattgtttctgtaagccaatgaaaagatcagatttcaaactttatgatagtttctgtaagccaataagatcagatcgattttgtaaccaccaaaattgttcagggatttttaaagtttgtgaatgtatactacattaaaaaacacatcccataattatattacatttataaagtgcctgtctaaacaaaacttcccagatgtcctcctaagactccatttgtatttatcctcactagaaaacagtatccttctcccaataaagtttttgtagttatctttgctttaaaactagtttttactaaaatatgtatatgtttgtattggcagtgttaggatgaaatgaaagcatactggacaagaagtccaaaaatttggatatatcatcaactctgtcatttactgtccatgtgataagtcagttaaaatctatgaattctgttttctcaatgggaaaacaagatagtggtgaccgcttctctcacagagagtaccatggtacttaaacatcataaagtatgtgaaactattctaaaaatatgtaaattggcattacaatttatatattattgtgtacatatgtattaacagcaaaatgtctgcagttaggaccacatcctgttgtaatttttaccccatccaccccctcattggcagatagtacagtggcaggccacagtagacctttaataaaagtaatgttaagacttaaatcaataagtgaaactggtgataaaatttacttaattcttcaaatagttcttccttcattaaaatccaacaattaattctcatgtttttttcctgtctgatacagtaaaatctacatttaaaaatgcttaaattattttaaaatgcttgaaatatattaccataatttcatttcatggtcaaataattaccttttctccaggaacaggttgacctggggaaaatcctggatctcctttggggccctaaataaaatagttataaaacagttggtgaagcataagttgcatataatgtgtcatatatcttcaggtatttattaccagatgttatatacattatatggtgttaaataaaataattttacattgagataggcattggttatttcattttttaatgtatatttttcttagccttatttttaaatgatgagaagattcctaaaagttctctagacatagttgattttttaatctaataaatttaaagttatactactattgaaacatttttcttgaaggacctaggtagatttattattttttccatttttgtgacatattgagttgttattcctattttagcattgaaagactattactttagtaaaagaaaacttcttataataatccttaaaattctaagatatcattccaagtttaaatattttccaaaatattacaatgcacatgtattacttttattattaagaaaaatgaacataaaaaagatacctctaatccacaaaattctttttattctgttataaaattagataagtttcacagtgtggggatctttatcttttacatttcaagataaatatgacattaggtttcagctaaagtttttgggtacaatatcaaaatatttttatgatgcatagtagcaaagtaactctttttcaaacaatttgtcatatctcaaaatataggggccacaatggagattctttaaaattcaaattctgattttattaccattctcaactaagaataaataattctccttcctagatacttctaaatactattttcactgggaaatagtcatatcttctttacatattcagagatgcttttaaatgacacttaagctgactgatgaaggatgaaataccaaaagaaaagtcctgcgtgtcccccagtaagtattttcattttacaaattagaaatgaaccctcactggcagagtcctgtattctatagtcaaagaaaaattctacattgtgtaaggaaggggggtccagttttaatgttctgtatatggctagccagtcatcccagcaccatttattgaatagggaatcctttccccattgctcgcttttgtcaggtttttcgaagatcagatagttgtaggtgtgcagtcttatttctgtgttctctattctattccattggtctatgtgtctgtggattaaagacttaaatgtaaaacccaaaactataaaaaccatggaagacaacctaggcaatatgatttagtacataggcacaggcaaagatttcatgatgaagacaccaaaggcaatcgcaaaaaaacaaaaattgacaaatgggatctaattaaaccaaagaggttctgcacagaaaaagaaactatcaacagtgtaaacaaacaacctacagaatgggagaacatttttgcaaactatgcatccaacaaaggtcaaatacccagcatgtataggaacttaaacaaatttaccagaaaaatacaaacaaccccattaaaaagtgtgcaagggatatgaaaagaaacttttcaaaagaggacataaatgcagccaacaagcatatgaaaaaaatctcaacattactgatcattagagaaatgcaattcaaaaccacaatgagataccgtctcacaacagacagaatggctattttgaaaaagtcaaaaaataacagatgctggtgacgttgcggagaaaaagaaatgcttatacactgttggtgggagtataaatcagttcacccattgcggaagacagtgtggcaattcctcaaagacctagagacagaaataccatttgactcagcaatcccattactgggtatatacccaaaggaatagaaatcattctgttataaagacaaatgcatgcatatgttcattgcagcagtattcacaatagaaatgacatgaaatcaacctatatgcccatcaatgatagactggataaagaaaatgtggtactgtatatacaccatggaatactatgcagccataaaaaagaatgagatcatgtcctttatagggacatggatggagctagaaatcattatccttagcatactcacacaggaacagaaaaccaaataccacatattctcacttataagtgagagctaaatgatgagaacacatggacacagagaggggaacaacagacatagggtgggaggtgggagaggatcaggaaaaataactaatgggaaccaggctcaatacctgggtgatgaaataatctgtacaagaaacccctaatgacacaatgttacatatgtaacaaacttgcacatgtacccctgaacttcaaatttttttttttctataaggaaagtttgtcttccaggttgacctctttttcatcatagccatcactgtttgctccactattaaggctacaattttaggtcattggttacaaggttatgaaacctaagaaatggctttggtgatatcttaatatttaaaaacttaactcatcatcaaaaaagttaatatacttagaatttataagagtaattagagcttatctagtaaaacatattttgtagataaaagaagcaataaagcccagaagagttaattgacttgctaaggattacttaggaaagtattggcaaacaatgtccattttctttcttgtatcacaatgcctattacaaatcttatctattggttttaatatattttaatcttttattataaaagctaactagttgattcaaggctataatttacaaagatttttaaaataagaaatgatagcccttgaaaagtttaaatataataaaaccctttgtggccaatgtttttattataaatatcatgttaaaaattcttacgtttagatcctatttgaattttctatcatctgtcagctttcttaatatcatcaaataatttaatgtttaatctccactttaaaaattgatagagtgggcaaaagtaatcaattgaacaataaaaattagattttaaagggtactttttcttcatgtgttatacatctgggcaacacatttgacacatatatgtcaaatttctctttgttctacacaaatatgattgagttaattgatcaactcatgttttagaatgggaatttcaagtcagtatggaggaaatgctcttaacttggctagttgtgggctgatccttcctaatataaaatgcatgcagcgaagactattgaataatgccaactttatctaaaatgtcaaggaagtagggcatgcttctctgcattgaaggagaaaactccaaaatttcttattttctccctcattttgtatcaactgttggactcttgacacacttttcatcttacttgattagtttttcaaatcccctttggaattatataaaatacttataaattcattaattaatcataactgactctgaacctcagtaccgacttccacttacttctgcatgacttttgttaaaggaagtatatatccttttgactatgagtaagaggaaaaggaaattgcctattctttgttactcaaagttccaactatcccactgatctgctagagtttaaaatcatttttatcagagtaagtcttttagtccattattgaatctccagagggccctcggtctagggagggaaagtccccaaggtagaggacccattaacatgttagaacagatttatcttagattagcatctgctcaatataattgaaagagcattgggatttggagtgaaaacaccaaacaattcatttaaactctcaatttgagatttcttctctgtaaactcgtattaataataatgagctttaggaccaaattctctatggattataaaggtattagtagtcagtactaaaattaacaggactaaaaacaattattattaaaatcacttttacaattgttgccatcttggaaagcagataacacaacttttgagtgaattattaatgaagcagcaaaactttaatagagaataatttggaatctaaaaattcagagtaggaatgaactaaattgtgagaatatcacaaaggaaacactaaatgacatgaccttgaggtagcatcatttggatattcttgactttgacattactaataaccacataagcttcataatctcaattacactctccaaccaacacttcctatctttagcccactcttcataggcctccacaactttaacatttatttgattcactttaacatttatttatttgaagctgctaatatgtggatcctaccacattttcattggttcatcccccttatggcctcgctttcctcctcagcctaaatacaagggtctaacatagtcactccattgcatacataaatgaccctacttcccctttctctctctgtcttataagcttacctggcaattcttaaatctaaattctatctattctgcacctgcctaacagccgaatgtgactaagagaaaaaattcatgttgacaaacttcactttaaattcataacttctttcattgtttggtcttttatttaatgtgtccaataattgtcttagtcaattcacattcccatttttatagatgattatttcataactccttctctttctttcctcttagctagtgatcttgtttttaatttttataagttctcacaaccaagtctactacctcaacctaactctgttctaaaatgctctgccttctctcattaaacagacaaatccaccattctttcaccaggctatcactgacgctctgtttttcctgcattattttaacttttacttctcttcagaataatttctatatacccaggataatttccattacagtaaacatactttaagttttgtcatcttaaaaaaagctttccttgagcctacatgtctcctttctgctccttatgctattcccttttagagtgaaactcctaagttgtttctgttagctaggagacctcctctccttttgttctctcttggacctactctacacagacttttttgtccctaccactatcctacttcacttatcattctttctcaatcttgttgttattgtattgttgttgttgttcttcttctccttctttcttctcttttctttcttcgtctttcttctcctttttctacttctcctcctccttcttcttctcctcctcccccctcctcttcctccctcctcctcctccctcctcctcctccctcctcctcccttctcctcctccctcctcctccctcctccctcctcctccctcctccctcctcctcccttctcctccccctcctcctcccccctcctcctccctcgtccttctccttctcctcctccttcttctttttcttattcttattcttcctcctcctcctcctccccttctcctcctcctcctccttcttcttcctcttcctcttcctatttattaaactctggagtaccccccataaggcttagtctttggacgttatctgcattcatccctagatgatctcatgaactctatatctttaaattccacatatacactgatgactgtaaactgtatttctagctatggcatgtcccctgaactccagatccaaatcctatttttaaatctccacttggatgttaaatagtgatctcagttgaatatgtccaagaaagagctcttggaaattctcgtccagatagtcacagagtagcatgtatgggatgaatcctcctgtagataatgattacaaagtcaggataagatacataaaacaacattatgtgagtatacaggagagcaaccaaaaacaggatacactggaggggattcaacccttgaaagggagacccatactttgtgtaatacatatttatacagcttgtctcctgaggatactccctagtctgcatggagtgactagaattaaagcagaaatagaccttttactaatggtgtcagaggtcagagtaaggggctaccagaatgactgtaaattggggaagaaaattaaaagaaagaaggaaaaagaagaaaggaaggaaagacagagaagcaagagaaagaaaggaaaggaaaggggaggggagcagaggagaggaaaggaaaggagaggaagaaaagaaaggagcttcccccaaatgctggatatagatttttcatccttggctgacactaacatgtgcttatatgaggtagactccaaagagctcaacagaagcaggtggaaggctgaaagaattgaacataaatatcagctgctggtcaccacaggggaaacagtttgggggtttagccacatccttttagaagaacatggtaaatactttggtaaacacctttccattgacattcaggaagggccatgctttagaagtaaatatgacatccttggactgagactcacaccaagagcaaaactgaaacaaatctgtcctttaaaaagttaccaagcccataagtttaaggtgactcttttggtaaaaagttaccaaacctttaagtttaaggtgatgaaccagttatttaactatctacagaataaaaatgaacagtcttcaattcaaaggacgtaacagaatctaacatctcttcaacgtatcatccacaatatccagtatatacaaaatcttctagacatacaaaaaaaatgggggaggggaaaatctgacctgaggttaacactatcattaaccaccataatctaattggcatttatataacaccacaccaaataactgcaaaatacacaatcttttgaagtatatgtagaatgttgacaaaaataggtcacatattgggccataaaatgccttggtaaattttaaaaggttaaattccaccagtatgtgctctctgatcaaaatggaactaaattagaaaaataataaagaaaacaacatacttctaaataagcaggtcaaaaaagaaattatatatttccgagtgataatgaaaatgtaacatatcaaattttgtgagatgcagttaaatctgtttttaaaggaaactttataactttaaatattagaagagaagaaaggtttataatcagtagtttagctttccaccttaagctggaaaatgaagaacaaattacatataaaataagcagaaggaagaaaataataaagagttgaaatcagtgaaatataatgtagtccatagagaaaattaacaaagccaaatattgactctttaaaatgattaatgaaaagttgttatttcctaccaggtgaaaccaagacaaaacatacaaagaaaaacctgcaaacatgttatttctcattatagcagataggaggtcccataatagcagctgttcaactgctcaagccttagcattatctttggctcttctctttcacactatatatgtaatctaccagcaaatcatgttgactgtaattcaaaatgtatctagattgtgaccacttctcaccacctcaactgctaatacctttatccatgccatcatcacaaatggcatggactagggatgactagcagagtagactcaactggtatccctgtttccacctgtctcccaccccaaactattctccacatgacagccagaagtatcctagaatattactggatgatgttatttgcctgcttagaactcttcaatgaatattcaacacaatcagaataaaatccgaccaaaatcttttttttaaaattttattattattatactttaagttttagggtacatgtgcactatacccaaaggattataaatcatgctgctataaagacacatgcacacgtatgtttattgcggcactattcacaatagcaaagacttggaaccaacccaaatgtccaacaatgatagactggattaagaaaacgtggcacaaatacaaccaaaatctttaccaatagaattggctcctactacctctctgatcatattcctgacacttaacctcattcagctattcttcaaagattgaatcaaggcctttggatttagtaaactgttgtttttcaatgttttcatcaggaatgccaaagtagtgatttttaattctagcattctttatttagtagctctttctataataagaaacttccatttatcaactattttgttatcctgaagttcaattctgtaaggaagggaggcaatttttaaaagtttgcttctttccttttatttttcttctatttaccattttttaaaataatgatgtggtataataaaatatatatatttggtttttgtccccagttcctggcatagagctcctaaactccttgaaatttcctgagtgataggggtgtcttttgttagtcataacaagccccttctgaccacaccagagtttatgctaataagatgacacacgctgggatccctaaatagctttcagcattggggtctggtcaccagaaagacacacaaatgattagagaatgggaactttcagccctactttcccctaccccctctgccagggaggggagagaggggctagaaattgggttataaaaactcttgaacaagatttgaagagcttctgttggtgaacatgttgatttcctgggaaggtggtatggtgggatagagcataaaagctccacactccccatccccaattctttgccttatgtctctctttcattaggctgttcctgagttgtatcctttacaataaactggtaaaagtaagtaaagtgttttcctgagttctctaaaccattctagtaaaatattgaatctgagaggatgggtcatgggaacccctgagcttgcagtttgtccaagcagaagtgtgcgtctgggcatctcatttttgtctggcatctgaagtgtgggaagtcttataggactcagtgttaaaaactgtggagatgatgctaactctggtaagctgttgtcagaactgaattgaattgttgcatatccaactggtgtcagaggatctgaggatcttacagatataattacccagcatcatcaaaagatgatcaatgactttgttgaagttgtatatcagcttaaggagctttgggtccaagactatggggttttctaggtatagaatcatattgtctgcaaacaaggatagtttgactccctctcttcctatttgggtgccctttatttctttctcttgcctattttgctccggccaggacttccagtactgtgttgaatagaagtggtgagagagggcatacttgtcttatgctggttttcaagggtaatgcttccagcttttgcccatccagtataatgttagctgtgcatctgtcatatatggttcttattattttgaagtatgtttcttcaatgccaggtttattgagagtttttaacatgaaggggtgttgaattttatcaaaagccttttctgcatctattgagataatcatgtggtttttgtctttaattctgtttatgtgatgaatcacatattgatttgcatatgttgaaacaaccttgcatggcagagataaagtctgcttgatcatagtggataagttttccaatgtgctgctggattcagtttgccagtattttgttgagaatttttgcatcaatgttcatcaaggatgttggcatacagttttcttttcttgtacctctgccaggttttagtatcgggatgatgctggcctcatttaatgagttagaaaggagtccttcctcctcaaatttttggaatagtttcagtaggaattgtaccagctcttttttgtacatctagtagaattttactacgaatctatctggtcctgagcttttttttttaaccaaaaaaaggctatttattactgattccattttggtgctcatttttggtctgttaaggaatgcaatttcttctgggttcattcttgggaaagtgtgtgtgtccaggaacttatcatttcttctaaattttccagttttggtgcatagaagtgtttataatattctctgatggttacttgtatttctgtgaggtcagtggtaatatcccctttgttgtttctaattgtgtttatatgaatcttttctcttcctttttattagtctagctagcagtctatttattttactaattttttcaaaaaaccagttccaggatttgttgatctttgaatgattttgcatgtctcaatctccttcagttcagctctgattttggttatttcttgtcttctgctaactttgaggttagttttctcttggttatccagttcttttagttgtgatattaggttgttaaattgagatatttctttttgatatgggtgtttagtgcaatacatttccccttaatactgccttagctgtgtggtagagattctgatattcgtatctttgttctcattagtttcaaagaacttcttcactcctgccttaatttcattgtttacccaaaagctgtgcaggagaaggttatttaatttcaatgtaattgtatggttttgagcaattttcttagcctggatttctaattttactttgctgtagtccaagagagtggttggtatgaattcaattcttttgcatttgctgaggattgttttacatccgattgtgtggtcaatgttagagtatgtgccatgtggtgatgagaagaatgtatattctgttgttttgggtggtgagttctgtagatgtctatcaggcccatttgatccagtgctgagttcaggtcctgaatatctttgttaattttctgcctcaatgatgtgtctaatactgtcagtggggtatgaaagtatcccactattattgcatgggaatctaaatctttttgaaggtctctaagaacttgctttatgaatctggttgctcctgtgttgggatgcatatatatttagaaaagttaggtcttcttgttgaattgaaccttttaccattatataatgcccttctttgtcttttttgatatttgctggcttaaagtctgttttgtccaaaattgggattgcaacccatgctttttttctgttttccatttgcttgatagatttttctttatctctttattttgagcctatgtgtgttactgcatgtaagatgaatctcttaaagacagcctaacattgagttttggttctttagcctgccactccgttccttttcattgagacatttagcctgtttacattcaagattagtattaatatatgtggatttgatactgtcttcatgatgttagctggtttttatgcagacttgtttgtgtggttgttttaaagtgtcactggtctgtgtacataagtgtgtttttgtagtggctggtaatggcccttcctttccatatttagtgtttccttcaggagctcttgtaaggcaggtctgatggtgattaactaactccctcagcatttgcttgtctgaaaaggatcttatttctcctttgcttacaaagcttagtttggctggatacaaaattcttggttggaatttcttttctttaagaacgttgaatattggcccccagtctcttctggcaatgtatggtttctgctgaaaggtctgctgttagtctgataggcttccctttctgggtgacctgacctttctctctagttgcctttaacatttttcctttcctttcaaccttggagaatctgacgattatgtgtcttggggatgatcttcttgggaggtatcttgccggggttctctgtatttcctaaatttgaattttggcctctctagctaggttagggaagttctcatggatgatatcctgaaatatgtttttcaagttgtttccattctccccatctctttcagcaataccaatgagtcatagatttggtctctttacatgatcccctatttctcaggggttttgttcattccttttcattcttttttctcatccttgtctgactgtcttatttcagaaagccagtcttcaagctctgagatctttcttcggcttggtctgttttaacacatgtgattgtattatgaaattcttatgtgtttttttcagctctatgagatcagttacattcttttctatactggctattttgcctgtcagctcctgtatcatttcattgtgattcttagcttccttggattgggtttgcgcttactgctgcatctcaatgatctttgttcctgttcatattctgaattctatttctgtcatttcagccatctcagcccagttcagaaccttgctgcagggctaatgcagtcatttggaggaaagaaggcactctgactttttaagttctcagagttcttgtactggttctttctcatctttgtgggctgatgttacttcagtctttgaaattgatgtcctttgaatggtttgtttttcttttatcctatttgatgaacttgagggttttattgtgatataaggctggctcagtcaactggcctcatttctggcagattttaagtggccaaggctcaactcacaactcctggactacatgctctaacactgagggactgatattgggccttgactttgttctctggcccttcaaggttaggatcccactgcaatgggaggagctaagttcctggaccattgatcacagcattccaatgggtagtgctagccaaagtgtttcatagggtggtagcagtgggatctgtccttgtttgcacatgccagcagcagcggccgagtggcaggatgctagcgggtgctgagagaccagcctccatgcaggtatttacagcagtggcagaggtagcatgactcaggaaggtgggggtcacactggtggtggtgttagcacagggacgaggcactggcaggtgcaggactgtgtgtgccctccgtacatgttcacacaggtggaggtggctgcacagggtgggagagggtccactgttctttgtgcctagtttcactccagtggcagtgttgacacaggggtggggtgctggcaggagcagggctggaaggctgtgtacctaccagggctccagctgcaatagcggtatggcagagggaggggaggtggagtgcacacacaccagctacagtgctatggcagggttcacatgcaaaaccggtggaacaaggaaggcaagatctgcctgcacacacatgcgttagcaaagcaatacggggagtggccatggaacctggggatgctgcagtgagggaaggaacaggtcagctgttgcgtgtccagagggccgctctgctggtcaggcacagtccaacagtgcaggagttatgatgcgggcccccagggccccagtctggctgcatctgtttgcagtccagcattgggtgccctgggaaaggccagcagatcaaggaaagctcagatcagaccagccccaggtgatagggaagaccaccctgcagagtttacatctgggctaaagttcccctaggggaacagtctcctatgggagcaagtgcagcctagggggattggcattcctggccatgctccaccacatatgctcctgtaacacaccctttgggctccacactggctgagtgctgctcctaccacttatctaagccgctctccctgtcaatgaagtggctgtggtggttgaggggtctcctcctgctgggattccagaggcctgtggtgaaagcaggttgctccttgccagttcaactcacctgttctccaggagtcgctggggtccatgaatgagtcccgatgtgaagtagcccctgtgcagagttcccagcttcctccctcttcagcccagcttctgtgtcttccctctgtccactctcagtgccctttctctacagatctgttaggagtgtgccagtcatcccgatcttcagtggcagctgttccacctggctgtgtctagtcagtcatcttgcccagctcccatatcattttttacattttcataatgttggacttactattttttatggcaatctgacccactacaaaattcttcttgtgggtaagcatctatacttaagatatttatttaattcatatagaaggaaaaattgtacttctagttaagataaatacacgatggagacataggagaagacagtcataaccagggatagaacatagcactaagatactactctttggtgttcaatactttatatatatactaatatattaaatattattaatgaaacattgttactgtgggttattaaggctagatgttttcatttaactggattaaatttgaaggaactattggccctgactaaattaatataagacatgaatgtttgtaggaaggttttaggcttcctccaagaggcctttttttggaaaagaactatcttgaccacagattgcctggactggaattgtaagcacatggtaggctgatgatacagactctacgtgcattcatcactcatgttcaaagatctacagcataattttacgtgtttaattaatagcaatgaacattcccatcgcgctgcaaataaatagaatacagttcatttaatagataaatatgataaataatagacccaggtggcatttgataacaagaaaaaagccattctctctggaaaacaggaaatggaatttagtttcttattttttttaagaagaacattgtttctaccatcagtctcctgatttcagccaatgatttcagctaatgatccccatagtctttctctattttaaatcatgttagttttacatgctgagaaaaattgctgcatatccactaaatttgtgtgtggcactttatatttctattgtttaacaatttaacaacacagtcctcagggattaggaatcagtttcactcttcatagaatttctatattactatcattatccacgggataacctggaaccttggaatataaccactttgttactattactaaataaattcataaagtctttaagttaggtaaccccaccactatcctgccttcttaaggtggtattttataaaagaattcctcattgtgttgggagagacaacctagtgtaagaaaaatactaagacatttccaattttgtctccccctctaccacttacaaacagtgttaccttggttaagcgcttactgctctcaagtgttttcttctgtgcaaaccagaaggtaataaagcctgctctcatagtacttatgattgggataaaactaaagagatatcatacataaaataagtggcagatattagataaaagaggattatacagtataaagcttgaatgttctattaattccgattattctagaaatgcatgttaagtacctaagaaaatcggtttcacaaaatcaaacactacaagctttatatgatacatttgtgacacaatggtaatttatttatttatttatttatttatttatttatttatttatttatagacggagtctgctccgtcgcccaggctggagtgcagtggcccgatcttggctcactgtaagctccgcctcccgggttcacgccattctcctgcctcagcctcctgagtagctgggactacaggcgcctcccaccacgcccggctaatttttttgtatttttagtagagacggggtttcaccgtgttagccaggatggtctcgatctcctgacctcgtgatctacccgcctcggcctcccaaagtggtaatttttaatacttgtcacaaatctactatcttccacaaatatatgcagttaaatcatggtcagttttagctagtttggacacagttatcaaattcttaaattaaatatgaattaaagactattgttcaggtttatatgactaaatccccaagaggcctaagtttttgcaaaataaatgtaagtttttaaatccctcatatgtgagttcataaaatatcttattggtgaatagttatagtcaaaattaagtccatcctactaaatataatgttaaagaagactcttgagattacattttcttctctcctaggtcattttaccacagacatatattaatactaaacagtatttaaaaacactgtttttaatatttttaaaatttatttttgatacatattttctgggtacatgtgataaataatttgatacgttcttataatcaaatcagggtaattgggctggatctctattacaatgtgtttaatcttggaacagagataattttagtttgatacaaagttcttcattttctcaaatattggcttctcaatatttatacacattttaagaagtcaatgaaatacaatactttccaccatctctagctttaactctcctcaccctattttccccattttttctttgtatttgcttctattctgaaacagcaacagagcttattaagaaaggactctcgggctggtcgcggtggctcacgcctgtactcccagcactttgggaggtcaaggcaggtggatcacctgaggtcaggaagtcgagaccagcctgatgaaaatggagaaaccccatctctactaaaaaaaaaaaaaaaaaaaaaaaaaaaaaattttaaattagccaggcatggtggcacatgcctgtaaccccagctactcaggaggctgcagcaggataatcgcttgaacccaggaggtggaggttgcagtgagccgagatcgcaccattgtactccagcctgggcaacaggagcaaaattccgtctcaaaaaaaaaaaaggattctctaaagggagagtaaattggtacttgccactgcagattgagagttaaattacaagagcctaactgttcgctactggctgaagtattaggctggtgcaaaagtaattgtggtttctgcctttttaatgggcaaaaaacagaactacttttgcaccaacctagaagggggagaagaataaaagccatgtggaaattctgtctccctgggtcttgtggagaggaggcaattagcaggaatataaactcactataaattcagccctgtggagaaatataatctgagcccttacagctactttaaccttactaaactaattataaagtccccaaatgaagctcgaagggctatgaaaccacaaactcaaaaagaaattcctaatttctttagaagccatctatcttcttccctattacttatccagacttgattttaaagagtcgtttttcctctctgaggcacttccattgaactcaaaaaaattttcaacacaggtgagaaattttggaaatttagatttgaattatccttgttatatgctattattacctattaataataatgataccacttatggcatcgtagcaccatgttaagagctttactcacattaatgtatttagccatcactacagcactatgagcaggtagcatgattctccccattttacagaaaaggaaagaagcttaatgagcctaagcaagcaatttgcttttagccattcaaattgaaagagttaagacttgaacccacatctgtcagactccaaaaattctattcttaaccccaatctatatgatttcatgtttacttctgaatgcgatcactgataagcagaggggtgagaccctcaaagattcatgaagttactggcaaccaagatcctaatccttatctaatcttcccccaacctctgtcatcactcatatgcacacttttttcttttcttctcttcttaatgcaatagactgaatgtttttcccttcaaaatttatatgttgaaacctaatcctcagtgtaatgataagtggggctcgtataaatgggattagtgcccttataaaagagaccccagagacatagctagttccttccattgtgtgatgacacattgagaaggctctgcctatgaaccagaaagcaagccttcagtagatactaaatcttctggtgctctaatcttggacttcccaggctccagaactgtgtgaactgtgagaaataaatttctgttgcttataaactactcagtttatggtattttgttacagcagcctgaaaaaactaagaaaatatatattgggaatgggaatattttattttatatattttaagggaatgggaatattttattttatatatatttaataaaaatatatacacaatggaaatgggaatatttcattttagtgggaaagtatgggaatggagatatcattaaatattttatgtttagtgatatctccattcccatgctttcaaggtaaccaacctgtgtacctgtattcttccatacgttttcctatgttcttactatttatcacactgttatctatcatattgagaggtgacaacatgctagcagccctcgcttgcttttggcgccttcttggcctcagcgtccactctggccgcgcttgaggagcccttcagcctgcccctgcactgtggaaggccctctccgtgctggcccaggagggagccagctccctctgcttgcggggaggtgtggagggagaggcgcaggcaggaactggggctgcgtgcggcgctcgcgagcgagcgcgagttccgggtgggcacaggcttggcaggccccacactcccagcggccccgggcagtgaggggcttagcacccaggccagcagctacagagggtgcgctgggtcccgcagcactgatggcccgcccgtgctgcgctcgaattctcgctgggcctcaaccgcctgcccgcagggcagggctccggacctgcagcccaccatgcccgacccccgccccccacaccccatgggctgccgcgcggcccaagcctccccagtgggggctccacctccttctccgtggtgcctggtcccatcgactgcccaagggctgaggagtgccggcaagtggagtgggactggcgggcagctccgaccgttgcccctgcatgacatccgctaggggaagccagctgggctcctgagtatggtggggacttggagaactttatgtctagctgaaggattgtacatgcgccaatcagcactctgtgtctagctccgggtttgcggatgcaccaatcagcactctgtatctagctaatctggtggggacttagagaacttttatgtctagctagaggattgtaaatgcaccagtcagcactctgtgtctagctcggggtttgtggatacaccaatcagcactctgtatctagctaatctggcggggacttggagaagttttatgtctagctagaggattgtaaatgcaccaatcagcactctgtgtctagctaaaggtttgtaaatgcaccaatcagtgctctgtgtctagctaatctagtggggacttggagaacttttatgtctagctagaggattgtaaatggaccaatcagcactcagtgtatagctcagggattgtaaatgcaccaatcagcactctgtgtctagctcaaggtttgtaaacacaccaatcagcaccctgtcaaaacagagcgatcagctctctgtaaaatggaccgatcagcaggatgtgggtgaagtcagaaaaggggataaaagcaggctgcccgagcccacaggggcaactggcttgggtccccttccacactgtggaagctttgttctttcactctttgcaataaatcttgctgctgctaactctttgggtctgcactgcctttatgagctgtaacactgtgaaagtctgcagcttcattcccgaggccagcgagaccacgaacccaccgggaggaatgaacaactccggataggaggaacgaacaactccagatgcgccgccttaagagctgtaacactaaccatgaacgtctgcagcttcactccttaagccagcaagatcaggaacccaccagaaggaagaaactgcgaacatgtccgaacatcagaaggaacaaactctggacacaccatctttaagaactgtaacactcaccgcgagggtccgtggcttcattcttgaagtcagtgagaccaagaacccaccaattccggacacaatatgactatcatacaactatgtacgctcatatatatagattttcaggttagttgttttcataaacatttgttcattctttaaacatcctcggttttttttcaggtaaaaataattagggaagtgtggagcaggtaaataatattttatttccttggtgtttatttacaaattaaaacgaccttaatttaaggtaaattactcaaatcataatcttatatttcagaggtttccatacattgccatcatatttttgataacaatgattttggaatactaagcaggcctatacctgattttactactaagaatataaatccaagtatggtgggctttcagaggaacctagctctctgccaggctaagacaatcatgttgaagaatcatgctctggaggtgacagagatccttgatgtatcaagacttgccttaaatgttagggatcttctttttaatatcaggaaaatcaggtgatactcattagcttaagttgcctgattagtagtcacttacctttggaccaggtaatccaggtaaaccaggatttccatgtggccctggtatgccctgcaagtaacgaaaaaagtcatcattcttggaacatactggaatggaacaaagtacaattgcttactttcctctcaacatgtgtgatccctttaagcacttgagtttttgcttatgttattatgtatgccttaaagacctacttacttcagcttatgccctatacctacccaaatttttcttcagatctcaactcatttttaaatcctagccacaagaacatgaagcaatatctctctcctactaatttccgtagaaatttcttcatgtaaaattcatttaccaattaattgtatattgcctcaggacatttcttatactgttctaatctgttacttaaatactttattgctgttctaactgccttatgacatgttctatttagccccaggattataaattctttgaaaagagactcttaaaaatattactagtgtagcacttaacacattgaatggttacactcgattaatatttagcaatttgattttgcatcactgataaattatataatctgaattcaaaaattgattctattttctgagtacctactatgtgctaggaactgtgttgatgttttgtgtttctcattactaatccttataacaatcctgcaaggttattatttttactcccatttaaaaatccggaaacttaagcgcatacaaccagtaagtagaggaacagatcaccctctccaagaaagccttccatgtctccaggttccctatgcttacttcaattttgtaccctacttctgtgctcttcagccatacctccctcttaagacataacatatagttaataattatttgtctttttaattctgaattaatagagcagaatacttcaggaagacagaggtgtcagcaatgcaaatattgaaaatgcatctagcaagatgaaaactaaagaaaaaagattaaattttggctgggtgtggtggcttacacctgtaattctagcactttgggaggccaaggcaggagcatcacttgagctcaggagtttgagaccagccagggcaacgcagcaagacctcatcactaccaaaaatcaaaaaactttgccaggcatagtggcccacacctgtagtcccagctaatcagaaagctgaggtgagaagatggcttcagccctggagatcaaggctacagtgagctatgatacccatcactgcactccagcctgggtgacagagtgagatcctgtctcacaaaaaaaaaaaaaaaaaaaaaaaaaagaaagaaaaaaatggttagatgttatgacttatgtcattggtaaccttcaaaaagtacattttaataaagtagatggaaaacatctatggggattaatgaataagttgctgatgtaaaagtaaggacaatggaatataaattattatttcacaaagctcagtagtacaaacaacagtgagccaaaacaatagctttaggaaaaattaatatcaatgaaagtttgggatttataaaagagggataacttgttggttgttgccaaataatataaaatttagggagagaaaaaatgtaaagttgcaacttttaagttagatgaggtgaaattaggaacacaagtaaaataactagccttgagcaaaacactctttcttccttaagagaatgagaattggacaaataaatggaagataaaaagtgaattagggaagataaaagtaaaaaagtaaactgccgtattatgagaacagatggagattctgaacctgaagttcatgctgttgagagtacaaccttagcagtggatagggaatagaattagtatgaaaattggcccagtttctcagaaaaataggatccaaattctcacagagaggtaggaggataggaatggttcatgggctagaggagaacgagcaaggtttagaaggggctatggaagaaatgtgataggtcatcaactacagagaattttttttaatgcaaaacagctagagcccaatgagaattcatcttaggcctcaaatggacaagagtttgatgtgactatggacaacttaaagtaatattttagagtaatttttctttataatctttgtatgttaaataaaaatcagaataaaaataaagtggattatataaaaggtatttgcatttgtcatacaattctttttctagctcattgaacaaagatgttttgtagtaaaatatccacactttttttaggtttgagagaaactaattttaacatagcaataagtcttttgttgggcctgtgtaacatgaaaaactactgctgatctttaatgcagcttttttcctcagggcagttattttctagtcaatagcttcagaattttccactatgtaatccaggaatgtactattttaaggcagcccacccctcttcatttccccaaacaaatgaatctcaccttagatattgcgatcactttataagtaagaataatgttacaagtagcaccagaacagccactaatttacacatttgatcatctttgttggacacgttcacagagaatgctttggctgtgtgtttacactcaaaataaactaggctgcatgtgttcttaagcttctcttgaattggctaaggtaggactaagtttgaagatccaggcaggtttccaaaggaagtacatactgtacaatactagaaaaaacatgttagaaagttacaaattctcactgccagcaggaaatatagcccatctacttacccgtggacctctcttccctgacggacctgggatacctgctggaccaggtggacccttggaaaacaaatgtcaagacattaggcatgatagtggacacatttattttcttacgagtctgaataagatttccacccaaagacaactctttttcagtccccagttcccagctggtgatgatttttaagtaacacgaacccccttaccctaatcagcaggggtgagttgaaactcaagtgtcccctttaatctggccagaaatggcagcaggaagtctatgacttatggttacagccaccgtatctggtttttaaagggaccacaactagtagttttgtgggtaattttttacctaaatttacttttactatggaagaaggaattcaatttagggtttggcgaccaacaactacaagtttttttcaaacacaattcagaagaagatttgctttgaaaaatgaaaacactggccattttatgtacttttaaaagaattataccaaggatctgtgtaatgtgttaaactgttataatgaaatccttcttgtatatccattaataaatctgacttataccaattgcagcacaccaggaagtcactaatagagttaaatgatttataaaataaagtatgaaagcaaaaactgatcaattgttacagtgttctgagttatttaaatgttaatttttaaacatatcaaataagaaataggacactacttctttacttctccatataatgttttatgttgtcttcttcacttactttaacaatcaactgtggaataataaatgctcatttgtgatatggttgaacacatattcattcattcatctgttcattcattcaattgttactgagcactctgtgatatggcattgttcttggtgtctatagagcataccatacacatattccacttaacaaatattcattcattattgcagtaaaaatagtacacgatttcaaattagacacatcagggttaaaatactagcctcaccagtaacaagcactgtgacctaatgtgctttatttttctttattgtaaaatttttatatatctatgctgattgcacataaaataaagagatgaatccaggttaaatcatatgtactttccaatatgtgacagttttttaacctacaatttcataatttcatacagtttaatctgcagcatggccaggtacacctaaaatgtacattgagtttcaaaggaggagagggaaaatggattgatgggaaaggatcattccaattcaaaaacacaagagggaaatgagtaaattatgttgaaaaaaataacagttattttgcatatttctcatctcacattttttgatattaactactccttgaaactttctcttttattagagtcatttgcagttttctgatattcattagatatttcagactgtccatgtttttcctttagttgcacttttttctcttaccccctaaatttataaaacttttcatgtatttcctaatattgagagagaaatgctatttctattcagcccctaactgagggcattctccttcctcagctgttcaaatattttagcagccattatcatatcactagcttccatcaaatcttgatattttactcattgtcaagaaaaattgactttcttttcaagttaattctggtcctgttgttataattaaaaatttagcagctgttgatttgaatttatgtccccaaaaataagagccagtaggagaaatcgcaactaaaatgaaaaagaaaatgaaaagttttctttaaaaatgtctagtttggtttagtgtcctgtctcactacttgtgacaaaagaaaacactattccattcacattggaaaggcagtttgctatggcttgcgtttgtgtcctcccaaaattcgtatgttgaaatcctaaacaaagtgatggtagtaggagatggggactttgggaggtgatgggtcagggattagtgtcctgtaaaagaggcataagggagttagttcattttcctcttccaccatgtgaggacacagcacgaaggtgccatctataaaccagaaacaggccctggccaactaccaaacatgccagcactttgatcttcaacttcccagcttccagaactgtgagaaataaatttctatagtgtataagcctcctagtttatggcattttgttacagcagcctgaactaactaagatgcaattaacattagatactggggggaaaaagaggtatagtttatgtcatgatataaatatttgaattgtttgataagcactaaattaaaatcaattctcacatgtcttcataattttgtggtttcaaaatcttttacaacatagtattaataggcattttctagataccagagaagaatcataatttttatagcatgacatttttgagaataaattattttctataaataaggttaagtactaaaaaaggcactttaactttcagattatttgttattaagagaaagtacaattccatttaaaaagtaatggttttgcaatcatacaatgtagattcaaatcatgcctcaatcatttactagctgaataaccttagacaagtcagttactctttctaagccttagtttcctcacctttaaaatattgatgatagaaatttacctttcagggttattgtgagtattaaagctattgtatataaaatacctgtcactgtgcttggcagtgatagtagttaaccagtaaacagtagtctaattaactttttttttttttcgagatggagtctcactctgtcacctaggctggagtatagtggcgtgatctcggctcactgcaacctccccttcttgggttcaagcaattctcctgcctcagcctctcgagtagctgggattacaggtgcgtgccaccatgcccagctaatttttttgtatttttagtagagacggggtttcaccatgttggtcaggctggtctcaaactcctgaccttgtgatccccctgccttggcctcccaaagtgctgggattacaggcgtgagccactgtgcctggcctaattaacttttttaaggtatgcataaggcacagcaatcactgagtaaatgttagatattattattactaggataatatatacattaaggtaaatctattcaatagtccaatacttctaaaagataataatccctggtcagttaatgttggaaatcctgcatcttacattccttttttaatttattcattcactcactcaataaatattataaagcatcaagccctcctggagtttgcagtctagataaaaagacatacattaacagataaatacataattacaaattttacttagtgacatggaggaaaagaaaaggcaaccaagaaagaggttaatatggtggacctaatttatattgtgatgtcagagaaggcttttctgaagaagtatttagttagacctaaaagattaatgggagctagaaaaaagaagaaaataaaatttcagaagataggaataaatgaatgaggccatgagtaaaacaaaacaaaactaataaaagacacagtcattttgaggaattaaaagaaaaactaatagagcaaggggaaaagtggggcaagaggcagttgcagaggtaagcaggggccatatcacatacctgcacaggtcaggatacagagtttgagtttaagtgctataaccttcttccactgaagaacttaagctgataaacaatgttatctgattcatctttttaaaagaacactagagaattttggtaaaagatgtcagagtgagaacattttgcagactactctccctccctcaaaaccagctgtaaacaacaaaaagcaccaaaagaagaaaacatcatctccagtgaaaaacgaaaggatcataaccacaaaccacaaaatatgaagattacctgcccaatactgagaaactttggagcgaaggtgttgagagataaccaaatccaaaaaactcctcagacctcaaaccttggatacatattagtcttgaaaatccacttttttgattatgataaggtttaagggaatgtgcaagccacaggaaatatgattcatgacccagtaaaaacccaacttcaaagagacaagagtagaaaaggtggagctgaagaagaacataccttttttatgttctacaaccagaatcctctctggtgagaggggacaaaagacaagaagagcacaaatccccctatcacttctgagacagcctgtgatacaaagggtttcgcaacaaattgtgcatgaacatgagacgacacatgcctctgggtagaagacaaaacaaatatggtaagatggtgttttaggcagcaatctaaatttgactctgtgtaccattccaccttacttccctatgcctctccatataccattctgaaacaaatcaccaagatacagttgcctttattttaaaaatgaataataaccagagagcaatcagtagaggatttataaatagatatttggaggaggggaaaagtgagaggacaggaaaataaatttaaagaacaaagctggaggcatcacgctacctgacttcaaactatactacaaggctacagtaaccaaaacagcatggtactggtaccaaaacaaagatatagaccaatggaacagaacagaggccttagaaataacaccacacatctacaactatctgatctttcacaaacctgacaaaaacaagaaatggagaaaggattccctatttaataaatgatgttgggaaaactgtctagccatatgtagaaagctgaaactggatccctgccttacaccttatacaaaaattaattcaagatggattaaagacttaaatgttagacctaaaaccataaaaatcctagaagaaaacttaggcaataccattcaggacacaggcatgggcaaggatttcatgacttaaacacaaaagcaatggcaacaaaagccaaaatagacaaatgggatctaattaaactcaagagcttctgcacagcaaaagaaactaccatcagagcgaacaggaaacctacagaatgggggaaaatttttgcaatctactcatctgacaaagggctaatatccagaatctacaaataacttaaacacatttacaagaaaaaatcaaacaaccccatcaaaaagtgggcaaaggatatgaacagacacttctcaaaagaagacatctatgcagccaacagacacatgacaaaatgctcatcatcactggtcatcagataaatgcaaatcaaaaccacaatgagataccatctcacaccagttagaatggcgatcattaaaaagtcaggaaataacaggtgctgtagaggatgtggagaaataggaatgctcttacactgttgatgggagtgtaaactagttcaaccattgtggaagacagtgtggcgattcctcaaggatctagaactagaaataccatttgacccagccatcccattactaggtatatatccaaaggattataaatcatgctgctataaagacacatgcacatgtatgtttactgtggcactattcacaatagcaaagacttggaaccaacccaaatgtccagcaatgatagactgcattaagaaaatgtggcacatacacaccatggaatagtatgcagccttaaaaaaggatgagttcatgtcctttgtagggacatggatgaagctggaaccatcattctgagcaaactatcacaaggacagaaaaccaaacatctcattttctcactcataggtggaaattgaagaatgagaacacttggacacagggtggggaacatcacacaccggggactgtcatggggtgaagggcagggggagggatagcattaggagaaatacctaatgtaaatgacgagttaatgggtgcagcaaaccaacatggcacatgtatacatatgtaacaaacctgcacattgtgcacatgtaccctagaacttaaagtataataaaaaaaaattctactcagtaccattgtttaaacatgaatttttaaagcattaattcactaacagtatccttttttattagcacataataaagagaataatcgttaatgtgaaaaaaattatttaccagaagaggaattactccatacaacagataaagagttcagttatataggtcactacatattcaaagaatgtcaagatgacattaacgtacaaaaataaagttcaaagaagagttgtgaaagatttaaaaaatatgaaagagcaaaaaagaaactctttgatgaaagccatgtcagagcaataaaaactgattaaatataatttaaaaatcaatgaagggataggaatatatagaataaatgagttcacacaaaatgaaatggaaaagagcaatcatgatgacacggttgtagaaaagataataaataccattcatcatcacaaatgacatttaacatatgcaaacttgtatgcctgaagaatttagaaaaatggaaccaaccaatatttggttattataaggggaggtctttctataatcttcagatcaaaataatcttctgatcaaaagagtattcccccaaaaacctgattcagaacctaataggtttaaagaacttcaaagataaagaactgcatgggtatataggcaggaaaaaattgttacttaaaagtaggaaaaaccaggctggcttcaggcttctgagtcacatctacttcaagaagcagtaaggcaattcctacaagttcattattttatcaccattcagtctctcattatctctctaaaatctacctttagtcttctacactgcgctgaagttaggattctcaaagttcaacaatgacttcttcatcaaaatatccaatagattatcgctttttctcagttctcattctctttgacttctctgtctcttttggccctgctgatcaattccttctcaaaagtctcttctttggctttttgatattgcttctttcatattttgatatcactattcttttctcctatctctctgacttctcatcacatttctgctttttctttctataaccaaaaagcaaacatccccctcatttgactggtgaccctatgccacattcctctctttgaaaatctatccaactctatagtttcaactataaaagtcaatagaaatactcccaaatctatatccccagccttgacatctattctttacttcagcttcttcaactcttctaacagcttaattaccaacagctctttaaatgtttcatttttctctcctaaaattgactttccctcttaattacagtttttaataatgatatcaccattctctcaatctgcaggcttaaaatttgatagtcatcttttattcttttcctttttgcttggtccctaggtcccattaatttcctagttctaccaagtcttcctacaaaatctcttgaatcctacttttcctttgcattttcactgctgccaacctagataatgttctagtcctttaacaccaagatggtaacagaaacttcgtatcctggacactgttaccagaccgattttccaattaatacctctgcttagaaacctacaaaattcccctttgagaacaagataaagttagaatgatcatttgacagttaagaatgcccacaacctgacaccatcaagcttggatctttatctgtctgctttagaggaagaaaacctggattcaaatcctggctctatcatttaccaacaatgtcattgtgggaaagtaaattaactctttgggcttcagtttcttcacctgaaaaatgaggataacactacaaactttacaaagttattttaagataatatatgtaaagagactggtagagcatctttctcaaggaactcaataaatgatagctattatgctatcataaaaaaaactcacctactcctctcacctgtcaaaatcttacccattcttagagcctaggtcataactaactttgtccacaagatcttattctgaatagctcagctttaagtgacctttcatagagactccatcaaaaaatactatttttttaacctttgaacatctctagcccatacacttactttgcatctctctgcagcatttatcctactttactacaagatatattaaatagttataaatgtacttcctttatcttcattatgaaatataagctttttctgagcaattactgagttatacatactttgtgttcctgctttgcttatagcagagactaagtaaatatctgctgaatattactgcttcacctgccaatactgaatgactatttttgaatttacagaagagattaatgctcatctgatcagactgactttttctgaagaaagtaaatggcttccataactatttgcttaatattatatgtccagtgattcaattttatgaccaatatgttgataattaattgtcatagttgaagagtttatttctctataatagtatagtcttcatattttatttttaaatgtctaaacatttactctagcaagagtgactcaatacctatcaaatcacttctaggaataaccacaaaggaaacacaagctaaaagactggcttcaccttctcccattctatgatttctagagctaagccaaagactcaaattttattttcattaaataaatactttaagatatattttaatctacttgaaattttgaaaaaaaataatttctaaagacataaaggtaaatttaagtatacaaatatgaagcataaaaagaatatttccaacactgtgattttaaatgactttaagtggtttttaaatgattttagaaatttttaaatgttgatctctaattcccacctatacaacaaaagaaattcagggctgaaaagttcagtttattatctcacagttttgtttacatgatattaaacaagtgccttggttgtttttttcccctcactgaattgactgataactggttctttttgtgttaggcaaggggagctttaattaacccataaacataaattgaccatatcactaaagacagtcaacgattcattacacaataatctctatctaaagtaagttttacactctattttaatccatttgatgctattttgctgtaagaatatttaatggatgtatttaatgtatttttctttaacctaccatatcttttatatacttctcttaacatgactatgcattctcctatggttttcaaaatataaatatattatctatatttagcagttgaaatcctgattgaatttcaactgaacaagaaaaacaaatagtttgcccactacttcaccagaattaagtcacctttcagcctaccagatgaagaacaaaagcacgatatttgagccagggttacattctggcagatatgttacagcaaccataaattcatttactgtgccagaatgcatttccatgacagactttatctgttatgtattgtttggtccagagaactctctttaaaatgtattttaaagagagtttaaaatgtaagttagcatattaggagatattaaaaaaaaaaaaacttacgggaggtccagtgtctccttttggccctctcagatactccatttcaagcattgtatttagatcctcataataataataatcataaagctcagtttcatagctattttcgatgggataagtagcatcaggataaaattcaccttctttccttagatcaaggtgattatccacagatggctcatttgtcactctatgcaagcttgtgtttaaaattggttgcatttccatgagttcgttagtgtgtagatttgctgtgatagccttcttgagattagtaattgtatcttgtttaatttgtggaagaatagatggcatcttcttaaacagtgacagaccagttactctatcatcatgttgtgtgatattgtcagacatgtttaggagagagctaaatttctctttggtattcatttttgcctcactgatgcgatgagtggtcactgacaggctgaaatttgtctgagtatcttcctcagtgatcatttctttggcctgaatcccatggtttgtgagatccacagcagagacatttcctgactgaagagaagataactgagatcttgatatctggtgttcttgtcttttatacacggtttcagaatcattttttatgatatttggaatgcttttgccttcagtaaatgtatcctctgacagtactttttcagcaaatagtttgggcgggggagagtgttccggtatctttgttggtatgagagttgtacaaggaatgcttgtttcaggttggtatttgtctgcttggcgacactgctgtttcacatatctgcagtagtctgcagatgcttctgcagaaggaataatatctaactgacatactattccttcaaaatggatagaattattattcatacttcctaaagtaaacacactattagaatcaaaggtctgaacttctggaatagtctctgtgctaaaatatttctttccacactcaacaaacattgagacactttggtttctaatagtaatggcaaatgagtgccattgctcatcatgaacactgtagttgaaaactgcaggctgctttcctctaatgtgtactactaattttttaggtagtaattgtactcctaattgcagtctatttttatttctaatgctgaagagaaatgcattgttcacccgatgtgactgtaacccagttaatattgtaaacggctgccccaagttgactggtaaaattttcacgaaaggtgtctcgatataagcatcatttttaaaaatgactcctgattctgttaaatggaccccctgaggtaacggtgtagatgctgatggtacagcagtcgctggtgatgagtgtcttacgtctttgcctccaaggcctagttgatgaagaatatctatgcctggaaatttaaaaaagagagagagaaagaatcttaattttatggattcaagtgttcatataaatgtttgaatatgataaaaatcttccttgtagcaacagtagtttctaaaataagcatgttctatcaataactaattatgggtaataagaaatagggagggggagagtaagacattatactcaataatttgaataaagtacatgcccctccccctacacacacaccaatctctaaacccaaaacttatttattattagtttatttattattttagagacagggtttccatctgttacccaggctggagtgcagcagcatgattatagctcactgcagccttgatatccggggctcaaaggatcctcccacctcagcctcccaagtagccagcactacaacggcatgccatcatacctggctaatttttgtatttttcatagagacagagtcttgctctattgcccaggatagtcttgaactcctaggcaaaagcaatcctcccacagcactgggattacaggtgtgaaccaccacgcctgatctccaaaatttaattagtttatctctcttgttttccattttactgattcttatttgtcacttcaatgaatatacatgttcaaagattcccagatcccatttgtttctttgatttagaacttaaaatttaatgaaatctgtgttaaagtgaaagtggagtcatacttccaaagataattgtgatttggaaaacattttataaattaggttcacacgatcccttaaagtataatttttcaggctgtttttccttctaaccttctgggaatttacaagttgcatggaagctttcccaatgcctactaccttaagtgtgtgctacgcttaaagtattctggttaccaaagtcctttgataattcccggacaaaagaatttaaattcattttattggtgatcactctggtttttctgtcccttccaagcttctctttcttccacttttccagtcctccagagtaacttttatccaacttttagactctttcaatatctattatgtaatacgcattttatataatatggatttgatataattgtggatttctctgatttattattcatcgtaatattaccaatagtatattgtttgtctcctttacccaattaaaagcttctggaaaactggatatgtctgattcattattggatctcttcagcaccttccttgcaaatagttctataatttcagaatgaatgaatttgtcccacagcaatctgaccaggtctcatattcacctctggagtcatataaatttaaatatcacttaaaaagaatgacaaattctgtctttaaaatacagaacagcatagtcagctgcatgatctttattattctttgggttataaatttcccatctgtatctttgtataaatataatcatctccaaccagaaatgttacagaattgtgataagtgaaaaaaataaaagtctttgaagattagccaggaacgtttggcatcaccttactttttccttttgtaggaaattagtagatatttgataatgcatgcttattacaaatagcaaaagataggagagaatctcatttcccaagtctcacaactgtgtacaacaatgaaataattactgaatgccattcctgtgtaatctagcaatgcaattaaaatgttttttaacagagatcttcacaaaacactcaagtgttttattttaaggttagaacaaccatcattttatcaataaaatagttgtaatttcatgacatttttaaaggatagcaatatttgtatctatgatattgtatgacaaacttttccaccaaaatattcctaacaccagtgtagaattatatgcacctccaggaatttagggacatatttcaaagaggccccacataatcaacaaaaaaatacctttgacttcttatgttttatcatcataattcacacaaaatttaaactttaatccataatatggctggttgtttcaatatacaatataaattacttatgagctaaatcagctaattgtactcatccccaatcttcagtgaaaatttacaccgccgaaactagctatgttagtctgtgacattggatatcctcacccaggtttacctaactctaaaggtatgcctagctcaatctgagaagtaaactatggaaggaaccctgcttctgtggaaatcacaatgcttaaatttaaagtatatatgatcataaagtatctgaaagctataattctgagataccaaataagctacatatgtaaaaaataatcatacatgtggtatatcaagggctgcacgctgccccaagaacatctccccttgcatttattaagaacccctgccatctagtgcttcgaatttctgaccctattatacagaaatatcattgggaggagtattatttgaaaactttaaaaagcatatgtgtgttttcaatgtttctttatatgtatattaatatgcttcctccaattctatttttagtggagctttgatgacaaatagctgttttttaaaaatcaaatgtgtttgaacacttattactgaataaatttcctgttattgaaccatgattgcatccctaaaataaaatcttattagttttacgttattcttttggtatctcactggattattgactaatagttttatgtagaatcactacatcaatatgtatgagttgactggtcagtgtttttctcttattgtcctatatttatcagacaataaaattgaaatttcattattttctatagcctaaaacaatttcagtaacctttgaaattacattttttcccaaaaagttacaaaaactcacctataaaccaaattgatcatgttggctctttcattgatagtgcttcattcactttcctaatctcttctatgttaattgatttagtctaattttccactgcaccttgagacaattttagaaatttatatttttctatgaaataataaatttcctctaggcttttacatgtattacccagaaatcttcacataataatcccttacaattatttttgttttcctatgtctgtggccctctgtctcatttctctaattttggttattttgctttatttattcttaagtctgtcattattggtcatttcaaatgtatacagccttcagatttatttatctactatttttgttcattttctctatcattaattttagaatttatctttattaattatctcttcccatttttttttgttttactcttttgctaatctctgaagatgaataattagtcctttatttttcttttcttgcttgataatgaaggcatttaagttatacattttcctgagtgctgctttagctgcatcccatagattttgatatgtagcattttcatttttgttgttttctggaaagtatttttatttgtattttctctttgacccaagtggtttaagaaaaaagttttaaattttcagttaggaaggtctttttgttttctgattttgttattaaaatctaacttaatagtattatgatcagagaatggtgtctaatcagcactttctttttcaaaactcaattagcctcataagtggtcaattttcaataacatttcataagcactcggaaaggtgtttgaaggtacaaaatttaatacataccagttagttgtacctcattgtttatgttatttatatcctctatattcttgtttatttttgtacaattaatctgccatcaactgagagataaagtatcttaccagtagtgtgtctatttggccttttctctcttgtggtctttgctttatgaatattgatgtcatggtttttatgcatagataatcatgcagttcacatatttattgagtactgcacctttcagaattacaaaaagaccttctatgtctagtttattgggttttatatttttggcattaccttaactggtagtaagactaagcttccctcatctgactttctttttgtttacatttgtctgatatacctttgcctttgtttttgttttcatctactgtgaaacactatgttttaggtaaagacaaagggattgtatttgttttttgatccagtctgaattgttttctttgaatgtataaactaaatctatctacatttgctaatattatggtttgtttaatctgttgtattattttatgttttaccactttaattttttgaagtctttcactatgtagtttgtttcctttgctttgctttgtgtatgccttttgagatttagaagggtttgtatttttattctaagggtttcctttaaaattttaaatgtatataatgcccccagtcctttcattacacatatctattaattctttcctttacacaatgttttattttcctccctttaaccctttcccataccttctaatattagtctataggagtatctttcatagtgtttatcttttcattcttaaatatccttatatttctttcatctaatttaccaactgtaaaatatttaattcccagcttcttcagataaggcaatcagcaaagttaatctactcttcctattcttcctctcttctcctaccatttttctgtaattgtaccattcctacattgttagtttgtatggcatttatatttttctttttcccacattttcttttgacaaatagagccagacttttgtagtagcttccccaatcacttctctttggctgaagtttatcctctattagtttcctcaagaaggtttacgggaacaacatttcccgagtgttggacttttcagaattgattttttgtagccttgtaccttaaatttcatgggatataaaattctttcatgatactttatttccttgaatatcttgcagctgctgttccatggttctcaggtagtctttctaaatctgaagtcagctaaatatttttctccttacaagtgactccgtagttatcaacattcttcaagagttgttctttatctttgaaatgcaggaattttataagaatatggcaccatattgaccattcttgataaatgtttccaggtgcatagtatgatcattcattgcacaggttcaaattttttttatttacttcagcaaacttttaatgaattgtatccttgaatattggttctatttcatagttttggttttcttttttatatatatactttaagttttagggtacatgtgcacaatgtgcaggtttgttacatatgtacacatgtgccatgttggtgtgctgcacccattaactcgtcattaacattaggtatgtctcctaatgccatccctcccccctccccccaccccacaaaggccccagtgtgtgatgttcaccttcctgtgttcatgtgttctcattgttcaattcccacctatgagtgagaacatgcagtgtttggttttttgtccttgtgatagtttgctgagaatgatggtttccagcttcatccatgtccctacaaaggacatgaactcatcattttttatggctgcatggtattccatggtgtatgtgtgctacattttcttaatccagtctatcattgttgaacatttgggttggttccaagtctttgatattgtgaatagtgccgcaataaacatatgtgtgcatgtgtctttatagcagcatgatttataatcttttgggtatatacccagtaatgggatggctggatcaaatggcatttctagttttagatccctgaggaatcgtcacactgatttccacaattgttgaactagtttacagtcccaccaacagtgtaaaagtgttcctatttctctacatcctcctctccagcacttgttgtttcctgactttttaatgatcaccattctaactggtgtgagatggtgtttcactgtgattttgatttgcatttctctgatggccagtgatgatgagcattttttcatgtgtctgttggctgcataaatgtcttattttgagaagtgtctgctcatatcctttgcccactttttgatggggttgtttgtttttttcttgtgaatttgtttgagttcattgtagattctggatattagccctttgtcagatgagtagattgcaaaaattttctcccattctgtaggttgcctgttcactgtgatagtagtttcttttgctgtgcagaagctctttagtgtagttagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccattttcagctttctacatgtggctagccagttttcccagcaccatttgttaaatagggaatcctttccccatttcttgtttttgtcagatttgttaaagatcagacagttgtagatatgtggcattatgtctgagggctctgttctgttccattggtctatatctctgttttggtaccagtaccatgctgttttggttactgtagctttgtggtatagtttgaagtcaggtagtgtgatgcctccagctttgttcttttggcttaggatggacttggcaatgcgggctcttttttggttccatatgaactttaaagtagttttttccagttctgtgaagaaagtcattggtagcttgatggggatggaattgaatctgtaaattaccttgggcagtatggccctttttcacgatattgattcttcctacctatgagcacggaatgttcttccattttttgtatcctcttatttcagtttgtagttctccttgaagaggtccttcgcatcccttgtaagctggattcctaggtattttattctctttgaagcaattgtgaatgggagttcactcatgatttggctctctgtttgtctgttggtgtataagaatgcttgtgatttttgcacattgattttgtatcctgagactttgctgaagttgcttatcagcttaaggagatttggggctgagacgatggggttttctagatatacaatcatgtcatctgcaaacagggacaatttgacttcctcttttcctaattgaataccctttatttccttctcctgcatgattgccctggccagaacttccaacactatgttgagtaggagtggtgagagagggcatccctgtcttgtgccaggtttcaaagggaatgcttccagtttttcccattcagtagatattggctgtgggtttgtcatagatagcacttattattttgagaaacgtcccatcaatacctaatttattgagagtttttagcatgaagcgctgttgaattttggcaaaggccttttctgcatctgttgagataatcatgtggttttcgtcattggctctgtttatatgctggattacgtttattgatttgtgtatgttgaaccagccttgcatcccagggatgaggcccacttgatcatggtggataagctttttgatgtgctgctggattcgttttgccagtattttattgaggatgtttgcattgatgttcatcagggatattggtctaaaattctttttttgttgtgtctctgccaggctttggtatcaggatgatgctggcctcatcaaatgagttagggaggattccctctttttctattgattggaatagtttcagaaggaatggtaccagctcctccttgtacctctggtagaattcggctgtgaatccatctggtcctggacttttttttggttgctaacctattaattattgcctcaatttcagagcctgttattggtctatgaagagattcaacttcttcctgctttcgtcttgggagggtgtatattttgaggaatttatccatttcttctagattttctagtttatatgggtagaggtgtttatagtattctctgatggtagtttatatttctgtgggatcggtggtgatatcccctttatcattttttattgcgtctatttgattcttctctgttttcttctttattggtcttgctggcggtttatcaattttgttgatcttttcaaaaaaccagctcctggattcattgattttttgaaggttttttgtgtctccatttccttcagttcttctctgatcttagttatttcttgctttctgctagcttttgaatgtgtttgctcttgcttctctagtgcttttcattgtgaagttaggatgtcaattttagatctttcctgctttctcttgtgggcatttagtgctataaatttccctctacacactgctttgaatgtgtcccagagattctggtatgttgtgtcttggttctcgttggtttcaaagaacatctttatttctgccttcatttcggtatgtacccagtagtcattcaggagcaggttgttcagtttccatgtagtcgtgcggttttcagtgagtttcttaatcctgagttctagtttgactgcactgtggcctgagagacaatttgttataatttttgttcttttacgtttgccgaggagtgctctacttctaactatgtggtcaattttggaataagtgcgatgtggtgctgagaagaatgcatattctgttgatttggggtggagagttctgtagatgtctattaggtccacttggtgcagagctgagttcaattcctggatatccttgttaaccttctgtctcgtggatctgtctaatgctgacattggggtgttaaagtctcccattattattgtgtgggagtctaagtctctttgtaggtctccaaggacttgctttatgaatctgggtgctcctgcattgggtgtatgtatatttaggagagttagctcttcttgttgaattgatccctttaccattacgtaatggccttctttgtctcttttgatccttgttggtttaaagtctgttttatcagaggctaggattgcaacctctgcctttttttgttttccatttgcttggtagatcttcctccatccctttattttgagcctatgtgtgtctctgcacgtgagatgggtttcctgaatacagcacactgatgtgtcttgactctttatccaatttgccggtctgtgtcttttaattggagcatttagcccatttacacttaagattaatattgttatgtatgaatttgatcctgtcattatgatgttagctggttattttgctcattagtttacgattttcttctttaaaaattcgtattatgagtatattgaatcattgttgtcttctatatgtctcatatatcatttctctataatcctttttattatgttctttaaattcatttttgtttgtttgattttcttatttgtctttactgtttcctacaaagtataacttccctttgtgctccttcccatttcatcttgatttatgagataatttttgtatgacttctttactgacttctacaagctcacaattcatatccttttaatatattgccttcttttacttttccctgagttctttcatttctgccttagtatctttctttgtgtaggtgataagggggacatatttggtcagaatatttgtcagtttaacagcaacatttttttgtgtgtacattctcatttttgctgcttttccttacatgtttccttattgtatatttctacttgtgctgtgccaactccttttgctcattaattcctagcctagcaacttatagaaagatgctggcagaagaagaggatgggctgtgacttccaagtctcaaaacccaaaggctctgctccggtactaccagtttcattctaaatggcttctagccccaccttcttctctaaaccaaatctagtccaggaggacttctgcagccagctctatatacaacccttcattctctttcctccatatccactcacattggtatatgcttcagaatgaatccttcatctcagtgagtagatttttgcattttctgagatctgtccccactcatccattttagctattatctgtgcttatttattatactttccccttggcagcttctgccttccccagaccctgtagcacttgtgtacaagggctaaatgtatattttggggtgtgtttctcaccttcaggaagtctggttttgctggtgctttctgaagtctcactattgaccttattccatatggcatctgcttttctgagcacattttggggatttgcagattatattagtcccctagttttgctgaaagtgatttttaagtttattatttcattcatttttttctattgtatgatatccaaggccaaaaatgggaagatagtatctcttggtttcaactttatacttaaagtctacacccatttcacaaatgaaaaatctctgaagcacagagagattaaataacttggtaaaggtcacacagctgataaatggtagcgatgcatttgagcccaatcaatatggctttaaggtctctgactgctccaccacacgacctctcagccattatattccccacaccactccacatatcccttggcaaatctcactaattaatcatggcagtattacttttaccccacagaaatctcagtggggaatactctctagatagccaccaaaattggtacctgaagtgaaatcatcaaattgtcatcctaattttaagctttcttacctgagtatgaatacacttagcaaatgtgtttgagcaagatcttaagagaagagagattaaagaacacttaagggtagaaggcacatatgactggagctgaggagaactgcagacaaaaaaaatgggggtgggcaagagaagaagaagaaaggctttcactcagaggtcagactctttaacatgtaatttatacctggacttggatatcaccaaattacaattaggggttgaatttagatatttcgtaccaatgtttacaagaaataactaagttgccggaagtaaattgcttgttttgtgagtggccctatataaaaaatcaatccagttcatgtcacttggaaaatcagttaccatttaaagaatattaatgatcaacccagcactatattaggtgctttacatttttaaaaaataagaattatagcagcatgtattaaatttccatgtaccaagcactattctaagaactttaatattttaagtcacataatttgcataacaactgtatgaagtaggcactgttgttatctacatgtgagagttaggaaaagtaagtcatagaaaagttaaattatttgcccaagcttacccagctagggagtgcagaggcagaatttgcatgcaggtcatctaaggccaacttcttaacatggtgaaatttaggaaaggtttgtgttaagtaacagcagaactgactgtatctccttcctttatttgcttctgaagtgtaaaataaatggtggtgtcaccaagacaacgacttgttcttttttctataaataccaggcctaatgacttcatccaaaccatggctgcaacaaccacatatgctgactcacaaacctctcttctgggcttgcatatccaattgtctattgaatttatccaatagaaatgagatgtttcaaaagcatttccacttcaatgtattttccccaaacctcatttttcttacttgagtgcttctctcagtgaagagtctcacaaccacacaagcaggcagaacaatcttttcatagtgtaaagtagattatgccagtcttctgaccaaaatcgtccaatggctttccatggtataagacacctatgccatttattctcttcttatctctctgatcacatctcctatcattttatcttacctaattttgctccagccaaactagtattttccttcattcttaaacccacccaactaattttaaactcatggcatttgtacttactgttctttcttgggacgctttaaacccgtgtattgattttaatctgtatccttaactgtgaatatattgattttaatctgtatccttgtattgattttaatctgtattcttaactgtgaatacaacacttcagtgaactctctgagtataacgaattttggtaagttctgtgagtccttctaaagtattactgaggctgagagtagtcttggggaccccttaacttgaagctagtgtcagaagtaagggtggtctttgggacagctctctaactttatactaccctgatatggtttggctgtgtcctcacccaaatctcatcttgaattcccacatgttgtgggagggacctggtgggaggtgattgaaccaggtctttcccatgtttttctcgcaatagtgaatgggtttcactagatctgatggttttttaagggggagtttccctgcacaggctctctctttgcctgctgccatcgaggtaagatgtgacttgctcctcctggccttccaccatgattgtgaggcctccctagctatatggaactgtaagtccactaaacctctttcttttgtaaattgcccagtcttgagtatgtctttatcagcagcatgaaaacagattaagacataccccttacttatttttctcttcactgatatatctgctcacttcacagcattctccactctctgtatgtactcttccttgaatttcttgccataacaaagcttatctgcttttttttttatctcatcccgtcagagccctgctaagtatatcccttcatgccaatctttactcatcctgcaaggctcagttcaagtggttacctcccctttaagtcatcagcgcaatttttgtttgttgttgtttcgttaaacactgatgagaaatagatcctctcttagtatgctaataaaatcagtcttctaagcttacaaagctgacatactatataaacacagacagcccaaacttacttgcctttcatttgaaacttgtagagtaagcagcactgatgttgttatcacaagttagaataaaagaaagatgagggagaaggagaaaggggggggagagggaggagagagaagtagtagatcgagaaagagggatggagaaagagtgagggagaaaggtgaaattaagtcttagtagaggataaaactatgactcataaccaagtctttgactctaaactcagtgactatatcaattgactctgtggggggaatatagtatatgcctaaagaaatagatatgggagatccaatggttataactcattttacaagtacagagaaccaaagaaccattaaatgtgtcaatattcagcgatagtctatcacaaattggaagaagaagaattgtactattatgtttactacctcaaaatggacagatttttacatctcttagtaattggtagtttaaaatacttaaaagaaagttaccaatttttagataaaaaggagtaatatatcgctttataaagtataacaagttacagagttaactcttaactattaaataactaaattaatataacatagcacttaaatttaatgaattctcactgtttaaaattttcatatgtcttgatcagttacatcccaaagctatattctttccagtttgtaggaaagaacaaatatgactgtttaaaataaaatcaccaaatttgcaaatgagaatgattatagacttcgacacacttttctttttcttgccaatttacttaaactgactaaattaactagataattgcccaatattcattttgtattattttttatagtctcagctaaatagtcaatatcagaatcaagactcaaatacagcttcctagctccagttcactgaattaaggaactaaaggaaactgtttaaaataaaccattttattttattttttcaatattatgaggatatgggaaaagaaaaggatctggagtattccccttcttctaatcaaagttattgtatccttatgtaacaggcactgtgctaagcactttacatgtgttattttatccacacgacagccttgtgtagtaagtattactattttcttcactttagcattgttaaaaatgaggctcagagagtatttaagaaacttgctcaaggtcagttagctaataaatggcggaaactgggcttaactctaagatgctggctctggaacacctgtgcttaaataccactgtcacactgggtatgttaaaggtggcaatcgtttcttagaagtattcttactttaaatagcacatctattctgtataaagagataaatgctaatttatttataaaatgagaaatgaagctctaagctgtgtatagaagttttggctaagtgcccatacaagtgtttgtgaagaaaggacttgaagttactgcagctacaatgaactgcttctgttaacaataaacacatttcagattaatttctatgggaaattcttcgagatgaatattctacacagagatttttacacacgtggttttcacacctagggatcatgaacctgagaaagatgtgcatgttaagaattagttacacattatgcatggtgcaagtcattgtagagaagtgttgtagctatgccaacatctcactggcagccatcccaccaacacagacaaagtaataacaaaaatacacatatcaggtaagaaaaggtatctacatctgtcaaatcctcagaaaactcagacttacataattaatttttctggagatagaatcatttattcattagattacacctaaaacttggacataaaaaatatacaatttacatctattaataaggtacttaaaatgttttttcttagctgtgttaaaatttaagggaatttactgaaaccgtgacaaatcacatagatgcttatttcttctcattcttaaaatcttactcaaatgagaataaggaaatgtggtttagaactacagggaaaaagttaatgagtagaagagacaacagcagacaaaatatatcaacaaatttttggaaaatgaaaagcacacgaagaaattaccagagctgaaaaaactgaacctaagggcttcagaggcaaatgctaatgacaggcaggctgattcatattgcaaaatcctgaaaaggctcaagaattgaaggcaccaaatcaatgaattcagcattgaggcttcaaattgggggttgaggatatgtgagggtggaggattgaaagtttgtataagaagtttccagactaaaggagaccaaaggttaatgacatagaagcattgaatcaatcgtagaggaaaatggaagggaagctctgtattgagaagggatttggctaaaattgacatacaaaattgtgagacaatcctccccccatcaacccaagaacctctttatatcactgaactctaataacagtggcaaccaggattatattctacaagtaaggtattggaggatccttctctacatgccttagacatgtgtagcctaacaaaatagtcagacaggtttctacttaatcatcctctatgtgaaacatctcagttaactagcctacccatgcaaacagttgttaagcatatttttagtgtcttacttttttttttttttttgagacagagtctcactctgtcagccaggctggagtgcactggcacgatctcagcgccctgcaacctctgtctcctgggctcgagtagttcttctgccttagcctcccaagtaggtgggattacaggcatatgccaccacatccggctaatgtttttgtattttccagtagagatggggtttcaccattttggccaggctcgaactcctgacctcagataatgtacccgcctcagtctcccaaagtgctgggattacaagcatgagcctcgcatctggccagtgtcttacttttaaatgataacagaaatgttgcatacttataaacaacttctccaacataaaagacagaccaatacaaaaatttagaacaaagacaatgcagagagcagaagaaaagttgaaaaaatcgtcattcttatccttacagagataaaagtagacattgcatcaaagaaacgagaacaggatgaaaaaaaaaaagactagtctcagtgaaaaaacccttaaaaatttaaacacagaggccaggcgctgtggctcacgcctgtaatcccagcactttgggaggccgaggcgggaggatcacgagatcaggagatcgagaccatcctggctaacacggtgaaaccctgtctctactaaaaatacaaaaaattagctgggcgtggtggtgggtgcctgtagtcccagctactcgggaggctgaggcaggagaatggcgtgaacctgggaggcagagcttgcagtgagccgagattgcgccactgcactccagcctggacgacagagtgagacactgcctcaaaaaaaaaaacaaaaaacaaaaaacaaaaaaaacaatttaaacacagaagaaataagaaattaaacaaaatgtttggaatagtaagtgatgaaaaatctcacataaagtagtacataaaacaaagacggaaaataggatctaaaaataagaaaataaagagcccaatactgaagatttaatatttaaaagatattgaagaaagaggaaataaatatatcaggaagaaaaacataacgcaggaaaattcccagaaaattaaggatgcttccacactgaaaaggcctactaagtgcctagcacaatgaattgtaaaaagacctgtaccaagacagattattgtaaccttccaaaacatcaaagataaatagatgatcttaagggattaaaagggaaattaaaaggtcacatataaaggatcaagaattaatataacatcagatttaaaaagtctgcaagccagataaaaaaaggcaaaagatgaaaatatttcaaattctgagggaataatatttacagcctaaaattttatactcacctgaactacctgtaagactgagaataaacacattctcagaaatggaatgttgtaaaaaatgcaccacccaagtgcatattctcaggatgcaactagaggatgtgctgcacccaaataaataaggaaatagactatgaaaaatgacataagacttccaagaaactccatctaacacagatatcagctctactggaagcttagagaactactggtccatagcagagcagaattttagcatgcagaaggaatatctccaagaaaagaatcaaatttctggagtacttggtgcgtttgggggaaaatatatttcaaaatatctgagatttagtgatagtgacatagaacataaagcaaacagaaaaggaggcaatcttgttaattcacaagaaaaaaatataaacgtacatggctcagtgataaaaaaatatacacatggtcataataagctgaattgtgaatattaaattaaccaaaaattggataaaactatattgagagaatagaagtagggaaaggagacacagagaatagtaatgttaagtcctcatcattaataataggaagtcaatataatatttaaacatattatagtattaaatatagatgttaaaaccaaaagaaggtgctaaaagagtttgggcagacaatagtaggagtgggtaaggggaagggacactgctttttgctatatgttttgtcatacaatttggcctttaaactttgtacagtacttgtaattctttgatatacttttttaagttttgaaaaatctcataagcatacaaatatttatttctgataagtctaacttaggataatctctcactcaaacatattcagcagtattaatataaataatatctgtgatcatataaaaacacaatttatctgataatggttttccagtctcctgattagatgttacaaattgcatcgtgccaatttaatcagaaaatttcttttaggaaaaaagtgtttctaagtttctgataatatgctatttccatttctttttttgtgctcaaaaatattcaattttctaaagtctgagaggttttctaaaggacttttctttttgttaagaactggcaataaaattttaggtgtataaaattgaaaattatgatgcttgccctgaaataaaataacatattttacattccataaatgagatcttaagggtgagagaaatatgttgtttctttcatttattccttttgttggttctagatttttaaaaaataagttcataaatatttaattttccctatatctttctttgcatgggtttctaatattttgataataatatctttggtaaattattaaactcataatgccagtggctggcaactgtgaagctagaggacgtctaagggaaagagttttgtcttcagagacggacagacctagattcaaatctaagctgtaggtgagccacttctttgagtctcagtttcttcatctataatacctactctgcaggttcattatgatgattagaataatatatgtaaagtaccagcaaaagagatgatacaaaatatacatttaattaataattgtattcttctcttccttatcttctctgtggctctaggagcctcaattttaaggaatttgtagactttgcagtcaaaatatgagctcaaatcttggttcttccattcattaagcttttacttggaggtggttacctattctccttaatctcagtttcagcaattctatcatggccataattacaaaaccctgtgatgaggcagcagtgaagtaaatgtacattctaatagcacagtgactagtagctcatagtaagttctcagaaacagtaaccgtgataataacaataaattaagagagagagtttttctcctcttcatggctacttcaagctaaatgaagtaacataaatgccttggttaagaatagtttttcatgaagttacatgtgacatgtggcttaatcatttcccataaaagagatttagaaaatgtcttctaagaaatattttaattcatctatgtgatatttgaaagaatatttatctgtatctacttgtcaatttggtcaaccagagtaccactcttcctttttgccctctctctaccttgcacatatttcattcataatttgtttacttgtctttttcttactgttatttgatcaattgatcaaactgacaaggggttcatcaaactgaccactcaactgaaaacttggttctgtaagaattaatgctttggcagctctgtgcagaagagccctttgctacctttaaggcagaggagaaaaacaaacaaacaaatctgaggccttggtaatattatctgtaggtccagcacagttctaggatttgtctctttgactttggtatgttttttacctttgataaaggcatttttttcactttgatgctacagacattatcttatttacatttccaatcattggcaataggatattacacaggaaatagaagatgcatcaatcatgtttaaatgaatgaattaggatatacatagactcctgaaactctatcatcatactaccagagtaattaactagtaggcacaaacaaaacaggtttaggtttattttctaaacctctccatttgaattacatagaatcctaagcccactagtatgcaaattccattttgtttcttaatgatgcaaatctggacggaacattttttatatgcttttgttgtatcaagaagtgcaaaggtaattcagtcacagtttgccacccccaagaactcccacttaaaatgaagtcacaagcaaagcctttttattgtacaaaacttcttttttatagagtttgcttaaaaatgtaagcaatttcacagacggaagatatgagtaatttcttaaaggtcgtatttcccctcaaaattggtttctttaatcttacattctcatggtactgggtggaatttttgttattgtttaatgttgaatttacagttataatgagttgaaagttatgtacttttgctgtctggaagtagaatttttaagtaagcaaataaattaaaaggtaattttcttaccttgttcttgtgcatgaacaaccaccccagccacacatagtacaataaaatgaagaagtgatttcctaggaaaagaaaaaagcatttgggaaaaacttactagttggacatttacaaccatatagaatccaaaacagtctatgcaagattaagaattaagcaattattttaaatagcatgatattttaatattcatagtggttaagaccaaaggctctgaagtgaaattccagttttgccacttactatgtgacttgggcacatttttaatcattctatgccttagctgctttatctgttaaacctatctcataagattttctgaagattaacttaaaaacttcatgtaaagcacagaaaacagtacctggcacataggaaacattcaataaatatgaactagtataggtggtattattatcatatattatgttaaattaccatatatgcaatttcatacaaagtaatagaaatttccacaaaaataacgcaaattacagttgcttaactatagtgattataagttaatggaaccagctatttatttgtttaatggttatatgtgaaagccatttgaatatcatacttaaatcactcgtactagattcatgattttttggttttgaaaatagcaatggcctgtagatgtcaacattgagcattttgattagtagtagctatgagcacaatacccaatcactacaaattaaaatgtccattagtattgataagctatctaagcaaaaatgttttgtgacattgctagtataaccaaacttttaataaattttgttgaacattcttcataattggctgtatctacctccaaaatgaaaattacagaaataattttgaagagagatgataagcatgctgaaaacaatacttcattacctaattttgctaatatagaccctgattctgtttttgattctaacccagggactgttcaaatgatgtatttgtaaaatgcagttccgcaaggagtgattatggagctgtctataaaccattaattcccttttattaaattcctgatgtactagtagtaattggtacattttctatttattactaataagatgttttttacctttaccaactagtataaggagcatcttaatgtaagaaagatgatctttttacaaagcttaagccagcaaatatataattcgactatttataatggaacacaaatttcatttgtattaaaatggtatttatcctttgttagtaattttaaaattgaacattctatggccgtactcagtccagagcacagctcttataagacaaggtttcgatagaatacttaacaactgtcactaactctacaaacagatcaactgaatcattgcagagatttcagctgatatggataaataactaaaccatatattctaatgaggcctatgaaacattcttatatatggcattattcatgtagatggatggttcccaaatgttagactcacctgaggaacttgtaaaaaatgcagattttgggccctgacacagagattatgattcaaaaatttgcgatggatatgcaggatgcatacattttaactaggtgattctagtgcagattgtacgtgtgccaaactctgagaaaaaactatttagaacattcactgtgtttatatttacaatgttattaaaatacatctaaattgattttacttttgcttaaatcacatatatctaattttataacatgacatgaccctaaaatattatttggcccttttaaaatcctttcctactgcactaggtcagtggttttcaaactttagtgtgatcagaatcgcatgaagcacttgtgagcaatcactgggcctcacccccagaatttctaactaagtatgtctggggtggggctcaagaatatgcatttataacaagttcctgggtgtactgacgctactgatctgggactacattctgaggaccactactctaaaataaatgaccctcaagagatgatataaagtcctcctgtttggatctttttaccccttggctgcacactggaattacctggggagttttgttttgtttttgtttttgtttttgctttcttgagatggagttcgctctttgttacccagtctggagtgcagtggagcgatctcagctcactgcaacctctgcttgccaggttcaagcaattctcctgtctcagcctcctgaatagctggaattacaggcgcctgccaccacacccggctaattttttttttattatactttaagttttagggtacaagtgcacaatgtgcaggttagttacatatgtatacatgtgccatgctggtgcgctgcacccactaactcgtcatctagcatgaggtatatctcccaatgctatccctcccccttccccccaccccacaacactccccagagtgtgatgttccccttcctgtgcccatgtgttttcattgttcaattcccacctatgagtgagaatatgcagtgtttggttttttgttcttgtggtagtttactgagaatgatgatttccaatttcatccatgtccctacaaaggacatgaactcatcatttctcatggctgcatagtattccatggtgtatatgtgccacattttcttaatccagtctatcattgttggacatttgggttggttccaagtctttgctattgtgaataacgccgcaataaacatacgtgtgcatgtgtctttatagcagcatgatttatagtcctttggatatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactgcacacccggctaatttttgtatttttagtagagacagagtttcaccatgttggccaggctggtctcgaactcctgacctcaggtgatctgcctgcttcagcctcccaaagtgctgggattacaggcatgagccaccatgcctggcccacctggggagttttaaaaactaataattggatctttctctccttgccccacagagattctgattttaatgtgtccataacacaggcattttaaaacattttccactgattctaatgtgcaaacaaggttgaggaccatcacgcaagattaaaatgatgtgtgggctctccaggatgtatcctaatatgatttagagcttgagtaaggaggctatttacctttcaaatttatgtttcaacatataactggcaggatacatatcagcgagactagaaaactgcttacttaggattacagtcaatgaaggatagtgcatctcaattatgctgtcttaagtataaagttgaatgtgaatggaagcatgtctcacctgcccaaggtaatcagcctcactcagatgcatagaaacaacccaacaggcacttttcccttaaaaataactaatgacaagtacaacagccagcactactcatttagcaattcaacaaactcataaacttccccaatgacctcagtggagaaaaatggaaataaacatgttaacaagtccattcctggtgtgaggcaggaaaacctgagcacatcaagcatcattctttagacaggtgatcctaggggattatgacaaaccagttgagccataccttgcataaatgtacctgtgtatgaaagctgatgactaatggactggtagagatcaatgactgaaatagattctctttctctttgtctagttacaaccaaaacaaatagcgaactgaaaaagaacaggtaaagtttcttacaatgcattcaagacccttattatttagcttcaatttccttttttagcagtatggatcccactacccctgatatctccaaagttccagccatacaaagttattctccatccactggaaagaccttgtatatgtctgaaatgccctaccagtctccacttaccattcttaagtacacccaaagcctaattaaatcaatacttgctccatgaagtttcccatcatctctaaaggggaatgaatctttcccccacctctgtacttttgatacattaattgtgactttgttatactcctataagtcctaccttttatgaaagtaaatatctgagcaagcagcaggtcttcatttttacctctagtgtacccatgtgttacatgaaattgacagtaaatactttttaaaaggaaatgatcaaaagtattatctcccaatgactgaggaattcactttttccttatggacttgattcttttaacacttggaaaaaataaaataaaatacaggcaattttagttagatgtccaaagaaagagaagggaaatagaattttttaaatctgctatggtagcatatatggtagccttcttcttttttttcttaattttcattttagctttcttgtctctgaagtgggtacaacagagaaaggatgaagtttcattgacatagtcagtttgataaagagccaaaccattattgtatatgggtatttaatgaatccaagattcttgggaaatgtctgatggactaggtttgtttgtttctttggattttcctccttatgatgttacatttattatacatttcctcaacaaataaaacttatcaagtttccacattagcagtagatggtagagtcctctatggaagcagctgttctttgtccttctgggtcttagctgactcatctatcatgtgatgacataatacaaattttatgtttttgtgttttacattccaaatgtaaaatcctataatttgtgtgtgtgatgggatcacattagtatactggcattaaaagacaaaaagcaaattacttagcaaaatgttatatatataggtgtgtgtgtgtgtgtatacacatacatatatataaagggtttgtatatatgtgtgtgtgtgtgtgtatacacatacatatatataaagcgtttgttatttaaccacaaaactgtaacggtcttcctatagttttggtccaatactatttaagtaacctaaaatagtctactaagttgttaattcattcatatatttagtttactcccacaaacagtctagttggtatattaaacatgaacaatttttgaatattcaaaacatgtttgttttcattcactggtttgtatatgtggaccatgtgtcactaatacaaagttatagagttatagttactcagacatttaacaaaatcagaccatatccaaaataaatcaacaatatggtaacaaacacttcataaaggctcaaaaaatataacccaagatattgatagctaacaaaataagaaacactctgcatgagtctggctgctagtcacattttcactttgacaccagcaacagtccaaacataaccagacatgtgagggtaaaggcctaaagaggataagacagaaaatagatatccaaagaccatactcagaacatgtaaatgactaatacccattccaggcatcgttcctagatgattcttagagctattcaacttcctctttattcaaaagatccaagttgctttaggggaatccgagggatcttttgcttagggtacccctgagactctaaggtattataacttatgtcttcaggctactgatgctcacttctacatagattcaatttataatagtgggaaggacttgtgaaatcttgtgaatagacaactttttatgagttggtggccttcttttaaaccaattgaaaatggtgaacaaatctgaaagacacacacacgtgatatacatcaataatttcaacaatttccaccacgctacgtttacatgccaaaaacttctctaagtcatgacagctttacagattttgctctttactagctactaagatcgagaaatagtaaaatttctgttctttcctctcaaaataactgaaaaaagagttttcatcacagcagtggacataaagttggatgattcagggagcaaagtagtactgtcactaacttacttgcaattaatttttcagactattaattcaactcaggtggtagttatatagctaaaccagcatgaagcatactacaggttgagcacccccaatctaaaaatccaaagtcctaaatgctccaaaatctgaaaggttttgagggctgaaatgatgccatactggaatcattttacacctgactttatgggtcacagtcaaaacttcatttcatgcacaaaattactaaaaatattatataaaattaacttcagtctatgtgtataaggtatatatgatacataagtgaatttcatgttttgacttgggtcccatccccaagatatctcattatatatatgcaaatattccaaaatccaaaaaaattcaaaatcccaaacacttctggtctcaggcattttagatgagcagtactcaacctgtagagcttttggttaaattctaagcattcaagcaattcatgcagtgcaagggagataaatgcttaagaacttcatttaatcaaagtgtctagagtccagtcagtaggagggaagaaaaatacatctaaactagtctgtcctagtaataccacagagaatgttaaactattgcctagcttagtaaagttcctggcacatactagtgttagataaagattttcaagtgaactaatgaatcagataatcttcagtcaatgaaagtatcaggtggtcttgagtttcaacaaatacataacttatctagcatcttctacctatacactcatcccaaaatcaagaaaagtcaagtctccccaacctctgcttgttaaacatggtttaaaggcctttccaaatctggtctctgtttatctctccagctccagctccagtcactgcttccctagaatgtgtactccaaccaacttcatttctttcaggccctcaaatgcactgtgctgtctcacttctgagctttttattgttccttctgtctggtaaatttcatgttcttttcagtaaggtctcagtctagatttcatttcctttggttaccttttccttccagtattatcctttcctcccctacccacccacccaagactgctaggtgcccctcatgtatatatcctcctctcatttcgttatacttggttgtttcatttgctatttcctttattagactggagagcagcaactgtggatctgtcatactcaatcattgtatctctgctgcctagaaccacactgggcccatagttggagctcagtaaacatgtgttgaataaatacgttaatgaatgatgaataaatgaatgacagaataatgttagccttttatgagaatgaaaataaaattgtctttacttctcattagagttacaaattctaaaataagtcatagttggaaggcatggcaaggaaactagcacagctattctaattcccataataacatttacttttattctgccgttcacaaattaccaagtagaatgtctaaatgacactcaaaagtactttccataaattagatttactctccctgagacatcagcttattttaaaaatttatttgaacacaaatataactaagcaactttaaaaaatagaatttcgtgccatctaggaaatagatctttatattccaaaattcctttttggttataaaagtctttaattaccataatagcctgcctcagagaccttctgataatatgtcaaattaaggtatctaaagctgactttgagatttcattaattttattaattctacaaattcacgttaggcaacccatataaaagaccccacaaaagaaagtgtcgtaaagatccacttttaaactggaactgtttttgggtgactaataagaactgtgattttaaaaagcgctccctctcttacaaaacatcaccacaaaaggaaaataaaactcagggatttcatcagagactctaaggtttaattcagtggcctgacattataaatcagctacttcttccaaatccagcccccccgccccaccccgcctcaaactccgaagggttggtggcattatttttcaaagggaaaaattccaaattatttatgaaaattggattttctagaaacaattttttcagtccaatcattagctatctttcccaagtttgcatgtgtggttggagctgtgagttctgtaatctgatgtaattatgaattacccttaattctctgcagcccatccccagtggcccctgtaacagaacaaattggatattatgagataaccaagggctgcaaggcctctggtggtcatgggagacaaacaccttcatccagaacctgctacttatccccatgtctctgcacaagggttctcttcccattccacgttttataatttttcttcagaagttcctccggtgcaatccattctatttggtttctctgcctccctccccccaaatcatctggacccaatttacaaaccccaaactgcccaagaatttatgcagggccttttctgggagcgtctggaagggaagtgtaaaccagacaagacaaaacccaggagcagatctgctttaactccggtggttggtcacaactaccaaggggagtgttagtcaccagcgtgggcctcgcgcggtggcagagggaaagccctcggggcaggagctgcaggagggccgcatgcggaggctggctgggcaagaagtggagggcctcactccgcctctcctggagtctccaggctggcagggctagagcctctctgcatccgcccctgatcagcgggaagatctgtcagttccgcaggatcggctgcaacccccgactctccaggctggtccacacagagggatgtttatcgagaacagtggcgggaaatcttctgcctgggaaccccatgcgacctgcgtgagccgctctgagaaggcaacccgcagagcttgacctctactcgctccagggactccccagcctccagcaccccgctgcccgcacggggttgaggagattgggaggtttcctcttcactgttgcatggggatgggggtgtgcggggaggtgcatgtggtcagctgggaagcccagcagcgaggcttccaggggtcggaagagagcgcgcgcgcgagccccagccaggctgggctgcacgcggctgggaagcacatgttcatacaaacacgaccacaaggcgctctttctccgcaccctgcctccgcctgccctcagctgacacggtcaattctgttccttgccctcctcccacctagcctcctgaggggcagcctctctgcagaagacttccacagccgcgttcacccttctcgcccaggggccagaagcaaacttgtgtaacccactgacctcttccagggggaccagggcatccagccaaagccgcgcaacccctggtccgagcccttttcccagggaaggcatgggagcaggtacagcgcccaaaggggaggtggggtgcccgtcaggacccgcccaaaacctccgcaggaggggcaggcccgcccccgtgtcctgctcccctccccagtccccgccgcgagtgccacttccccagtgacagggcaatgatcagggcgcagcctcggctcggatgggcaacgtttgttggccttctaaccagaggggattgcctctgagcccgtgggtaaaacaaccccccgacgcccgaggttctgcagccacccccttccccccgctggcgacccttcctcacgcctgagtccagtggtccaggctgcgcacactgaccctgggggacctctagcgtcacagcaatcgccaggctggacgccctgagaagcacctcggggaagcaggacctcgacagggccctgcgggaggagaaggggaggagggcgcgagggcggcgggagctggagccagagagatcgtcggagcccagctctggagcttagggagccgctgccctggacctcgggactcgcgccagcgagcttttcctctcgagccaaaagatcgctttagcataaactgtctgagatctgctggcacgaggcatcctttcaaacacggtattttgcaagctgagaagacaaggggaagataccgcgggtactcggccgctcctaaagccaaaaagtgccaaggagccggacttcagatctccatcaggctcagcagaaccagggggtggagagaggggttggtctaacccctaccctacccggcgggtgggctacttacgtttttgccgtgggggagacttttccacgccttgttctgtgggctcttaaatgcatttgtatgcatttgtccgtgcagcaaagcgctaacggaaaaca

SEQ ID NO: 631 - DNA, 50350 bp, Homo sapiens
ctcaagctttgtctgctttatttcactacattaagttaagcaataaggcaaaacagtaacctgtcattcataaagatcaaggagtacctctctgtcccaaaagggaccaaaaagggtgtttcttcacaaatatgcatgacacttagctcattatgctgataagcacttcaaacaaaagaaaaggtcagtaggtgaatcaagtaacaaatccaaattaacttagcctaagtttccaaagctgtagtttcaagtgctaatgggatctaactttcctgtggtggtgcatactgactagcattaaaatttttgcacctcatctaatataaaaaaggcaacaaatacaattcctaattcaccagctgcaggtattgaatcatttctacgaacacacagaatactagcttacactaaaacctatcttgaggaaacattaaaccagtggctctattattctgcaagttagtttggcttctgaagaaaaaagtttatgatcaaagtgttttgtgtttctgtgtatgggaatgatgagacccatacttcaacattattactttggggaataaataccagctacctgccataaacgcatgacatgtgtgtagtctatgcaaacgtgtaaacatatgaagctattctctactctatgcccatttcctccactggcaaatatggagcagtgatttcacagtaggctctagcaggtagtgaaataaaaatttgagactctgtggggtcacaaaaaaatgaaactctttctatagtctgcaaatctgtaattacccatccccctgctccaactcctaagaggctaaatgttattaccataatgttagagatgagtattttccttcttacactgcatcacatatattactctgtaggactgtttcataaaattggcttgacctttgtacaattagtacaatttagtgtcttttagagtacaatttagtgtcttttaaaagcttcctaaatatttaaaacattttcaagggaagcttacaaggactatgtcccatctgtattctacattataatgttatctttaattttttaagacttaaaacaagaccaaggtaaacaaaaaatctgtattttcctcaagtctcttggccacttactaacaatacttttacagaaaacacggtgcagctggtggtctactttatcaagtttcattttagaaaacatcatagaaattaaggttagcaacccaactccaggataccaagtgaaaacagcaagtctgctgttaggccagaactgtgggctacttgctgaactattttatggtttacaatcaaaatggtcttatttgactcaccacatgacaaaagtcttaaacttagtaagggggaaagttcttaatatccagttttggattcaagagattataatagttaatttccccttcaaatcaatggaaagaatgctagttgagaatattctaaaaatctagcctttaaaatgttttctgcattccagaaatgaacctgtccactcaggttttctttgggttcttttccaggtcccaaacagaacaacttaactgagttaaagaggcagaacagggaaggggtaggaagtaagacaaataaagattgcccccctgtggcagcattaatccctgggtattgtggcaatattgaaaacgaatggaatctgctacccccttgacatgacatgtaattgtttgcttctcaaattcttcttaaaagatccatattttactgggaaaaaaattaagaacaactaatacgtgtcctgtattcacttagaaaaagagggcaaatgagagtgccttaacaacttcacaggtttttccaatcatcatgatactaaagataaagtgacaattcagtttttcagttatatggaaatctatggcaaaatggcagccattatggcaatgaagggatatgttttagactgttagatgatatttaacggaatgcagaaagcagttggtacattgtgaccaatgctggatcattaacagcaggtctacctttgggttatcatttaagtttcatctgtgacattgtgatccttagtgagatcagatcaagagacagtacagagtttctcaggtggtaaatacaatgccattccaaggaacacccatcccctttcctaggatggaattatgctgctgttactcaacgtgcagggttcagtgagggagacacagacttactggtgtcaacaggggtgagagcaagagcaacagcagctaccctgtgttcccaatgccttgcctatgctcccactttcttagcaatagaattccgtagtgcatgggtacatcgttataaacaaggcctaatgaagcagcagcttccacattttaacgcaggtttacggtgatactgtcctttgggatctgccctccagtggaaccttttaaggaagaagtgggcccaagctaagttccacatgctgggtgagccagatgacttctgttccctggtcactttcttcaatggggcgaatgggggctgccaggtttttaaaatcatgcttcatcttgaagcacacggtcacttcaccctcctcacgctgtggtgtaactttgatgaaaatacccactttgttggcctttctgaaggctataatgctatggaaagaaaaaaaagcaagtattaggtagataaaaaaatcagccaaaccactaagacttacagtaaaagtctttcaccttattctttccttcagcacacacagaaaacctataaacactttgttcttaacctaccaagtatttttttgttttgttttgagacacagtctcgctctgtcgcccaggctggagtgcaatggctccaccttgggtcactgcaacctctgtttcacgggctcaagtaactctcccatctcagcctcccgagtagctgggactacaggcatgcaccaccacacctggctagctttatatattaatacgtatattttttggtggagatggggtttcgccacgttgcccaggctggtctcgaacaccagggctcaggtgatctgcttgccttggcctccaaaagtgctgggattacgggcataagccaacacgttggccatatatttttctatgagcttatacttttctgcttttctaaccaacacagatggtacacactattccataacttgcttttttttaactctgtttatcacaaacaccttttgacgctggtatatacagatcatctacaatctatgtaatggttgcacagtattcaattatgtgtttaccataattggcatatactgaggttgctgacaacttttctctattataaacaatggtgctgcaaacatccctttacatttacctctgtgcaaatgcaatatttctatagaacatagactcataccgtggaaagttatttatttatttatttttttgagatggagtctcgctctgtcacccaggctggagtgcagtggcgcaatcttggctcaccgcaacctccgcctcctgggttccagcgattctcctgcctcggcctcctgagtagctgggattacaggtgcacaccatcacgcccagctaatttttataattttagtagagatggggtttcaccacattggtcagactggtctcgaactcctgatctcaggtgatccacccgcctcagcctcccaaagtgctgggatcacaagcataagccaatgcacccggccttatttttattttttagagacaaggttttgctctgttacccaggctggagagcagtggcacgatcatagttcatggtagccttgacctcctaagctcaaatgatccttctgccttggcctcccaaagtgctgggattataggcatgagccaccatgcctggccatactgtgggaagttttaataactcagtgctttaagggaaattttggaacaccataaatcaagaatgtttttgtaaataacttatgtaattaggaattttagcacaaaaatgtctcttcattgaggtttgcatttcaatttcccctcatttgtgcatacagtttgtgctttaataacttagtttctgaaagtaaaagggcaatgaaataaacagaatttgtctactacccaaatgacattcagttactctaagaaaggttactgggattacatatttacatatttatacagtgttagtttccagaaatctgaaagttctattaaatctaataatgtaaaatataattaattcagtttttaattactctatcatgtaatcaggctgaaatctgatatctcagacaatcattccagaagtatatcttggcttaacaaatttctgtacctaattaatttgaggacccacataaagcaaggatttgagagaacacattttgtactgtacaactcagcacattttgtattacagtaactaaccagacctttgatttgtatgagtcatgtaaaaaataattcaaacagtttaaaatggtaaaaagaaaaacatcagtctttctttttatccttaatttcccaggcaaccactgatacctgggaagcttttccaaaacaaatttggatttctggtccctagctagacctgctaaaaaaaatcctctggggttagggtctggaatgctatcgaacaacaaaacaaaacaacacttgacctggtgctttctgaagttaacccacgtttggtatcactaaactaatctcacctttgccttcactttatttttcttttcttttcttttttttttttttttgagacggagtctggctctgttgcccaggctggagtgtagtggcgtgatctgagttcactgcaacccccgcccctagggttcaagtgattctcccatctcagcctcccaagaagctgggattacaggcacgtgccaccacgcctggctaatttttgtatttttagtagagacaggatttcgccatgttggccaggctggtctcaaactcctgacctcaagtgatctgcctgcctcagcctcccaaagtgctgggattacaggcatcagccaccacacctggcttcactttatttttctaacccaccttgttatctcttctctctaatatcttgttgagaaagcttttgatcattctgtcaaaaaaccgtaaatgggccaggcatggtggctcacgcctgtaatcccagcactttgggagaccaagtcgggtggatcactttaggtcaggagttcaagaccagcctgggcaacatggcaaaaccccatctctactaaaaatacaaaaattggccaggcgtggtggcgcttgcctgtaatacaagctcctcaggaggctgaggcaggagaactgcttgaactcgggaggtggaggttgcagtgagcaggagatcacgccattgcactccagcctgggcgacagagactccttctctaaaaacaaaacaaagactgtgaatgttccctgtgccagtttactaagctattatttttcagctccaagcgcacctctctcaattttgctttgtgacacaggattctgcttggactgtatctgctggatcggatggctctttgtcaggttctgtcagcagcgggctctaaagggagactagaagtctggaggaggaagggtcttgctcttcctttagagattcctgtttgcttgtggtccctgttccctgtggccatcactccaaaaatgtctttttttttttgagacagggtatcactctgttgcccaggctggagtacagtcacaatcacagctgactgcagcctcagcctaccgggctcaactgattctcccaccctggtatcctgagtagctgggactacaagcatgcgctgctacacctggctatttttaaaatttttttgtagagacggagtcttaactctattcctaggctggtttcaaactcctgtgaagcaatcctcctgcctcagcctcccaaagtgttgagaatacaggggtaagccaccatgcccggcccagcaatgcttctttacccaggaggaagtggcagtaagcagttgaagttttccaattcttgtataatcatgccacccctcctttgccatcacgagatgccaggaccacgcaagcagtgttccccttcagctcactggaggcctgagtttcagctacatggagctctttgtttaagttctaaattttaataattctaactatttccctttgttccctccacctaaggggtggtagctggctcatcaaatagctatctttgaaattttatgcccatgaagtagcataaaattgctacttcagtgttctttttcactttttaagttacacaagtgaacaattatttatattaaatcctctgttcgaatcattgaaaacattcagtctacagactgaattctctgatggtcacagtccccagttactggaaggtttggttcttttcagttattagatatgagagagtaaaatctattaattcctccaagggggtgggggtggggaacaaacccgatgatcaatctctagggacagagtattgtatcctgtccacaaccattaaaatcatataattaaaaatttctttattaacatgggaaaatatattcaagtgaaaaaggctaaaaaactgtatttatagaatgatcccaatgaggtgagaaatatttggaaggacaaatgccaaaatgctaatggtgtttatctctggtggtgggataattttattttcttcttcatggtcttacatatatttccccaattttctacaataattatttttagaaacaggaagaaaaaagttattttaaaaaatccagacaagaaaactggatataagtgggcattctattatcagccatttgttgtatggggatcacaaaaagatcactcactcaggatcgtcctgaaagtcttgaggttctgccaactcatcgtactctgctgctgcatccttgccagctaaaacgagctctttgggaggcaccaccacctggagagcaacacagagaggcctgcctgagaagggaccagtgtgacagaatatagcaaagtacgacattgatttagacaaatggaagcacacagcaagtttcaggaaacatatactacttctatggagtttataagaacaaaggttttaagagaaagctaagttagtacttacttcatggggtctgcaatgaggaactggggagaacatgggggcttcaattgtgtctttaatgttttattttattatttatttttttgagatggagtctcactctgtcgcccaggctagagtgcaaatggcatgatctcggctcactgcaacctctgcctcctgggttcaagcgattctcctgactcagcctcatgagtagctaggactacaggtgcccaccaccatgcctggctaattttttgcagttttagtagagacggggtttcaccatattggccaagctggtttcgaactcctgccctcatgatccacttgcctcggcctcccaaactgttgggattacaggcgtgagccaccgcgcctagccctaatgtttaatttcttaaggggatggggagaaatgggtacttgccatattattcctcatttttttttgatacatctgaaacagtccatcattaagaacaacacaaaggagaaacactggttccaacacaatgttttttgacatggtaccagctgattcctggtacctgatacataaacttacatgagatactgggtgattatggtcatggaaaacaattagcattcttcagacttatgttgtaattaggcctcaactttgctctatcagaggttaacagttaacagtgttgatcaaatttctaattatagatacaaatgtgggaggggaggtataaagagagctttataaagatatgctgtgcttatgcatcaggtacttatttctgtctgtcttaactggagctgcttattagtgttaataaaaaaaggaacgtcagggcacagtggctcagatctgtaatctcagcactttgggagcccgaggaaggtggatcacaaggtcaagcgattgagaccatcctggccaacagggtgaaaccccgtctctactaaaactgcaaaaaattagccgggcgtggtggcaggcgcctgtaatcccagctacttgggaggctgaggtaggggaatcgcttgaaactgggaggcggagagtgcagtgagccgagactgcgccactgcactccagcctggcgaccgagtgagattccgtctcaaaaaaaaaaaagcaacaaggaccaaataagtgaaataagtgttatctctctttggaggtgatgctagtaagtgaaatcattaaaaagcagaagaaaaaaaaaaagaggacagaaattctctaatattatttgaataagaactaaagatataggcatctttttaaaccatttctattataaatatcatgctgaattatgaattagtaatagatgatctatagagaaaggctcttgttctaaaatttcaagtactagaagtagcaaaatataaagagaggccatattacatccattcaactcacactgagtcaaaatcacctactttaacatttagttattttgttttttgagatggagtctcacctcagccgcccaggctggagtgcagtggcgcgatctcagctcactgcaatcactgtctcccgggttcaagtgattctcccatctcagcctccccagtagctgagattacaggcatctgccatcatgcccggctaatttttgtattttagtagagacgggtttcaccatgttggccaggctggtcttgaactcctgaccttagatgatccactcaccttggcctcccaaagtgctaggattacaggcgtgagccaccaagcccagactagttagtgctatgttatgtatactctttgtaaggtagaggaatctagaggaggcataccagcttctaaatgattttaaacgtatcatttctaaaaggaaatgatatttcacaagtgttgaagaatgaatgtatgagactgagagactgaaggggcatgtatgttaggggagtcaggataggaaggaggcatgctaagtaaaatgaatagcatacacaattctccagtgtcaaagtttataacccattggatctgtctggatcacaaccactaatatgtacgattcagggaatgctaaatttgaggatctgaaggaagaccacactggaagaacagagaagtaatgtcattaagcagctcttatgctatgccaaaaatctggacttcatctcagtcaagagcaatgctaaatgaccagcatgcacagagttagattttagaagtatcaccctggtggcaagagagaagaaatgggttgaaacagaggtggtggtataaaaatagcaaggtcatttaggaagttattgtcactgtccaggtaagaaacgatgagaccttcaaatagggcagtgtgtttcaggataaagtaaaaaaatttaggaggtggaatcaaaagaacttgctgactagatgtggaaaggagagtgtgtggagtcttttaagccaggtcaaatgaggacactccagggaaagtgcgggtcagtcaggctgaggcaaaatgctcctaccttagcagtgctgttgatatcatcagggtccccctcctcacactcgaagagagtcacatgggtgaggttctcaactggatttgtaagagtcaggaggacctggctctcctggtgaataggaaacacatctctcagacattcgccactttcttagctgctataccgaatatttcgcaaaattaccatccccgccattactcctgggcaatgacgccctacttatacctctacatcactgtattctctatgtgcttactgatccctgttctattatctatatgttagaccaaatactctctggagttgctatttcactgaggaaatgggacagattccactgaaagggccagttactagatccagaaattctgaggaatgttcattatctaagtgaagttaaaactcttgtctcacccaggctgccacttaaggactgaaaaggaggccctcataaataaaatatgggagccacaggccagtcagatgcatgaacagagcaaaaatggcacaccaagactacaaaaactttttaaaatttttattatttatttatttattttcgagacaaggtctcactctgttgcccaggctggagtgcagtggcatgatcatggctcactgcagcctcaacctcctgggctcaggtgatcctcccatctcagcctcctgagtagctgggaccacaggtgtgcgccaccacacctggcaaattttttgtattttttgtagagatggggtttccccatgttgcccaggctggtcttgacctcctgcacccaagcaatctacttatcttggcctcccaaagtgctgggattacaggtatgagccaccgtgcccgaccttataaaaactttttaagacttcttgaactgtgataatttgtccttgtttggtaccctctctagataagcaaaacaaatctttcaaatgaaggcccatgtaataaatatttgtgttttcaggagcagcatgaaagaagagttaaagagtttgctgcagaatattctacaattcactgggtgtgtgtgtggaaggaaggggagtagatgaggactccaaggaagagaagggctgtggtatataaatctaactgaatcctagtacctgaaacataacaaacaggagatcgaagagaatctctaggctggagaagaacaaaagatgcctgtgggatccaacattctctcctttcttttccccacctataatttcaccttaacataatgtgcaccctgctccttctccctacttttcatcagatgctgttgtcaagaatctcagtgtcaacaaatttagtctttattatcccaaactgtcttcttttctatcccttgctcactggatcctgtgccaaatacacacacagccacccacatacacatgtacacacatcattgatcaatcctttttcttcctgttaatgagcaaggtactaaccttcatgtagcgaaggttgggaattgacatgattctcacttctggaatataattgctgtgcataaataaaaaaatgcattaatgttcattggagtctcttaaaattattattattttttaaagctagtgcagtacataaaggatttcatgttaattagaatgtatcagaaaaaaaataattttaatgaaccatatcatcacagtaagaacttaagaaaagacataagaccaaactggtatgagttctttctgaaatcttacgtatatttctagttgaaactgcccaggccccagattagcatttacatatcaagatattgctttgtaatgactaaggcaagatatttatctccttgtgccttggttttcccaattctaaaatgaggaaaataatggtatctttcacttgaggttattgtgaagaatacatgcaagaatgctttgaaaagtgcttggaacaaagctcacataaatgttcattattgtgcatacattaacgtaatacgaaatctattgcagaaacattaaaagtgggggaaaaagtacatcttagaatcagatatttaaactttaaacgagctatttttcatggtgaccagcaggattacctgagtaacttaacaggaatttaagaaacttttgtcttcctgaatctcaaaaaaaacacacacacacacaaaagcaacaacaataaaaataaatttaaagaccccacttctaagaatttgaattcagtaggtctgaggtttgataccagagctctgtatttttttttttttttttgagacagggtcttgctgtcacccaggctggagtgtaacggcacaatcatgactcactgaagcctcgaccccccaggctcaagtgacattcccacctcagcctcccaagtagctgggagtacaggtgtgtgccaccatgctcagctaatttttgattttttgtacagatgaggactcactgtgttgcccaggctgggcttgaactcctaaggctcaagcgatcctcctgccttggcctccccaaatgttgagattacaggcatgagccaaacacctggcctcagagcatctgtattaagatagccaggcaattctaaaatgatgtcagaaaaaaatcactttttctcaaagcaagcttaagaaattgatgctaagtacaggctgccattcagggtttctgtaatgagtataattcttaagaaaggagttcatcccagacttcacaagtgccatttctgtaggtctctaaccaatcatgtattaagagtagttaggaaaatgaacatattttatggtgagttacaaggcatttgcaaacataattactcatttgattcttttcaagaatcccaagaggaatacattattcccatttcagagacgagggaagtatgtttagacaaaaatagtaagtgacagaccctcttcctggccctcctagctcctcctaactcactagacatgcacttcccaacctttttgtttcctaatacttatttttaattgctgcataatattctacagtacaagttatctcaatttaaccaactatttccttgttaatggttaatcagtttgacactgattaacttttggttaaactgtttgcagctttttgccattaatatattctaaaacacacctttggaaatgcatctttatatattggtgattttgtttctacagaatatatccctgaaacagtactgttgggttaaaaggtctatgtaatttgttttgatatttccagaccactctccaaaaagactagcaattcaagatcccaccaacaatgtgtgcaagtatgtgtttacccacattctcatgagcactagatgctaattaccttttaaaacttttcctatcaaatcttagtttctttccatatacagtgtatcttctggtcatttgaaattcctttcccataagctacctgttcaaatcccttgttccacattccactttactgcctccctctatttttatcttttcaatttctgggaattctctatgcctgggatattaaacttttgtttgtcatgactgccaaatattctttcttgctttactatttgtctcaggactttgttgctaattttgtcttaaaaaaatttttttttccttagagagagagtcctgctccactgtctaggatggagtgctgtgggacaatcatagcttactgcagccttgacttcctgggctcaaggggtcctctcacctcagactcccaagtagctaggactacaggtgcatgccactacacctggctaattttaaaaattttttgtagagatggggtcttactatgttgtccaggctggtcttcaactcatgggctcaagtgatcctcctgactcaggcttccgaagtgctgggatcacaagtgtgagccactgcacctggctttaatttcatcttttataaccactatttctttttgctaaggtcaaaggtgtttcttttcttttaatggcttctgggtttcctgtcttgctaaagaagggctctcttactccaaagctagacaatactttcctaatttgtgaaaatatttttgtttgccaggtaatttaaaaaatttatgtattagaaaagtatgatgagatatgaaaagtttacatttaattagatgaacactgggtaagttttaagtggcagtatttgtctctaattaggaccattcagatagcctgataggtagtttttatacacaaaattctcttctactcacaagtcccagagagttaacactaacttaatcactttcattccagtcaacgaagtgttataacacaggtaagtaaaatgaacactgttacagggatactcttcaatcagctatacttcattatttttaaattttttttgaaggattattcccaaactcagatactttataatttgtaatgatgactagtgactttccaccaaataatcaacataccttgttgctccagatcatactgggacactgtgtccctgatcccaatacccctgaatctatttatcttaaacttcatggcatgtaactaaattaaaaacctaaacaggaacagaatgtcaagattattttgatgtaatttttttttttttaggccaagagtaaacacacttcatactggggaagaagaataaaccaaaataactcaaaacagtaactgaaaacaccaatcccaaaatacttacacagcgaccagctggattttgaatttgattgacgttgggttaaattctggcttgctcaaattatgttcacatttctaaaaagaaaacaaatataacacgtatcagaagacaacaacacactttgttgatccatagagctgctaaattcagaaggacagcatttacgagaattttgttttgttttgttctgctataagaccatatgtttttgaataatgtatagcagccaaagtttataaaagatgttcgcacttcctgatatgtgcaaccccactatccaatattattatacctctgtggtacttaaaaactactaaaataacacatactgagtacatactgtatttgctaaacaacgtgctcactggtttaactggatttaaatatcacatcaactttatgagctaggtataggtattacattaaggttgccatattatagatgatcaaaatggtatacaggaagggtaagtaacctgtccaacttcacagagccaataaaaatggacactgggatttaaatctaggtagtaaaattccagatcctatgctttaaagtacagtaacaatgattacttttgagatagggtatcactctgttacccaggctggagtgcagtggcacaatcaaagctcactacagcctccaactcctgggctcaagtaatcttcctgccttggcctcccaaagtgctgggattacaggcatgagccactgcactaggacagtaataattatttactactttcttaaatacatactacatatacctggttaaaaatttttttaacagaacaaaaaaggtgtccagtgtaaagattacccattatctgtctgtccccttgttttctccagatagcctatgcacataaaagtacaagcatacatcaccttgcttttttcacaataacacaaaagggaacattttatatttattctcttgcttttttcatttattctatcttggaattaattccatttcagtacatatagagaggcctctgtgtcccactgtaacaatttctataacttacataagatagaaattgatggacattcaggatgtttccattattttgctactgtaagtaatgcagcgatgagtgttcttgtacatgaatcatttcctaagtgtctaagtatctgtaagacaatttcctaagagtagatcaaagggtgtatgcatttgctattttaatggatactgaaatataactgactaatctgacgattatgaaatgatattccactgcagttaattttttttaatttttcattttctcattgcagttttaatgtacatttccctgattagtgtataaatttgaatatctttcatatttattggctattgggatttcctctgccataacttgaatgttaggatctactggttatttttatttccttgccgatttgctgatattaacaatagattttaatctcttgttaataatataccttgcaaactacttttctcagtctgtggcttatcttttcatttctttatgggttttctttggcatgagggtacaagttttacttttaatgaagtaaaatatgtaactttacattacagtttgtgcttatttgtattacttatgaaacatttccctacccagaagtcatgaaggtattctcctctatttccttctagaagtttggctcttcagatttccaatgttcctgaaattaacttctatgtagggtgaggtagcaacccaattttattttcttccatataatcacttgacctagcaaaatataattgcctattctttccccaatgatctacaatgccatatttagtatataacaaattttctcatatgcatgggtctacgtctgcatacatatagacacacttttttttgtttatatgtacatttgtactttccctccttttttatacagaaaaagtgcatacctaccatgcactttgctttttgcatttaaaaatgtatcccaggctgggcgcagtggctcacgcctgtaatcccagcactttgggaggctgaggcgggcggaccacgaggtcaggagattgagaccatcctggctaacacggtgaaaccccatctctactaaaagtacaaaaaaattagccaggcgtagtggcgggcgcctgtagtcccagctacacgggaggctgaggcaggagaatggcgtgaacctgggaggtggagcttgcagtgagccgagatcacgccgctgcactccagcatgagcaacagagtgagactccgtctcaaaaaaaaaaaaaaaaaaaaaaagtatcccatattaacacattcttttataaatttatagtactcattctgcggatatactataatctctgcatattttggtttgtatttgtggaggtgcaaggtagattcctaaaagtgaagttgatgagacaaaaggtaactttacttttggtaggtattactatattaatggtgcattatataaccatatttatataaatttatatcaatttaatttatatataactatttccattactaatcttttttaagaaatcaacttctgattctgttgcccttttgtattttggtttcttaatttactgtattttatattaatttattgtattttattttggtttcttaatttattaacacctgttctctttggactttgctgttttttttctaacttcttgaaatggatgctgacatcgctaatcttttaatatttcttcttttctaatatatactgtatagctaagcacagccttagttgtatcctgcaagttttgctataaagaaattactgattcctaacttaactacgttgtgatcaaataatatactttaataatttcatcttccagctgacagcctcagcaagagaaagcatagggactccaatggcagcagcagcatgtgcaaagaaacaatcatgaaagttggtagacaatattggatgggtgccccaggtctctccaagctggctatttattatattttgttatttaaaacaaacctgtatttatttattttttgagacaagttttgctcttgttgcccaggccggagtacaatggcgcaatcttggctcactgcaacctccgcctcctgggtacaaccaattctcctgcctcagcctcccaacaaacctatattttaagcagaattaaaaaaaaaataagctggtataaggctatatgacttttgatcaaaccaacgagatgcagggcttctaaatataagggatcatctgaaatgaatgttgtttgaaataactgtctaattttgagagttccagtatttatgtgaaaatttaacaatttttaaagaagtccttggaaattggtattgacagtaaatctccttaaaatagaattttaaagctttcaacacactggaactctccccagctttggaccaaccccacaactgagcggagccacctcctcgagacatgcattgctctgctgctggatactctaacagcttgaacaggggagctcacttaagaagagatattgtgtagtttaaaacatattagtttgtataaaataacttctcataaatttctcataaattaaagctgcagtacaattcacttagtggttaggccaatcctccccgccattatccttgctttgttataaatcaccattaaaaaccattataatgtttttaatagtatcagctggcacttaaatatttttggagtgaaaattattcctaaagttatacatgactcccacaaaaatacagttttatcatattaaagagacctgtactgatttgccaaaattccgcaacttagcaaaggtattaccttccttggatttgtactttgtgatacagtgtgctgtaccgtgggctggttatgttaactgaaaaaatagtcattacccaagttttgcagcactctaaacttaagcagaagaacagctgttcacatcttacaaatgccatgtgtcaaaatcatggttttgtaattgctaaggtacggtatgtcaggttatttgaaaacaattactttttgaagtaattgtgaccacaaagcatcatttttacatgaaaagttgtctgtcatttgaaattatgcaaatgatgtcttgacctgaagcacaaaccccaggtacttaatgtttttaataatatggtgccactgcaggggttaggggcggtggggaagaacaaggataatggcggggaggattggcctaactaaccactaagtgaattgtactgcagctttgatttatgagacatccttatctgggatatttgagggcagctgcaaactaaaaacaatccagtaaatgtactttgtttatattttgtatcaggcaattatcaactgctaaataatagctttcatatttgcaactgttgcatacagagtacttttgctaaaaggtgattagctcttgcctttaattttacagtgcttaatgtgataaacttccagacatgtttcctataaaagagaccatttaatatatgtatataaaccacagtaatagtataacatactattttaaaattatttttttctacttaaaatatttaattttaggcttcttaggacatttctaaagcagattaaacccaataagcaggccgggcgcggtggctcacgcctgtaatcccagcattttgggaggccgaggcgggcggatcacgaggtcagaagatcgagaccatcccggctaaaacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaacaaaaaacccaataagcttcctgatgatttttttgtaattggagatagttttctcaactgaaataacatttcagctaaataaagcattttaaaatattgatatttgataaaaaattgccttgtataatttctgtaaattatatttgttctgaaaaaggtataatgccctaatgttaaaagattttaaacaaatccttatcctttgatttttaaaactctgatctaatgataaaattctataaattttcattttcccgtgcagttaggtagcaaaatagctggtaattcataacttttacctattaaaatataaacacacaacaagcaaatgtatttaagagtactaaatggaaataaagtgttcaaaagagaaagtcttgtgttattgagcatcttagcctatttattattataaagtataaatgtgacttaaatcttttcttgttaataaaaactttcttttaactgaaaaagaatttcatcttctgaaaaatgttcagacttactttataataatccagtatataatcaacctttataagtgttctgtgtgtacttgaaaagaatgcatatattctgcagacattgggtacagtagtctatatatgcccatttggtcaagtttgctagataaattgtccaaatgttctatattcttactgattttcatctatttgttctctcggttactgagagaagtatgtcaaaatttcccaaaatgatttgtccatttatgtaattttctcaaatgtcgctttatatattttgagtctattattcagtgcacatgactttagacggttatatcttctttgtaaattgaatcttttttttaaacaaattatccctcttttaaaaaaattagtgtttgtccaatatttttcccacttctctctactttcaacttttctgagttctcatgtttgtgcttcttgtaataagcatatagatggatcactgcaatttgctttattatttagactgacaatgtttgtcttttaatggaagcatttagttcattggtatttaatgtaaatactgatacatctggattttaatctactatcttaccacacacaatcttttttttttttttaacagacagggtcttgcttcgtcacccaggctggagtgcagtggtgtgattactgctcacagcagcctcaacttcctgggctcaagcaattctcctgcctcagcctcctgacttgctgggactacaagtgtgtgaaccaccacactggcttttttttttttttttttttttttttttttttggtagagacagggtctcactatgttgcctaggctgatctcaaactcctgggctcaagtgatcttcctgccttggcctctcaaagtgttgtgattacaggcatgagcccaggctttctatttgaactaccaattcaatgttcctttgccccttctttttctttctttttataaaggtttttcattatagaaattttctaacgtgtacaaaaatatagaatggtattacaaatctctaggtacccatcacccaacttcaacgattatcaacttcggaatatatatgcaggacttgaatctatgctctcaggttaaacaaacaaaaagaatcagcatcttgttatcaaaaattagcaacaatggccaatcttgtttcatttatactcttacccattcctcatccctcattattttgcaacaaatatcagagaccaagtcatttcctccataaatatttctgtatgtatctccaaaagataaagacattaaaaaacaaacaaacaaagtactatcattattcctaaaaaagaaaaaatactttttttttttttttaagagacagggtctttctgtgttgcctaggctggagtgcagtggctattcacaggcaccatcatcacacactacagtctcaaactcctcaggctcaagggattctcctgcctcagcttccagagtagctgggactacaagtgcatgtcactgtgccctgcccaatagttttttaatagcatcgaaaatgctaccagtgtttaaattttctcaaagatttcacaaatttttctttccttctttcctctttcccttcttccctcctcccctgggccctttctttctgttttgtttgaatccgaatctacgtaaactctatacattgtgtttggtaaacttttaagtctcttctaatctagagaatgattaagtaacattagccactagcgacatgtggttatttaaatgaaattaaagactgactcagtacctcagctgcactatcacatttcatgtgctcaagagccacatgtgcctagtggctatcatgcgggactgtacagacacagaatacttccatcaccatagaaagttctgttggatagtactcctctaaaaggtttcttttccattttgtttttacaatttatttattgaagaaactctgtcatttgttctgtagattaccagagcctggattttgctgatttttcttgctttcttttaaattgattattttttattggtcctccctgagcctgaacactagcctaaaagttcacactctttcactattcttttaggggttaaccctatgtacttaaccttcagatacttcattttctacatttgtaaaacaggtttaacagtagtacctacctcacagagttgtaagagctgtttatattgaaagcatttaaaatagtgcctggcaattagtatgttctctacaagtattttctgtatttaatacattccaaaggttttgacattagtcagacaccagccacatttatttttgctttcctcttgtacaaatggtcagtctacagaatggaatacttacacggcagcgcagggaccgtttgatcagaagatgtttgtggcgaggatagagctgtgaagcacagactggctggaagtcaggctgtaacagacgctgctgaagggttgttactagaaagaaaggcagaaaacaggcttagtttacagtgactttcaaaatcagacttttatgtaccagtaattacacgaagcattactgcctttacgaacagtgttgttcataaaaatgaaaatatagaaagttgacattttagatttcaaacaattacctctattacagctgttttattttctacatattgtttttactactaacagctattccattaaaaatctcaaatcactaggtacataaataacaaaaacagaattagatgtagactagaaacaaagtagaaaaacacagaaaattaccctctgttaaatttactggtcttgtataatagtcttcaggtagaggttccacttcatccacagcctgagctggctcaatctttatctctttctgatcctctccttctttaaggctgaaaaattaaaaaaacaaaacaaaacaaaacaaaagagtaatttctcacggatccacctgattatcctcagtctatgatatcaataattgaagtattcctctgtcatagaatatctgtatagcgtaggtcttttctaagtatgagaatcttcttttccattgacaactgtgtgtgtgtgtgtgttttaatctcatttatttgatattcattttgatacctgctgttctcctcaaagtcatttcatgtctaaacttacgaaagtccggcaagggtactgatggatgcaccagctcgtggtcgctgaagcctggttccaagaccatatttgtcctaaacaaagttcagaaattcctattagaaagtccacttttacacaccctatttatcaaaagaaagaattttgggtaggatagcatgagaagctcagggaaataagcaaaaaaaaagctaatctaaaggcttcttttaaagaaagcaatttgtagccccacatcattattctattcttaaaataataacagcactaaacatggagattgaaactatattaatacagtaaaaatgaaccaaatgtgagcttctgctagtaatctaaaagtatctaagctacggctcaggcaagaactatgtggagtgtctaagatacacaacagacgtcttcctggaacaccagtggtcatctgctaacttcttcagggtcagcaagaatcataaaggagaacttaccactacatgaatagtatgttgctgtagagccccaaaatagcagcaggttgcaacagagacaaaaaatgcagcataagatagaagcaaacgcatatagcaggcaggttatatgggaaaattggaagaataattcatttaattcaaattctacctctaaatataacacacattggtgcatatgctgactataccactggactattcagaaaaattcacttctttttgcaaatgtaggtgctttgcaagtgttaatgtttttaaattctaatctagattttttttgagacagagtctcactccgtcacccaggctggagtgcagtggcgctatcttggctcactgcaacctccgcctcctgggttcaagcgattctcatgcctcagcctcccaagtagctgagattataggcgtgcgccaccatgcccagctaattttttgtatttttagtagagacagggtttcgccatgttggccagactggtcttgaaatcctgacctcaagtgatccccccgcctcagcctcccaaagtgctgggattacaggcgtgagccactgcacccagcttaatctaggtatttttatatggactttaccaacccttagggtttcaatgacttaactaattttcatgtggatgcagtatgacaagttgcttaactaggtcccatttcctcaagcgtaaaatggggatatgatactccacaggatttttgtgaggattaagtaaagtaatacatgtaaagtgtttatttagcacagagcttgacacatcattgccattcaataaatgttatttattgaatgtcaatttgctgggccccaagcaagcacacagaaaacaaactgtactatgagagcaaataaaactcggggtaaaataacaaaaattccaaatcctaatttctttcttcttactagcagtacgtaaactggtagagaatgactctcataaataattcttatcaaaaattctacttgcatatattactatttaaccacacaagtgcactatgtaaaaagtcagtgtttttcatcttggagaaacaggggaggatgttaaaaaaattataactaaagctgagaaaccactactgccaggatgtcaaaggtgggctacaggggtaatatgactgaaatctaccatttgcccacctccttcttctcagactttctgtaatacacaaaagctgtacgtggaactctgcagtgcctacaaaattaacagcctttctggggaaataatcagaagataaaggggagtgatggagaaagaaacacaaatgtcctcaaaacacaaataactcaaacagaactaatgatatagcaaaagcctaactattggacttaaacgtctataatttgaagaatccctctctctgatatccaccattcaggaatctaggacaatggccattttctgaaatgatcactgttcttaggccttagaggtcttgcaaatcattttagtaccaaattctcaccgaaaaagccagaggcatatagtttctacgtcgtgccagtttcttgcgatctcgctcaaccttctctttctgagcaagctgctggtaatattcaatcaatttgttcatctgtaagaaaatcacagactcagtacacaaaaaagctaacagaaaacatatcaaattaatcaactacactgactagacacataatgaatagagaagacaaattattaagatgggcaagtttgccctttttcttctaagataatttttcttcgttatgtgatctgttttccgaagtgaaatggaaaactgaagttcaaggatgggaagaaatgggcaatgaagaggcttggaaattttttgctctctaacttcattacttatttcccctcacaactgctcttattttttttctgcatggccacaggaccacttatttctaagaacatagcattttatactgtattttattccccaactccatcacactttttaatttttaaaatacattttaattataaaagcaatacatattaatcataaaaagttcaaaccaggatgggcacagtggctcacgcctacaattccagcactttgggaggctgaagtgggtagatcacttggggccaggagttcaaaaccagcctggacaacagagtgagaccttgtctctataaaaaaatgcaaaaattagctgggcatggtggtgtatgcctatagtcccagctactcaagaggatgaggtggcaaaaaaaaaatggcagataggaggcaggactaacttgcagcttcccctcagacagacagaacaacatgtggagactcacactgtgaatttttattccaagaactactgcaggaacatactaggaaaactgaaagaattcacagaccctttaaaagaagtggcttgctgctgcaaaatccatgagacagcagaaaatctgtgagtgcccatgtgtaagagggggaaaatccaccttcaaacacacatcctcactggagaacctaaaaatccagatcatgggagaaaaatttaaccttacctagtgctgaaacaaaatttagagagccgagtgaaatataaaaatagaagaagcaacagcgggaagagccctgtaggcactcccggttcccagtgaagcccagggaagtcatttctgactttaatctcacaggggtccttggggagtgctgccagtggaactgaggaaggaccacttggagacagaaacttccaggtgaactttgtaataactttgacggagagcaaattttcctgggcacaatcaagatggggaaggcgtaaaggggaagtacagatatgagcacataagccacagcagtcgggaaggggcggagtccaaaaggctagcttgctttttcagcaagtaggcttgtagcctgggccaaaatcttggccctgcaaaccccatgctgttggtggggcatggtgggagtgagactggccttgctggctgcatgggagctgggtgaagcctgtcactgctggctttcccctacttccctggccaccagtatgacacagcagaggcagccataatccccctgggaacataactccattggcctgagaaccacacaactgtccttcacagcagctgcagcaaaccctgcccaaggagattctgagctcagatatgcccccacctgatggtctttctctacctgccctggtagcccaagacaaaagactgtaaactcttgggagctttatggccccactgatcacctgggaaacccaaatacttatccaggcaaccttagggcaagcttgtatccccaccacactactgcagctgatgctttcttgaaagcgccacctcctggctggaggccaaccaactcattatagcaactcataaaagaacaaccctgccctcaaaaggagaaaacaacagctaattccaccacctgtgacatcctggctaaccagaggtcctgagtctgtccacgtgacaattcactgctagcacaaccagcattaaagaaaactagcatacgaaaccaaactacaaccaaggaccctcacagagtccacttcactctcctgctatctccaccagagcaggtgctggtatccacaactgagagacctgaagacggactgcatcactggactctttgcagacactccccagtaccagctcggagactgatagctctggccgggtggctagacccagagcagcaataacaataattgcagtccagctctcaggaagccacagggggagagcaccacatcaaggaacaatgtcgtaggacaaaataatctgaacagtagccctcaagccccagatctttcctctgacatagtctacccaaatgagaaggaaccagaaaaacaattctggtaatatgacaaagcaaggttctttaacaccccaaaaagattacactagttcaccagcaatggatccaaaccaagaagaaaactctgaattgtcagaaaaaaaatttagaaggccaactattaagctactcaaaaagctactcaaaggggcaccagagaaaggtgaaaaccaacttaagggaattaaaaaaaaaaaaaaaaatacaggttatggacaaaaaaaatctccagagaaagacagcataaataataaacaatcacaatttttgaaatgacagacacacttagacaaggcttttgaattaacccaatctgacaaatacaaagaaaaaagaataataacaataataataaaaaataaagcctctaagaagtctgggattatattaagctaccaaaactaagaattggtgttcccaaggaagaagagaaatctaaaggtttggaaaacttacttgaggaaagaatagaagaaaacttccctggccttgctagagatctagacatccaaatacaagaagctcaaagaacacctgagaaattcatcgcaaaaagatcaccacctaggcacacagtcatcaggttatctaaagtcaagacaaaggaaagaatcttaagagttatgaggcaaaaacatcagataacctataaaggaaaacctatcaggttaacagcagatttcttggcgaaaccctacaagctagaagggactggggtcctatctttagcctccttaaacaaaacaattatcaaccaagaattctgtatccagcgaaactaagctttgtaaatgaatgaaggataaagtctttttcagacacacaaatgctgagagaatttgtcagtaccaagccagcactacaagaggtgctcaaaggagttctaaatcctgaaacaaaaccttgaaacacaccaaaatataacctccttaaagcataagtctcacagggcctataaaacaataacacaatgaaaaaaaaaatctaagtattcaggcaacaactagcacaatgaatagaatagtacctcacatctcaatactaatgttaaatgtaaatggcctaaatgctccacttaaaaaatacagaattacagaatggataacaatttaccaaccaagtatctgccgtcttcaagagactcacctaacacctaaggactcacataaacttatggtaaaggggtaaaaaaagatattccatgcaaatggacaccaaaagtgagcaggagtagctattcttatatcagacaaaacagactttaaagcaacaacagttaaaaaagacaaagtgggacattatataatgataaaaggactagtccaacaggaaatatcacaatcctaaatatatatgcacctaacactggagctccaaaatttataaaacaattactactacgcctaagaaatgagatacaaagcaacacaaaaatagtgggggacttcaacgctccaccaacagcactagacaggtcatcaagatagatggtcaacaaagaaacaatggacttacactataccctagaacaaatggacttaacagatatttacagatcattctacccaacaactgcagaagatacattctattcattagcacatagaatattctctaagatagaacatacgagaggccacaaaacacgtctcaatacatttaagaaaactgaaattatatgaagtactcgctcagacagcagtggaataaaatggaaaatcacctccaaaaggaactcttgaaacgatgcaaattgcatggaaattaaataatctccttctgaatgatcactgggtcaacaatgaaatcaggatggaaatttaaaaactctctgatctgcatgataatagtgagacacaacctatcaaaagctctgggatacagcaaaagcagtgctaagaagaaagttcatagcattaaatacctacatcaaaaagtctaaaagagtacaggagacaatctagggtcataccttaaagaaccagagaaacaagaacaaaccaaacccaaacctagcagaagaaaagaaataacaaagatgagagcagaactaaatgaaactgaaacaaaagagacaataaaaaagataaatgaaacgaaaagctggctctttgaaaagataaaccaaattgatagaatgtgagattaaccaagaaaagatgagagaagatccaaataagctcaattagaaatgaaatgggagatattacaactgataccacagaaacagaaaagatcattcagggctaccatgaacacctttatgcacacaaactggaaaacctagaggagatggataaattcctggaaatatacaaccctcctagattaaaccaggaagaaataggaactctgaacagaccagtaacaagcagtgagattgaaatggtaattaaaaaaaactgtccacaaaaaaaaagcctaggaccagatggattcacagctgatttctatcagacattcaaagaataatttttatgaatcctactgaaactattccaaaagataaagagggaatcctccctaaatcattctatgaatccagcatcgcccttataccgaaaccaggaagggacacaacaaaacaagaaaactacagacagatatccctgatgaacatggatgcaaaaatccttaacgaaatactagttaactggatccaacagcatatcataaagataatacaccatgatcaagtgggtttaataccagggatgcagggatggtttgaaatacccaagtcaataaatgtaatacaccacataaacagaattaaaaacaaaaatcacaggatcatctcaatagacagagaaatagcatttgacaaaatccagcatcctttatgagcaaaaccctcagcaaaatcagcatagaaggaacatgccttaagtaaaagccatctacgacaaacacagagccaacattatactgaacagggaaaagttgaaaacattccagctgagaactggaacaagacaaggatgcccacttttaccacttctattcaacacagtactggaagtcttagccagagcaatcagacaaggaaagaaataaagggcatccaaatcagtaaagaggaagtcaaactgttgctgtttgccaatgatatgatcgtatgcctagaaaaccctagagacttatccaaaaagctcctagatctgatcaatgaattcaataaaaggttgggcacagtggctcatgcctgtaacccgaacactttgggaggccgaggtggacagatcacttgaggtcaggagctcgagaccagcctggccaacatggtaaaaccccatctgcactaaaaatatgcgtggtagcgggcgcctgtaatcccagctactcaggaggctgaggtaagagaatcgctggaacttgagaggcagaagttgcagtgagctgagtttgcaccattgcactccagtctggctgacagagagagatttcatctcaaaaaaaaaaaaaaaagttttgaattcagtaaagtttcaggatatgaaatcaatgtacagaaatcagtagcactgctatacaccaacagtgaccaagctgagaataaaatcaagaactcaaccctgtttacaacagccgcaaaaaccccacccaaaaaacaaaaacaaaatgcttaggaatatacctagccaaggaggtgaaagacctctacaagaaaaactacaaaacactgttgaaagaaatcacagataacacaaacaaatggaaacatatcccatgctcatggctgggtagaataaatactgtgaaaatgaccatactgccaaagcaatctgcaaattcaatgcaattcccaccaaaataccatcatcattcttcacagaactagtaaaaacaatcctaaaattcacatggaaccaaaaaagagcctacatagccaaagcaagactaagcaaaaagaacaactctggaggcatcacattacttgacttcaaactatatataagactatagtcaccaacgcagcataatactggtataaaaataggcacacagatcaatgaaacagaatagagaacccagaaataaaccaaatacttatagccaactgatctttgacaaagcaaacaaaaacataaactggggaaaggacatcctattcaataaatggtgctgggataattggcaacctaaatgtagaagaatgaaactggatcctcatctctcaccttatacaaaaatcaactcaagatgtatcaaagacttaaatctaagacctgaaaccataaaaattctagaagataacatgagaaaaatccttctagacattggcttaggcaaagacttcattaccaagaacccaaaagcaaatgcaacaaaaacaaaaataaatggaacttaaactaaaaagcttctgcacagcaaatgaaataatcagcagactaaaaagacagcccatagagtgggagaaaatctttgcaaactatgcatccaacaaaggactaatatctcaagtctacaagacactcaaacaaatcagcaagaaaaaaaacaaataatcccattaaaaagtaggcagaggacatgaatagacatttctcaaagatacacaaatggccaacaaacatatttaaaaaaatggtcaacatcactaatgatcaaggaaatgaagatctaaaccactcctgcaagaatggccttaattaaaaaaaaaaaagtaatagatgctggcatggatctggtgaaaaggggacacttttacactgttggtgagaatgtaaactagtacaccactatggaaaacagtatggagattccttaaagaactaaaagtagatctaccgtttgatccaataatcctactactgggtatctactcaagaggaaaagaagtcattacatgaaaaagacacttgcctgcacgtttatagcagcacaattcacagccgcaaaaataggaaaccggtccaaatgcccatcaatcaatgagtggataaagaatatgtggtatgtatacaccatggaatactactcagccataaaaactagtgaaataatagcatttgcagcaacctggatagtgttggagaccattattctaagtgaagtaactcaggaatggaaaaccaaacatcatacattctcactcataagagggagctaagctatgaggatgcaaaggcataagaatgatacaatggactttgcggactcagggggaaagctgggaagggggtgaggataaaatactacacattaggtacagtgtacactgctcaggtgataggtacaccaaaatctcagaaatcaccactgaataatttatccatgtaagcaaacaccaggtgttccccaaaaacctatttttttttcttttaaatggctgaggtgggaggattgcttaagcctgggaggttgaggctgcagtgagctgtgatcatgcaactgcatgccagcctgggtgacagagtgagatcctgtctcaaaaaaaaaaaaaaaaaaaaagttcaaacactatacacatgaaaagaataaaaagcaaaacttctcttttatcccttctgcccaagttgacttttctactcattagaggtatcaactattactggtttagatatctttcttactcagagaaacaaatatattatattttgcatatattttaaaatacttgtgtgtagatgtatagctttgatgtgtataaaaatacatacttattcctggcctcaagcaatcctcctgccttagcttcctgagtaatggggattacaggcatgagccactgcgtttgtctctaccgcattctttttctttttttgagacacagccttgctctattgcctaggatggagcgtggtggtatgatcatagctcaatgcagactcgaaaacctaggctaaagcaatcctcccacctcagcctcctgagttgctgggactataggcatgcgccaccacactcagctgaatttttaatttttttgtagagatggggtttcactgtattgcccaggctggtcttgaacttctgggctcaagcaatcctcctgcctcagcctcccaaagtattgggattacaggcatgagccaccacacctggctgtttatgatatttctaagagtatctgagaacaaatggaaccttaactcactggtgggttgtgtgaagaaaaaacaaaaacttggttccttttcctgatgcacaattcaaatacagaactaaagctacacctaggattctccattatcttaagtcatttggaaaaaagtgacagtgtatttcaatgtcttacaatgagaagcactgtctatgtgcaaagacgtattatggacttataaacacagctcatatctacccataaaatgcaagatcttcagtcttttactcaattttttccgatttcatcctctctctcttatgaccctttacttacccgttgtgtgtgaggattttcaggttcctgccaaccgccactagctacaaaataaaagaatattaaacaagactttcataatgtgataattttattttcataaaacaagtcttctgtaggccataaaaagaaacttaaaacataagttatatagaccattctggtctatataactatagactataatgttcagaacaaaattttaagaaaacatctaatgatggtgataacaatcaccaatgcacagccactgtgccaggcacttgaaatgtattacatttccttttattctcataacaaccctctgaggtaaggactcttattagtctcattttatatatgaggaaactgaggctcagagatgttaaataacttgctcaaagtcacacggagagtaagtggtaaagccaggattcaaactcagtctgactccggagactttgctcttatctgtaacactgtgcattttctaagttctatgaccttggcttagagaagaatttcttacgtaagaagcacacagcataaatcacaaaggaaaagattattcaagaaaactgaaagtactgaaagtaaaactataatgaacacttttaacaaatggtgctgcaacaatggaatatccacacatcaaaaacaaaacaaaaacctcaaaaaccaaaaaccaaaaggacccttacttcaacaacatttacaaaatttaccttgaaaagagcaagacttaggaggagccaagatggccgaataggaacagctccggtctacagctcccagcgtgaccgacgcagaagacgggtgatttctgcatttccatctgaggtactgggttcatctcactagggagtgccagacagtgggtgcaggacagtgggtgcagcgcaccgtgcgccagccgaagcagggcaaggcattgcctcacttgggaagcgcaagggatcagggagttccctttcctggtcaaggaaaggggtgacagacggcacctggaaaatcgggccactcccacccgaatactgcgcttttccaacaggcttaggaaacggcgcaccaggagattatatcctgcacctggctcggagggtcctacgcccacggagtctcactgattgctagcacagcagtctgagataaaactgcaaggtggcagtgaggctgggggaggggcgcctgccattgcccaggcttgcttaggtaaaaaaaagcagccacagctcaaggaggcctgcctgcctctgtaggctccacctctcggggcagggcacagacaaacaaaaagacagcagtaacctctgcagacttaaatgtccctgtctgacagctttgagcagagcagtggttctcccagcacgcagctggagatctgagaacgggcagactgcctcctcaagtgggtccctgacctctgacccccgagcagcctaactgggaggcaccctccagtaggggcagactgacacctcacacggccgggtactcctctgagacaaaacttccagaggaacgatcagacagcagcattcgcgattcacgaaaatctgtggttctgcagacaccactgctgatacccaggcaaacggggactgaagtggacctctagcaaactccaacagacctgcagctgagggtcctgtctgttagaaggaaaactaacaaacagaaaggacatccacatctgtacatcaccatcatcaaagaccaaaagtagataaaatcacaaagatggggaaaaaacagagcagaaaaactggaaactctaaaaagcagagcacctctcctcctccaaaggaaagcagctcctcaccagcaacggaacaaagctggatggagaatgactttgacgagttgagagaagaaggcttcagacaatcaaactactccgagctacaggaggaaattcgaaccaaaggcaaagaagttgaaaacttcgaaaaaaatttagacgaatgtataactagaataaccaatacagagaagtgcttaaaggagctgatggagctgaaagccaaggctcgagaactacatgaagaatgcagaagcctcaggagtcgatgcgatcaactggaagaaagggtatcagtgacggaagatgaaatgaatgaaatgaagcgagaagggaagtttagagaaaaaagaataaaaagaaacgaacaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaatgccacaaagatactcctcaagaagagcaactccaagacacataattgtcagattcaccaaagttgaaatgaaagaaaaaacttaaagggcagccagagagaaaggtcaggttacccacaaagggaagcccatcagactaacagcggatctctcagcagaaactctacaagccagaagagagtgggggccaatattcaacattcttaaagacaagaattttcaacccagaatttcatatccagccaaactaagcttcataagtgaaggagaaataaaatactttacagacaagcaaatgatgagagattttgtcgccaccaggcctgccctaaaagagctcctgaaagaagcactaaacatggaaaggcacaaccggtaccagccgctgcaaaatcatgccaaaatgtaaagaccatcgagactaggaagaaactgcatcaactaacgagcaaaataaccagctaacatcatcatgacaggatcaaattcacacacaacaatattaactttaaatgttaatggactaaatgctccaattaaaagacacagactggcaaattggataaagagtcaagacccatcagtgtgctgtattcaggaaacccatctcacatgcagagacacacacaggctcaaaataaaaggatggaggaagatctaccaagcaaatggaaaacaaaaaaaggcaggggttgcaatcctagtctctgataaaacagactttaaaccaacaaggatcaaaagagacaaagaaggccattacataatggtaaagggatcaattcaacaagaagcgctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctgcaccaaccagaccttatagacatctacagaactctccaccccaaatcaacagaatatacatttttttcagcaccacaccacacccattccaaaactgaccacatagttggaagtaaagctctcctcagcaaatgtaaaataacagaaattataacaaagcgtctctcagaccacagtgcaatcaaactagaactcaggattaagaaactcactcaaaaccgttcaactacatggaaactgaacaacctgctcctgaatgactgctgggtatataacaaaatgaaggcagaaataaagatgttctttgaaaccaacgagaacaaagacacaacataccagaatctctgggacacattcaaagcagtgtgtagagggaaatttatagcactaaatgcccacaagagaaaccaggaaagatccaaaattgacaccctaacatcacaattaaaagaactagaaaagcaagagcaaacacattcaaaagctagcaaaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccgatcccacagaaatacaaactaccatcagagaatactacaaacacctctatgcaaataaactagaaaatctagaagaaatggataaattcctcgacatatatactctcccaagactaaaccagcaagaagttgaatctctgaatagaccaataacaggctctgaaattgaggcaataatagcttaccaatcaaaaaaagtccaggaccagatggaatcatagccaaattctaccagacgtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatgcagcagcacatcaaaaagcttatccaacatgatcaagtgggcttcatccctgggatgcaaggctggttcaacatacgcaaatcaataaatgtaacccagcatataaacagagccaaagacaaaaaccacatgattatctcaatagatgcagaaaaggcctttgacaaaattcaacagcccttcatgctaaaaactctcaataaattcggtattgatgggacgtatctcaaaataataacagctatctatcacaaacccacagccaatatcatactgaatgggcaaaaactggaagcaatccctttgaaaactggcacaagacagggatgccctctctcaccactcctattcaacatagtgttgggagttctggccagggcaatcaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcgggatacaaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggacctcttcgaggagaactacaaaccactgctcaaggaaataaaagaggatacaaacaaatggaagaacattccatgctcatgggtaggaagaatcaatatcaagaaaatggccatactgcccaaggtaattgatagattcaatgccatccccatcaagctaccaatgactttcttcacagaattggaaaaaactactttaaagttcatatggaactaaaaaagagcccgcattgccaagtcaatcctaagccaaaagaacaaagctggaggcatcacactaactgacttcaaactatactacaaggctacagtaaccaaaacagcatggtactggtaccaaaacagagatgtagatcaatggaacagaacagagccctcagaaataatgccgcatatctacaactatctgatctttgacgaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaagatccagaatctacaatgaactcaaacaaatttacaagaaaaaaacaacctcatcaaaaagtgggcaaaggatatcaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaatactatttgacccagccatcccattactgggtatatacccaaagaactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccacaaaaaatgatgagttcatgtcctttgtagggacatggatgatattggaaatcatcattctcagtaaactatcacaaggacaaaaaaccaaacaccgcatgttctcactcatagatgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataagaaaaaaaaagaaaaaaagaaaagagcaagacttaaatgtaagtgttaaaactacagcacttctagaagaaaacatgggtagatcttagtgacactgggttaggctaaagtttttttaataggacacaaaaaacacaaactataaaataaaaaaattggtaaattagacttcactgaaattagaaacttgagttcttcaacacacactgctgagaaaaggaaaaggcaaggcacagactgggagtaaatatttgcaaaacatatattcaacaatggacttgtatccagaatatagaactcttataactcagtttaaaaaaccaaatcaaaacaaaccaacaacaacaaaacccagttaaaaagtagggaaaagatttgtacagacagttcaccaaagatatatggctggtaaacaaacacaatgagaaaatgcaaattaaaaccacagtgaagtactgctgtacatgtgctagaatggctaaaatgggtaagactgacaatatggcaagggttgtcaagggattggaactctcctaatttgctggggaggatccaaaattgttcagtcactttggaaaacagttgggcattggccaggtgcagtggttcatgcttttaatcccagcactttgggaggctgaggcaggagaactgctagagtccaggagttggagaccagcctgggtaacatggagaaaccccatctctactttaaaaaataaaaaaaaataaaaatagtttggcagcttctagacaaattaaacatacacttatcctatgacctaataatttcactctttggcacttaagaaaaatgaaaacatatattcacacaaagagttataggcaaatgttcatagcacctttattcacataagccaaaacccaaaaacaatccaaatgttcaagtggagaatgaataaacaaacatgttcatacaacagaatactactcaacaataagaagaaataatataaagaagaaacacagatgaacctcaatagcattatgctaaataaaagaagacagacaggaaagactgtaatgtaagactccaattacatacacttctagaaaaggcaaaattctagtgatagaaagcatatcagtctagtcaggggccgggaggttgggggaagaaactgactgcaatggggcatgaggattctctagggggacagaaatgttgtgtatcatgattatggtggtggctatgtgattacacacttgtcaaacatcacagaattctacacttaaaattggtaagctttattatatataaattatatattggtaaagctagccaaataaagggaaaaataaaagtataatgagataccatttcacaaccatcagtctggaaaaattttagagtccaaaagtactaagagctgacaaggaactggagctacaggtagtttactcttacatattactactaggagcaaagactgctaaatcattttggagtgctaaggatgtacacaacttatgactggcaattttacttctagttatatagaaaagtccttacacttgtgccttaggaaacacatacaagattgcttccagcagctatattttttcaaaagcaaagaaaatgaaaacaacctaaatgttcattaagagaagacggaataagtaaactgtggtgagtcatacaggaatcaactgtgtatcagaaacataatgctgatagagtaaagttgtagcaggatatatacagtatgttttcatttgcttaaaagtgaaaaatgttatttgtttgtggctgcatacatatgtggagaagtataaagacatgtatggatgctaataaacactgaattcaggattgtgattattatctctagcgggcagagaggaagataaagtagggggagggcttaaactgttttggctgtttcatttcttaaactgggtgataagtacatgaatatacatatttcatataaaatcacttttttcaaaacaaaaaggacgcaattaccttgctgaaggtgacattgtatcctcttgcaagaaatggcagaaataacactttagtataatattattttagaagttgcctcacttaaggcaatcatgaaaaataattatgtgaaagaaatgtttcagctgtaatatttttaaacgtctgaatattttatctaattgcttcttttgaactggtaatttattctaagtagcaatttgggagacataataatctcattgtaagtttttctccgtacattacagacaagtacttataaataaacaaatagttctaacttaagtggtttcagggcttctgagataccaatgacatcaaggaggaaatgaaattatctgtacgctttaagagctcctggtattcaattatccctgttgagataccctagaggagatacagttctagaagccagcataagtttatagttctgaaatataaattctccaatcttcatgactcataaaccaaaaagcataaaacactcactaacagagtaacaaactgagaaatctacttggatttccgggctgtttcttttacttgataaaaagacacaaaatacaaacatgaaaaaacaatactttagttcactgaggcctacattatgccactttgaggttgctttttaacatttaacttactttctttaacttatctcctatactgacactaaaacatatacacataaatacttactggcaattttcaaagatgttacagaatctttctattttcagtcacacttcaggtaaatagctacccaccaatgagcatttttaaggaactaagatatacttatttaactttctgtttttgaaaagagtatgtattttatcaactcaatgtacaaagtcagaaaaaccatcaacagctcaaagcattctaaaccaaagagcaaattcaatagaatcaaggattaaatttttaagaacatagttgaatctaaagaacttcacccatatttacttccaaattgtgtaagaatctatagaaaggttttagccagtctgcttcattttagttatgtcaaatgacatataatgaatttgttatgagcttcctcatttattagtcaataagctgtactttttatgaaaatcccaaaatgagaatttttacaagtttaaaatgtttttagaaaattaaacaatgaaacctcagaaaaaaaaatacggagttagtgatgctactacttatataaagcataaatagcaactcaagattttattaattttttttaaactttggatcacttaaatcaaaagcaactcaagattttgaactgactgtacagagaatgtttccactctatgatgttaaccatgaaatacagaatttgcaaaaataaagtttcgtgataaaattaagtgtaatctgttctaaaacactcaaacactcaaatgatggaggtatataatgccttaggtggtcttaaatccaaacataccaatttttctctttcactgataaacattttatatatatacgtaaaagtttttgagcacatgtttgaatgctccaggacagacatttggacattgaattactgggcagaaggatataagcaatttaaaattttaataaatgttttaaaattggtctccaagatagactaccatagtgtatgagagaactattctcctatgttctagccaacacttgatacaaccagattaaacatgttgtaccaaatagaaggaagctttaatttgcatttacatgactactagggaagtcgaatacatctttttgcatattcattgaccatttttatttctactatgagaattgctgctcatatcctttgcctgtttttctactaagtctttttcttattgacttataagcgttcctcatttctgagtattcatctttagcctgttatataagacccaactatttttcttagtttgtcatttttatctttaaagattttttttttttttgagacagagtcttgctctgtcacccaggctggagtgcagaggcccgatctcggctcaccgcaagctctgcctcccaggttcacgccattctcctgcctcagcctcccgagtagctgggactacaggtgcccccaccacgcccagctaatttttgtattttttagtagagacggggtttcactgtgttagccaggatggtctcgatctcctgaccttgtgatctgcccgcctcaacctcccaaagtgctgggattacaggcgtgagccaccgtgcccggccttatcttttagttttatccatgatgtcttaacatgaatgtttatttttcatgaagagcattaatattttgattccaagaaagtaccagatttataaaagctattttatcaagtctaagaaaactaaatattatcccatctcagataaaacactaaggtctacaaatgtgaacatatgggaacacagaagagttaatgacaaaatattctgaatttagctcctatcgccccaacgggttacagaaataataatctatgggcaattatagcactgtcaattgtacaaaatttcatattgaagtccatctcactcacctacagatttgtctgccatgcccacatctctagacgtccagcgacaaaatccacatgccaggtaataggctttcttcatggtggtcttggctgggtcatctggaagctgtgtggagatgctcgtggcccgagtagagagggtgtgcatgcagccaggacagtcaaaacaattggcacatctgtgacatgacaaacacaaccattcattcaacaaatatttatcaaggaattcaagagagaacaaatataaggacaagtgtctctcaagaaaaaacagtaacattctgcaggcctcttaccaactttgctttaacagttcaagagtactatatgttcattagtttaaaaaatatgcagttatcgccaaagtaagaattagagcccaacccaatcctactccacagagagaaccattgttaacagatggagtttatgattccagactctttttatgcttatattgatcacaaagatttctgaggaagagaactgtcacagcttatgcctttagagaggacagaccaactgtgccatagaaaacttagagtcaacaatacaagaagctgtgaaactggatttggaaaataaccgactgctgtgccagagagcttcaacagaaagcaaacaatgctatcaaactggaatggttcagaagcagcatattttcagggctttctgttctctccttaaatgctacttttcctagtgctcagccaacatttctcctttaggaggtccctatgtcttcttgcttttaactctcccaccagcacagattatcaagatttcacctgcagtcctgtacctgcttgaagttctgttctataatataacttgcattatctgttatagtctgccatctggatactatcaaaagaagataataatagtactcaccttacaaggaagctttgaggattaaatgataaaaattaatttgtggaaagtatacaaaacagtatctggttatcaggggttacttctcagggcaggaaagacaaataatagtggttcacatccataaaggtatgggggtatgactaacagcaaaaggactttcacttcaagctaaaaactaaacaccatccagtagcaatgagcaagcctagcagccatatcttggtttctaagactattctccaataaagtgaaccaaggctccttggagaaacaactctaagactgagacagaaaatatacaagatgaggctgggcacagcagctcacgcttgtaatcccagcactttgggccaaggcaggtgaagtgcttgagccaggagttcaagaccagcctgggcaacatggcaaaagcctatctctccaaaaaaatacaaaaattatccaggtgtggtagcatgtgcctagtctcagctactcaggaggctgaggtggaaggactgcttgagcctgggaggttgaggttgcagtgagccaagattgcaccactgcacttcaacctaggcgccaaagtgagaccctgtctcaaaaaaaaaaaaatacacacaaaacatacacacaagatgagtctggagtatcttgtagtactggtaagaaaatgatcaaagtaatgaacagagaactctctcctgctcctaatgatgggggtatgtcaaagggatctaggagtcaactgaaagagctcccaatggccaaagctgaaataatttgagcaaaataaataaagtagtattggattacaagccaaaatataaaatgaatattcataatcccactgtcctataagtaagtgatttaaaaaacaaataaacaagaggagaagagacagatcttccatgcaaaagaattccaaatccaaataatttatgcagatagtcctcaaggacaggggagcataattctctagtctttatgggctgtgacagtaattttccttccaaaaagtagagtacaaaaaaagaaggaaaagcagtaactttacagtggagaaacctgacaaacactagctcaagccagataatcaaggttaacaccaacagtgacaagtcataagtatttacccttgatatgatgtaatcaaagatggcactttacctctgtggttctcctccgcaaaatacattcccctagtctgatgagaaaaaaacatcatgcaaatcctaatgaaatgacattctataaaatacctcaccagtactcctcaatacttttgaggtcatcaaaaccaaggaaattttaagattctcctatcacaccacacccaagaggagtctagagacataactataaatataatgtgatatcctgaaaagaatcctggaaaaaaaggagaccacagaaaaactaaggaaatctgaataaaatgtagtgtattggttcattaattgtaacaaatataccacactaatgtaaaaagttaacaataggggagactggatgtgaggtaaatgggaactctccatactatcttcaccataattctgaagtacaaaactgttctaaagtagaaaatctatttcaaaaatcaaaggggatttcatctttggcaatggtgatgcttaaaaatgaaaaagagctggttaaaaaagttaatttcatgtgtcttttttttttttttttttttgagacaaagacttgctctgttgcccaggctggagtgcagtggcacaatcttggctcactgcaatgtctgcctcccaggttcaagcaattcatctgcctcagcctcccaagtagctgggactacaggcgcgtgccaccacacctagctaattttttgtatttttagtagagatggggtttcgccatgttagccaggatggtatcaacctcttgacctcgtgatccctgcctccgcctcccaaagtgctgggattacaggcgtgagccaccatgcctggcccatgtgtctttttaactagctattttagagaacagtcaaggaaaataggaagaaaaaaaaaatcagtccaggtcttacctattcttttttagtttggcttcagccgatggcatattttctaaacaactgggacaataatgggagtccacctaggaggaaacaagaaagaaaaaaaaaaccagaggagaactcagtttaacttgtgtatatgtcttgtcaaatagtgaattttaaaatatgttatactgtagcagaaagtagactgttttctgcttagggtttattcttcttcagtcacctgttttttttttttcttcttcttccggatttaaaaaatccttctatttttctgatctttcctattccatcatcagggttttatgtgttaaaagttgtttatttaacaatctacaatttccagttgaactccatagaattctatgattaataaagagattaataaaataatccaatttgtaacattgtgataaaatatcctcctgtctaggctagctttatatgactataaaacttgaccatacttttaggttttgaaggacatttttttaaagatttctcattattgaagtaatacaggttgactgaaggcaagcataaatatttatttacatagtcagctatggccaaccaattagagatttttaaacaaattaatgggacagtcttattgtacttaaaaaactggagtctaaaatttaagttcattttattttttaaaagtctgaataattattttctttaatgtaggtcctatttgacaattatagaactctagtcacctgcaaatgaaaagacaatcactggaacataaatactatgatagaaactggcttttttcatcatctgctataaacaggtcaatttgaaaagattaataaagttgttgctcaaataatctccaggaacataaaatacaatattgctaactaacctctgcactgactcatcaaaaaaggcaaaatacaagtcattcctttttgccccctttccaaattctgcttgtccgttcatgtgcagctccagacccagattctccattagaacttcactgcctgccccagccctcagagcttcatctttccctaaactctaatggcctccatatcacaggtacacatcaggctgtaaaagatgctgtcacagactggatgtcctaattgaagagagtcttagagacagatcatggagactgagcactctattcaccacaggagaatatgatccaataaattctggaggtggagctggaatagggaatcatcaaggagatacacataaggaaagtgctaatggagatgagaagaaaaatcgatgccatatttttaatatatacgatttttcttgtattatttaattgcttttcttgactattcctattatgaaaagtatcttcaataaaataagttattaataacacataaaatggcttatagtatgtgttttcatatgcatttattttaacagtcccgggatcttcagtaaaaaacactctgagttaggctgtttagattcaaatccaggtcctccttcccacccccaaattactggctgtgtgacttacagcgaacactctgtatctgtttctttacctgtaaaaaaaattttttaaaaaaagtatccacttaaattggtttgaagattacataaagcacatgacatatagcaagtatcgaataagcagcaactattactactatcagctttttcttcactaagactatggcttattaaacagcgcattttatgtcttactcgccttttaatccctaaagcttactgaataaacaagatgtgccaagcgctgcagaagttttggggttttgttatttggtgactttttactggccggggtcttctttttgaaaaatccaacttcggacgcccacttgtgccagggaaggacagcattgtcctctagctccataaatacactttcagcttcttacatgacatactgtattctgagcgcttttcacataactcacgccgccccaacctcttcccggctgcaggccttggcctgagtcaggaacagggcaaggcagtctgacgagggcccagtttctggacaaaagaggaacagaactttcaggatgggagaactatgaatgagaacgcctgcgcctccctccatcctcgcaataaatcctggaaaggcagtttttcgccccttaagtggcctgaactaagcacccccagacctttctccgtagtccacccaattaccaagccccatcgcagacagacacggtccctaagtcaagtttgtccaatcagaggccgctctagaaccagaagatccgctcagtcccacccgaggctgctcctcctttccaagtgacagattagaagcaaattaaatcgcaggcaaacccgagtgacggaagacataaccaatcagtaaggaaggaaaatagctccagccttccggtggcagtgactagcatgaacgccgcgccccccccaccccacatactcgctatagggcgactctgttacctcgtgagacacacattccagcgaccgcagttcgctacaatagcggcagaagtagagttgcgagagcggggcccgaaccttcttttctccctggactagatagagaacccggtccgactgcagcaaggacgccatcttggggagggaggaggcgatgacgctcccggcgcatcacgtgacccgagagccagcgtcttcctcgctgccttccctacgacttcctacgtagactttgac

SEQ ID NO: 632 - DNA, 49775 bp, Homo sapiens
ctcaagctttgtctgctttatttcactacattaagttaagcaataaggcaaaacagtaacctgtcattcataaagatcaaggagtacctctctgtcccaaaagggaccaaaaagggtgtttcttcacaaatatgcatgacacttagctcattatgctgataagcacttcaaacaaaagaaaaggtcagtaggtgaatcaagtaacaaatccaaattaacttagcctaagtttccaaagctgtagtttcaagtgctaatgggatctaactttcctgtggtggtgcatactgactagcattaaaatttttgcacctcatctaatataaaaaaggcaacaaatacaattcctaattcaccagctgcaggtattgaatcatttctacgaacacacagaatactagcttacactaaaacctatcttgaggaaacattaaaccagtggctctattattctgcaagttagtttggcttctgaagaaaaaagtttatgatcaaagtgttttgtgtttctgtgtatgggaatgatgagacccatacttcaacattattactttggggaataaataccagctacctgccataaacgcatgacatgtgtgtagtctatgcaaacgtgtaaacatatgaagctattctctactctatgcccatttcctccactggcaaatatggagcagtgatttcacagtaggctctagcaggtagtgaaataaaaatttgagactctgtggggtcacaaaaaaatgaaactctttctatagtctgcaaatctgtaattacccatccccctgctccaactcctaagaggctaaatgttattaccataatgttagagatgagtattttccttcttacactgcatcacatatattactctgtaggactgtttcataaaattggcttgacctttgtacaattagtacaatttagtgtcttttagagtacaatttagtgtcttttaaaagcttcctaaatatttaaaacattttcaagggaagcttacaaggactatgtcccatctgtattctacattataatgttatctttaattttttaagacttaaaacaagaccaaggtaaacaaaaaatctgtattttcctcaagtctcttggccacttactaacaatacttttacagaaaacacggtgcagctggtggtctactttatcaagtttcattttagaaaacatcatagaaattaaggttagcaacccaactccaggataccaagtgaaaacagcaagtctgctgttaggccagaactgtgggctacttgctgaactattttatggtttacaatcaaaatggtcttatttgactcaccacatgacaaaagtcttaaacttagtaagggggaaagttcttaatatccagttttggattcaagagattataatagttaatttccccttcaaatcaatggaaagaatgctagttgagaatattctaaaaatctagcctttaaaatgttttctgcattccagaaatgaacctgtccactcaggttttctttgggttcttttccaggtcccaaacagaacaacttaactgagttaaagaggcagaacagggaaggggtaggaagtaagacaaataaagattgcccccctgtggcagcattaatccctgggtattgtggcaatattgaaaacgaatggaatctgctacccccttgacatgacatgtaattgtttgcttctcaaattcttcttaaaagatccatattttactgggaaaaaaattaagaacaactaatacgtgtcctgtattcacttagaaaaagagggcaaatgagagtgccttaacaacttcacaggtttttccaatcatcatgatactaaagataaagtgacaattcagtttttcagttatatggaaatctatggcaaaatggcagccattatggcaatgaagggatatgttttagactgttagatgatatttaacggaatgcagaaagcagttggtacattgtgaccaatgctggatcattaacagcaggtctacctttgggttatcatttaagtttcatctgtgacattgtgatccttagtgagatcagatcaagagacagtacagagtttctcaggtggtaaatacaatgccattccaaggaacacccatcccctttcctaggatggaattatgctgctgttactcaacgtgcagggttcagtgagggagacacagacttactggtgtcaacaggggtgagagcaagagcaacagcagctaccctgtgttcccaatgccttgcctatgctcccactttcttagcaatagaattccgtagtgcatgggtacatcgttataaacaaggcctaatgaagcagcagcttccacattttaacgcaggtttacggtgatactgtcctttgggatctgccctccagtggaaccttttaaggaagaagtgggcccaagctaagttccacatgctgggtgagccagatgacttctgttccctggtcactttcttcaatggggcgaatgggggctgccaggtttttaaaatcatgcttcatcttgaagcacacggtcacttcaccctcctcacgctgtggtgtaactttgatgaaaatacccactttgttggcctttctgaaggctataatgctatggaaagaaaaaaaagcaagtattaggtagataaaaaaatcagccaaaccactaagacttacagtaaaagtctttcaccttattctttccttcagcacacacagaaaacctataaacactttgttcttaacctaccaagtatttttttgttttgttttgagacacagtctcgctctgtcgcccaggctggagtgcaatggctccaccttgggtcactgcaacctctgtttcacgggctcaagtaactctcccatctcagcctcccgagtagctgggactacaggcatgcaccaccacacctggctagctttatatattaatacgtatattttttggtggagatggggtttcgccacgttgcccaggctggtctcgaacaccagggctcaggtgatctgcttgccttggcctccaaaagtgctgggattacgggcataagccaacacgttggccatatatttttctatgagcttatacttttctgcttttctaaccaacacagatggtacacactattccataacttgcttttttttaactctgtttatcacaaacaccttttgacgctggtatatacagatcatctacaatctatgtaatggttgcacagtattcaattatgtgtttaccataattggcatatactgaggttgctgacaacttttctctattataaacaatggtgctgcaaacatccctttacatttacctctgtgcaaatgcaatatttctatagaacatagactcataccgtggaaagttatttatttatttatttttttgagatggagtctcgctctgtcacccaggctggagtgcagtggcgcaatcttggctcaccgcaacctccgcctcctgggttccagcgattctcctgcctcggcctcctgagtagctgggattacaggtgcacaccatcacgcccagctaatttttataattttagtagagatggggtttcaccacattggtcagactggtctcgaactcctgatctcaggtgatccacccgcctcagcctcccaaagtgctgggatcacaagcataagccaatgcacccggccttatttttattttttagagacaaggttttgctctgttacccaggctggagagcagtggcacgatcatagttcatggtagccttgacctcctaagctcaaatgatccttctgccttggcctcccaaagtgctgggattataggcatgagccaccatgcctggccatactgtgggaagttttaataactcagtgctttaagggaaattttggaacaccataaatcaagaatgtttttgtaaataacttatgtaattaggaattttagcacaaaaatgtctcttcattgaggtttgcatttcaatttcccctcatttgtgcatacagtttgtgctttaataacttagtttctgaaagtaaaagggcaatgaaataaacagaatttgtctactacccaaatgacattcagttactctaagaaaggttactgggattacatatttacatatttatacagtgttagtttccagaaatctgaaagttctattaaatctaataatgtaaaatataattaattcagtttttaattactctatcatgtaatcaggctgaaatctgatatctcagacaatcattccagaagtatatcttggcttaacaaatttctgtacctaattaatttgaggacccacataaagcaaggatttgagagaacacattttgtactgtacaactcagcacattttgtattacagtaactaaccagacctttgatttgtatgagtcatgtaaaaaataattcaaacagtttaaaatggtaaaaagaaaaacatcagtctttctttttatccttaatttcccaggcaaccactgatacctgggaagcttttccaaaacaaatttggatttctggtccctagctagacctgctaaaaaaaatcctctggggttagggtctggaatgctatcgaacaacaaaacaaaacaacacttgacctggtgctttctgaagttaacccacgtttggtatcactaaactaatctcacctttgccttcactttatttttcttttcttttcttttttttttttttttgagacggagtctggctctgttgcccaggctggagtgtagtggcgtgatctgagttcactgcaacccccgcccctagggttcaagtgattctcccatctcagcctcccaagaagctgggattacaggcacgtgccaccacgcctggctaatttttgtatttttagtagagacaggatttcgccatgttggccaggctggtctcaaactcctgacctcaagtgatctgcctgcctcagcctcccaaagtgctgggattacaggcatcagccaccacacctggcttcactttatttttctaacccaccttgttatctcttctctctaatatcttgttgagaaagcttttgatcattctgtcaaaaaaccgtaaatgggccaggcatggtggctcacgcctgtaatcccagcactttgggagaccaagtcgggtggatcactttaggtcaggagttcaagaccagcctgggcaacatggcaaaaccccatctctactaaaaatacaaaaattggccaggcgtggtggcgcttgcctgtaatacaagctcctcaggaggctgaggcaggagaactgcttgaactcgggaggtggaggttgcagtgagcaggagatcacgccattgcactccagcctgggcgacagagactccttctctaaaaacaaaacaaagactgtgaatgttccctgtgccagtttactaagctattatttttcagctccaagcgcacctctctcaattttgctttgtgacacaggattctgcttggactgtatctgctggatcggatggctctttgtcaggttctgtcagcagcgggctctaaagggagactagaagtctggaggaggaagggtcttgctcttcctttagagattcctgtttgcttgtggtccctgttccctgtggccatcactccaaaaatgtctttttttttttgagacagggtatcactctgttgcccaggctggagtacagtcacaatcacagctgactgcagcctcagcctaccgggctcaactgattctcccaccctggtatcctgagtagctgggactacaagcatgcgctgctacacctggctatttttaaaatttttttgtagagacggagtcttaactctattcctaggctggtttcaaactcctgtgaagcaatcctcctgcctcagcctcccaaagtgttgagaatacaggggtaagccaccatgcccggcccagcaatgcttctttacccaggaggaagtggcagtaagcagttgaagttttccaattcttgtataatcatgccacccctcctttgccatcacgagatgccaggaccacgcaagcagtgttccccttcagctcactggaggcctgagtttcagctacatggagctctttgtttaagttctaaattttaataattctaactatttccctttgttccctccacctaaggggtggtagctggctcatcaaatagctatctttgaaattttatgcccatgaagtagcataaaattgctacttcagtgttctttttcactttttaagttacacaagtgaacaattatttatattaaatcctctgttcgaatcattgaaaacattcagtctacagactgaattctctgatggtcacagtccccagttactggaaggtttggttcttttcagttattagatatgagagagtaaaatctattaattcctccaagggggtgggggtggggaacaaacccgatgatcaatctctagggacagagtattgtatcctgtccacaaccattaaaatcatataattaaaaatttctttattaacatgggaaaatatattcaagtgaaaaaggctaaaaaactgtatttatagaatgatcccaatgaggtgagaaatatttggaaggacaaatgccaaaatgctaatggtgtttatctctggtggtgggataattttattttcttcttcatggtcttacatatatttccccaattttctacaataattatttttagaaacaggaagaaaaaagttattttaaaaaatccagacaagaaaactggatataagtgggcattctattatcagccatttgttgtatggggatcacaaaaagatcactcactcaggatcgtcctgaaagtcttgaggttctgccaactcatcgtactctgctgctgcatccttgccagctaaaacgagctctttgggaggcaccaccacctggagagcaacacagagaggcctgcctgagaagggaccagtgtgacagaatatagcaaagtacgacattgatttagacaaatggaagcacacagcaagtttcaggaaacatatactacttctatggagtttataagaacaaaggttttaagagaaagctaagttagtacttacttcatggggtctgcaatgaggaactggggagaacatgggggcttcaattgtgtctttaatgttttattttattatttatttttttgagatggagtctcactctgtcgcccaggctagagtgcaaatggcatgatctcggctcactgcaacctctgcctcctgggttcaagcgattctcctgactcagcctcatgagtagctaggactacaggtgcccaccaccatgcctggctaattttttgcagttttagtagagacggggtttcaccatattggccaagctggtttcgaactcctgccctcatgatccacttgcctcggcctcccaaactgttgggattacaggcgtgagccaccgcgcctagccctaatgtttaatttcttaaggggatggggagaaatgggtacttgccatattattcctcatttttttttgatacatctgaaacagtccatcattaagaacaacacaaaggagaaacactggttccaacacaatgttttttgacatggtaccagctgattcctggtacctgatacataaacttacatgagatactgggtgattatggtcatggaaaacaattagcattcttcagacttatgttgtaattaggcctcaactttgctctatcagaggttaacagttaacagtgttgatcaaatttctaattatagatacaaatgtgggaggggaggtataaagagagctttataaagatatgctgtgcttatgcatcaggtacttatttctgtctgtcttaactggagctgcttattagtgttaataaaaaaaggaacgtcagggcacagtggctcagatctgtaatctcagcactttgggagcccgaggaaggtggatcacaaggtcaagcgattgagaccatcctggccaacagggtgaaaccccgtctctactaaaactgcaaaaaattagccgggcgtggtggcaggcgcctgtaatcccagctacttgggaggctgaggtaggggaatcgcttgaaactgggaggcggagagtgcagtgagccgagactgcgccactgcactccagcctggcgaccgagtgagattccgtctcaaaaaaaaaaaagcaacaaggaccaaataagtgaaataagtgttatctctctttggaggtgatgctagtaagtgaaatcattaaaaagcagaagaaaaaaaaaaagaggacagaaattctctaatattatttgaataagaactaaagatataggcatctttttaaaccatttctattataaatatcatgctgaattatgaattagtaatagatgatctatagagaaaggctcttgttctaaaatttcaagtactagaagtagcaaaatataaagagaggccatattacatccattcaactcacactgagtcaaaatcacctactttaacatttagttattttgttttttgagatggagtctcacctcagccgcccaggctggagtgcagtggcgcgatctcagctcactgcaatcactgtctcccgggttcaagtgattctcccatctcagcctccccagtagctgagattacaggcatctgccatcatgcccggctaatttttgtattttagtagagacgggtttcaccatgttggccaggctggtcttgaactcctgaccttagatgatccactcaccttggcctcccaaagtgctaggattacaggcgtgagccaccaagcccagactagttagtgctatgttatgtatactctttgtaaggtagaggaatctagaggaggcataccagcttctaaatgattttaaacgtatcatttctaaaaggaaatgatatttcacaagtgttgaagaatgaatgtatgagactgagagactgaaggggcatgtatgttaggggagtcaggataggaaggaggcatgctaagtaaaatgaatagcatacacaattctccagtgtcaaagtttataacccattggatctgtctggatcacaaccactaatatgtacgattcagggaatgctaaatttgaggatctgaaggaagaccacactggaagaacagagaagtaatgtcattaagcagctcttatgctatgccaaaaatctggacttcatctcagtcaagagcaatgctaaatgaccagcatgcacagagttagattttagaagtatcaccctggtggcaagagagaagaaatgggttgaaacagaggtggtggtataaaaatagcaaggtcatttaggaagttattgtcactgtccaggtaagaaacgatgagaccttcaaatagggcagtgtgtttcaggataaagtaaaaaaatttaggaggtggaatcaaaagaacttgctgactagatgtggaaaggagagtgtgtggagtcttttaagccaggtcaaatgaggacactccagggaaagtgcgggtcagtcaggctgaggcaaaatgctcctaccttagcagtgctgttgatatcatcagggtccccctcctcacactcgaagagagtcacatgggtgaggttctcaactggatttgtaagagtcaggaggacctggctctcctggtgaataggaaacacatctctcagacattcgccactttcttagctgctataccgaatatttcgcaaaattaccatccccgccattactcctgggcaatgacgccctacttatacctctacatcactgtattctctatgtgcttactgatccctgttctattatctatatgttagaccaaatactctctggagttgctatttcactgaggaaatgggacagattccactgaaagggccagttactagatccagaaattctgaggaatgttcattatctaagtgaagttaaaactcttgtctcacccaggctgccacttaaggactgaaaaggaggccctcataaataaaatatgggagccacaggccagtcagatgcatgaacagagcaaaaatggcacaccaagactacaaaaactttttaaaatttttattatttatttatttattttcgagacaaggtctcactctgttgcccaggctggagtgcagtggcatgatcatggctcactgcagcctcaacctcctgggctcaggtgatcctcccatctcagcctcctgagtagctgggaccacaggtgtgcgccaccacacctggcaaattttttgtattttttgtagagatggggtttccccatgttgcccaggctggtcttgacctcctgcacccaagcaatctacttatcttggcctcccaaagtgctgggattacaggtatgagccaccgtgcccgaccttataaaaactttttaagacttcttgaactgtgataatttgtccttgtttggtaccctctctagataagcaaaacaaatctttcaaatgaaggcccatgtaataaatatttgtgttttcaggagcagcatgaaagaagagttaaagagtttgctgcagaatattctacaattcactgggtgtgtgtgtggaaggaaggggagtagatgaggactccaaggaagagaagggctgtggtatataaatctaactgaatcctagtacctgaaacataacaaacaggagatcgaagagaatctctaggctggagaagaacaaaagatgcctgtgggatccaacattctctcctttcttttccccacctataatttcaccttaacataatgtgcaccctgctccttctccctacttttcatcagatgctgttgtcaagaatctcagtgtcaacaaatttagtctttattatcccaaactgtcttcttttctatcccttgctcactggatcctgtgccaaatacacacacagccacccacatacacatgtacacacatcattgatcaatcctttttcttcctgttaatgagcaaggtactaaccttcatgtagcgaaggttgggaattgacatgattctcacttctggaatataattgctgtgcataaataaaaaaatgcattaatgttcattggagtctcttaaaattattattattttttaaagctagtgcagtacataaaggatttcatgttaattagaatgtatcagaaaaaaaataattttaatgaaccatatcatcacagtaagaacttaagaaaagacataagaccaaactggtatgagttctttctgaaatcttacgtatatttctagttgaaactgcccaggccccagattagcatttacatatcaagatattgctttgtaatgactaaggcaagatatttatctccttgtgccttggttttcccaattctaaaatgaggaaaataatggtatctttcacttgaggttattgtgaagaatacatgcaagaatgctttgaaaagtgcttggaacaaagctcacataaatgttcattattgtgcatacattaacgtaatacgaaatctattgcagaaacattaaaagtgggggaaaaagtacatcttagaatcagatatttaaactttaaacgagctatttttcatggtgaccagcaggattacctgagtaacttaacaggaatttaagaaacttttgtcttcctgaatctcaaaaaaaacacacacacacacaaaagcaacaacaataaaaataaatttaaagaccccacttctaagaatttgaattcagtaggtctgaggtttgataccagagctctgtatttttttttttttttttgagacagggtcttgctgtcacccaggctggagtgtaacggcacaatcatgactcactgaagcctcgaccccccaggctcaagtgacattcccacctcagcctcccaagtagctgggagtacaggtgtgtgccaccatgctcagctaatttttgattttttgtacagatgaggactcactgtgttgcccaggctgggcttgaactcctaaggctcaagcgatcctcctgccttggcctccccaaatgttgagattacaggcatgagccaaacacctggcctcagagcatctgtattaagatagccaggcaattctaaaatgatgtcagaaaaaaatcactttttctcaaagcaagcttaagaaattgatgctaagtacaggctgccattcagggtttctgtaatgagtataattcttaagaaaggagttcatcccagacttcacaagtgccatttctgtaggtctctaaccaatcatgtattaagagtagttaggaaaatgaacatattttatggtgagttacaaggcatttgcaaacataattactcatttgattcttttcaagaatcccaagaggaatacattattcccatttcagagacgagggaagtatgtttagacaaaaatagtaagtgacagaccctcttcctggccctcctagctcctcctaactcactagacatgcacttcccaacctttttgtttcctaatacttatttttaattgctgcataatattctacagtacaagttatctcaatttaaccaactatttccttgttaatggttaatcagtttgacactgattaacttttggttaaactgtttgcagctttttgccattaatatattctaaaacacacctttggaaatgcatctttatatattggtgattttgtttctacagaatatatccctgaaacagtactgttgggttaaaaggtctatgtaatttgttttgatatttccagaccactctccaaaaagactagcaattcaagatcccaccaacaatgtgtgcaagtatgtgtttacccacattctcatgagcactagatgctaattaccttttaaaacttttcctatcaaatcttagtttctttccatatacagtgtatcttctggtcatttgaaattcctttcccataagctacctgttcaaatcccttgttccacattccactttactgcctccctctatttttatcttttcaatttctgggaattctctatgcctgggatattaaacttttgtttgtcatgactgccaaatattctttcttgctttactatttgtctcaggactttgttgctaattttgtcttaaaaaaatttttttttccttagagagagagtcctgctccactgtctaggatggagtgctgtgggacaatcatagcttactgcagccttgacttcctgggctcaaggggtcctctcacctcagactcccaagtagctaggactacaggtgcatgccactacacctggctaattttaaaaattttttgtagagatggggtcttactatgttgtccaggctggtcttcaactcatgggctcaagtgatcctcctgactcaggcttccgaagtgctgggatcacaagtgtgagccactgcacctggctttaatttcatcttttataaccactatttctttttgctaaggtcaaaggtgtttcttttcttttaatggcttctgggtttcctgtcttgctaaagaagggctctcttactccaaagctagacaatactttcctaatttgtgaaaatatttttgtttgccaggtaatttaaaaaatttatgtattagaaaagtatgatgagatatgaaaagtttacatttaattagatgaacactgggtaagttttaagtggcagtatttgtctctaattaggaccattcagatagcctgataggtagtttttatacacaaaattctcttctactcacaagtcccagagagttaacactaacttaatcactttcattccagtcaacgaagtgttataacacaggtaagtaaaatgaacactgttacagggatactcttcaatcagctatacttcattatttttaaattttttttgaaggattattcccaaactcagatactttataatttgtaatgatgactagtgactttccaccaaataatcaacataccttgttgctccagatcatactgggacactgtgtccctgatcccaatacccctgaatctatttatcttaaacttcatggcatgtaactaaattaaaaacctaaacaggaacagaatgtcaagattattttgatgtaatttttttttttttaggccaagagtaaacacacttcatactggggaagaagaataaaccaaaataactcaaaacagtaactgaaaacaccaatcccaaaatacttacacagcgaccagctggattttgaatttgattgacgttgggttaaattctggcttgctcaaattatgttcacatttctaaaaagaaaacaaatataacacgtatcagaagacaacaacacactttgttgatccatagagctgctaaattcagaaggacagcatttacgagaattttgttttgttttgttctgctataagaccatatgtttttgaataatgtatagcagccaaagtttataaaagatgttcgcacttcctgatatgtgcaaccccactatccaatattattatacctctgtggtacttaaaaactactaaaataacacatactgagtacatactgtatttgctaaacaacgtgctcactggtttaactggatttaaatatcacatcaactttatgagctaggtataggtattacattaaggttgccatattatagatgatcaaaatggtatacaggaagggtaagtaacctgtccaacttcacagagccaataaaaatggacactgggatttaaatctaggtagtaaaattccagatcctatgctttaaagtacagtaacaatgattacttttgagatagggtatcactctgttacccaggctggagtgcagtggcacaatcaaagctcactacagcctccaactcctgggctcaagtaatcttcctgccttggcctcccaaagtgctgggattacaggcatgagccactgcactaggacagtaataattatttactactttcttaaatacatactacatatacctggttaaaaatttttttaacagaacaaaaaaggtgtccagtgtaaagattacccattatctgtctgtccccttgttttctccagatagcctatgcacataaaagtacaagcatacatcaccttgcttttttcacaataacacaaaagggaacattttatatttattctcttgcttttttcatttattctatcttggaattaattccatttcagtacatatagagaggcctctgtgtcccactgtaacaatttctataacttacataagatagaaattgatggacattcaggatgtttccattattttgctactgtaagtaatgcagcgatgagtgttcttgtacatgaatcatttcctaagtgtctaagtatctgtaagacaatttcctaagagtagatcaaagggtgtatgcatttgctattttaatggatactgaaatataactgactaatctgacgattatgaaatgatattccactgcagttaattttttttaatttttcattttctcattgcagttttaatgtacatttccctgattagtgtataaatttgaatatctttcatatttattggctattgggatttcctctgccataacttgaatgttaggatctactggttatttttatttccttgccgatttgctgatattaacaatagattttaatctcttgttaataatataccttgcaaactacttttctcagtctgtggcttatcttttcatttctttatgggttttctttggcatgagggtacaagttttacttttaatgaagtaaaatatgtaactttacattacagtttgtgcttatttgtattacttatgaaacatttccctacccagaagtcatgaaggtattctcctctatttccttctagaagtttggctcttcagatttccaatgttcctgaaattaacttctatgtagggtgaggtagcaacccaattttattttcttccatataatcacttgacctagcaaaatataattgcctattctttccccaatgatctacaatgccatatttagtatataacaaattttctcatatgcatgggtctacgtctgcatacatatagacacacttttttttgtttatatgtacatttgtactttccctccttttttatacagaaaaagtgcatacctaccatgcactttgctttttgcatttaaaaatgtatcccaggctgggcgcagtggctcacgcctgtaatcccagcactttgggaggctgaggcgggcggaccacgaggtcaggagattgagaccatcctggctaacacggtgaaaccccatctctactaaaagtacaaaaaaattagccaggcgtagtggcgggcgcctgtagtcccagctacacgggaggctgaggcaggagaatggcgtgaacctgggaggtggagcttgcagtgagccgagatcacgccgctgcactccagcatgagcaacagagtgagactccgtctcaaaaaaaaaaaaaaaaaaaaaaagtatcccatattaacacattcttttataaatttatagtactcattctgcggatatactataatctctgcatattttggtttgtatttgtggaggtgcaaggtagattcctaaaagtgaagttgatgagacaaaaggtaactttacttttggtaggtattactatattaatggtgcattatataaccatatttatataaatttatatcaatttaatttatatataactatttccattactaatcttttttaagaaatcaacttctgattctgttgcccttttgtattttggtttcttaatttactgtattttatattaatttattgtattttattttggtttcttaatttattaacacctgttctctttggactttgctgttttttttctaacttcttgaaatggatgctgacatcgctaatcttttaatatttcttcttttctaatatatactgtatagctaagcacagccttagttgtatcctgcaagttttgctataaagaaattactgattcctaacttaactacgttgtgatcaaataatatactttaataatttcatcttccagctgacagcctcagcaagagaaagcatagggactccaatggcagcagcagcatgtgcaaagaaacaatcatgaaagttggtagacaatattggatgggtgccccaggtctctccaagctggctatttattatattttgttatttaaaacaaacctgtatttatttattttttgagacaagttttgctcttgttgcccaggccggagtacaatggcgcaatcttggctcactgcaacctccgcctcctgggtacaaccaattctcctgcctcagcctcccaacaaacctatattttaagcagaattaaaaaaaaaataagctggtataaggctatatgacttttgatcaaaccaacgagatgcagggcttctaaatataagggatcatctgaaatgaatgttgtttgaaataactgtctaattttgagagttccagtatttatgtgaaaatttaacaatttttaaagaagtccttggaaattggtattgacagtaaatctccttaaaatagaattttaaagctttcaacacactggaactctccccagctttggaccaaccccacaactgagcggagccacctcctcgagacatgcattgctctgctgctggatactctaacagcttgaacaggggagctcacttaagaagagatattgtgtagtttaaaacatattagtttgtataaaataacttctcataaatttctcataaattaaagctgcagtacaattcacttagtggttaggccaatcctccccgccattatccttgctttgttataaatcaccattaaaaaccattataatgtttttaatagtatcagctggcacttaaatatttttggagtgaaaattattcctaaagttatacatgactcccacaaaaatacagttttatcatattaaagagacctgtactgatttgccaaaattccgcaacttagcaaaggtattaccttccttggatttgtactttgtgatacagtgtgctgtaccgtgggctggttatgttaactgaaaaaatagtcattacccaagttttgcagcactctaaacttaagcagaagaacagctgttcacatcttacaaatgccatgtgtcaaaatcatggttttgtaattgctaaggtacggtatgtcaggttatttgaaaacaattactttttgaagtaattgtgaccacaaagcatcatttttacatgaaaagttgtctgtcatttgaaattatgcaaatgatgtcttgacctgaagcacaaaccccaggtacttaatgtttttaataatatggtgccactgcaggggttaggggcggtggggaagaacaaggataatggcggggaggattggcctaactaaccactaagtgaattgtactgcagctttgatttatgagacatccttatctgggatatttgagggcagctgcaaactaaaaacaatccagtaaatgtactttgtttatattttgtatcaggcaattatcaactgctaaataatagctttcatatttgcaactgttgcatacagagtacttttgctaaaaggtgattagctcttgcctttaattttacagtgcttaatgtgataaacttccagacatgtttcctataaaagagaccatttaatatatgtatataaaccacagtaatagtataacatactattttaaaattatttttttctacttaaaatatttaattttaggcttcttaggacatttctaaagcagattaaacccaataagcaggccgggcgcggtggctcacgcctgtaatcccagcattttgggaggccgaggcgggcggatcacgaggtcagaagatcgagaccatcccggctaaaacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaacaaaaaacccaataagcttcctgatgatttttttgtaattggagatagttttctcaactgaaataacatttcagctaaataaagcattttaaaatattgatatttgataaaaaattgccttgtataatttctgtaaattatatttgttctgaaaaaggtataatgccctaatgttaaaagattttaaacaaatccttatcctttgatttttaaaactctgatctaatgataaaattctataaattttcattttcccgtgcagttaggtagcaaaatagctggtaattcataacttttacctattaaaatataaacacacaacaagcaaatgtatttaagagtactaaatggaaataaagtgttcaaaagagaaagtcttgtgttattgagcatcttagcctatttattattataaagtataaatgtgacttaaatcttttcttgttaataaaaactttcttttaactgaaaaagaatttcatcttctgaaaaatgttcagacttactttataataatccagtatataatcaacctttataagtgttctgtgtgtacttgaaaagaatgcatatattctgcagacattgggtacagtagtctatatatgcccatttggtcaagtttgctagataaattgtccaaatgttctatattcttactgattttcatctatttgttctctcggttactgagagaagtatgtcaaaatttcccaaaatgatttgtccatttatgtaattttctcaaatgtcgctttatatattttgagtctattattcagtgcacatgactttagacggttatatcttctttgtaaattgaatcttttttttaaacaaattatccctcttttaaaaaaattagtgtttgtccaatatttttcccacttctctctactttcaacttttctgagttctcatgtttgtgcttcttgtaataagcatatagatggatcactgcaatttgctttattatttagactgacaatgtttgtcttttaatggaagcatttagttcattggtatttaatgtaaatactgatacatctggattttaatctactatcttaccacacacaatcttttttttttttttaacagacagggtcttgcttcgtcacccaggctggagtgcagtggtgtgattactgctcacagcagcctcaacttcctgggctcaagcaattctcctgcctcagcctcctgacttgctgggactacaagtgtgtgaaccaccacactggcttttttttttttttttttttttttttttttttggtagagacagggtctcactatgttgcctaggctgatctcaaactcctgggctcaagtgatcttcctgccttggcctctcaaagtgttgtgattacaggcatgagcccaggctttctatttgaactaccaattcaatgttcctttgccccttctttttctttctttttataaaggtttttcattatagaaattttctaacgtgtacaaaaatatagaatggtattacaaatctctaggtacccatcacccaacttcaacgattatcaacttcggaatatatatgcaggacttgaatctatgctctcaggttaaacaaacaaaaagaatcagcatcttgttatcaaaaattagcaacaatggccaatcttgtttcatttatactcttacccattcctcatccctcattattttgcaacaaatatcagagaccaagtcatttcctccataaatatttctgtatgtatctccaaaagataaagacattaaaaaacaaacaaacaaagtactatcattattcctaaaaaagaaaaaatactttttttttttttttaagagacagggtctttctgtgttgcctaggctggagtgcagtggctattcacaggcaccatcatcacacactacagtctcaaactcctcaggctcaagggattctcctgcctcagcttccagagtagctgggactacaagtgcatgtcactgtgccctgcccaatagttttttaatagcatcgaaaatgctaccagtgtttaaattttctcaaagatttcacaaatttttctttccttctttcctctttcccttcttccctcctcccctgggccctttctttctgttttgtttgaatccgaatctacgtaaactctatacattgtgtttggtaaacttttaagtctcttctaatctagagaatgattaagtaacattagccactagcgacatgtggttatttaaatgaaattaaagactgactcagtacctcagctgcactatcacatttcatgtgctcaagagccacatgtgcctagtggctatcatgcgggactgtacagacacagaatacttccatcaccatagaaagttctgttggatagtactcctctaaaaggtttcttttccattttgtttttacaatttatttattgaagaaactctgtcatttgttctgtagattaccagagcctggattttgctgatttttcttgctttcttttaaattgattattttttattggtcctccctgagcctgaacactagcctaaaagttcacactctttcactattcttttaggggttaaccctatgtacttaaccttcagatacttcattttctacatttgtaaaacaggtttaacagtagtacctacctcacagagttgtaagagctgtttatattgaaagcatttaaaatagtgcctggcaattagtatgttctctacaagtattttctgtatttaatacattccaaaggttttgacattagtcagacaccagccacatttatttttgctttcctcttgtacaaatggtcagtctacagaatggaatacttacacggcagcgcagggaccgtttgatcagaagatgtttgtggcgaggatagagctgtgaagcacagactggctggaagtcaggctgtaacagacgctgctgaagggttgttactagaaagaaaggcagaaaacaggcttagtttacagtgactttcaaaatcagacttttatgtaccagtaattacacgaagcattactgcctttacgaacagtgttgttcataaaaatgaaaatatagaaagttgacattttagatttcaaacaattacctctattacagctgttttattttctacatattgtttttactactaacagctattccattaaaaatctcaaatcactaggtacataaataacaaaaacagaattagatgtagactagaaacaaagtagaaaaacacagaaaattaccctctgttaaatttactggtcttgtataatagtcttcaggtagaggttccacttcatccacagcctgagctggctcaatctttatctctttctgatcctctccttctttaaggctgaaaaattaaaaaaacaaaacaaaacaaaacaaaagagtaatttctcacggatccacctgattatcctcagtctatgatatcaataattgaagtattcctctgtcatagaatatctgtatagcgtaggtcttttctaagtatgagaatcttcttttccattgacaactgtgtgtgtgtgtgtgttttaatctcatttatttgatattcattttgatacctgctgttctcctcaaagtcatttcatgtctaaacttacgaaagtccggcaagggtactgatggatgcaccagctcgtggtcgctgaagcctggttccaagaccatatttgtcctaaacaaagttcagaaattcctattagaaagtccacttttacacaccctatttatcaaaagaaagaattttgggtaggatagcatgagaagctcagggaaataagcaaaaaaaaagctaatctaaaggcttcttttaaagaaagcaatttgtagccccacatcattattctattcttaaaataataacagcactaaacatggagattgaaactatattaatacagtaaaaatgaaccaaatgtgagcttctgctagtaatctaaaagtatctaagctacggctcaggcaagaactatgtggagtgtctaagatacacaacagacgtcttcctggaacaccagtggtcatctgctaacttcttcagggtcagcaagaatcataaaggagaacttaccactacatgaatagtatgttgctgtagagccccaaaatagcagcaggttgcaacagagacaaaaaatgcagcataagatagaagcaaacgcatatagcaggcaggttatatgggaaaattggaagaataattcatttaattcaaattctacctctaaatataacacacattggtgcatatgctgactataccactggactattcagaaaaattcacttctttttgcaaatgtaggtgctttgcaagtgttaatgtttttaaattctaatctagattttttttgagacagagtctcactccgtcacccaggctggagtgcagtggcgctatcttggctcactgcaacctccgcctcctgggttcaagcgattctcatgcctcagcctcccaagtagctgagattataggcgtgcgccaccatgcccagctaattttttgtatttttagtagagacagggtttcgccatgttggccagactggtcttgaaatcctgacctcaagtgatccccccgcctcagcctcccaaagtgctgggattacaggcgtgagccactgcacccagcttaatctaggtatttttatatggactttaccaacccttagggtttcaatgacttaactaattttcatgtggatgcagtatgacaagttgcttaactaggtcccatttcctcaagcgtaaaatggggatatgatactccacaggatttttgtgaggattaagtaaagtaatacatgtaaagtgtttatttagcacagagcttgacacatcattgccattcaataaatgttatttattgaatgtcaatttgctgggccccaagcaagcacacagaaaacaaactgtactatgagagcaaataaaactcggggtaaaataacaaaaattccaaatcctaatttctttcttcttactagcagtacgtaaactggtagagaatgactctcataaataattcttatcaaaaattctacttgcatatattactatttaaccacacaagtgcactatgtaaaaagtcagtgtttttcatcttggagaaacaggggaggatgttaaaaaaattataactaaagctgagaaaccactactgccaggatgtcaaaggtgggctacaggggtaatatgactgaaatctaccatttgcccacctccttcttctcagactttctgtaatacacaaaagctgtacgtggaactctgcagtgcctacaaaattaacagcctttctggggaaataatcagaagataaaggggagtgatggagaaagaaacacaaatgtcctcaaaacacaaataactcaaacagaactaatgatatagcaaaagcctaactattggacttaaacgtctataatttgaagaatccctctctctgatatccaccattcaggaatctaggacaatggccattttctgaaatgatcactgttcttaggccttagaggtcttgcaaatcattttagtaccaaattctcaccgaaaaagccagaggcatatagtttctacgtcgtgccagtttcttgcgatctcgctcaaccttctctttctgagcaagctgctggtaatattcaatcaatttgttcatctgtaagaaaatcacagactcagtacacaaaaaagctaacagaaaacatatcaaattaatcaactacactgactagacacataatgaatagagaagacaaattattaagatgggcaagtttgccctttttcttctaagataatttttcttcgttatgtgatctgttttccgaagtgaaatggaaaactgaagttcaaggatgggaagaaatgggcaatgaagaggcttggaaattttttgctctctaacttcattacttatttcccctcacaactgctcttattttttttctgcatggccacaggaccacttatttctaagaacatagcattttatactgtattttattccccaactccatcacactttttaatttttaaaatacattttaattataaaagcaatacatattaatcataaaaagttcaaaccaggatgggcacagtggctcacgcctacaattccagcactttgggaggctgaagtgggtagatcacttggggccaggagttcaaaaccagcctggacaacagagtgagaccttgtctctataaaaaaatgcaaaaattagctgggcatggtggtgtatgcctatagtcccagctactcaagaggatgaggtggcaaaaaaaaaatggcagataggaggcaggactaacttgcagcttcccctcagacagacagaacaacatgtggagactcacactgtgaatttttattccaagaactactgcaggaacatactaggaaaactgaaagaattcacagaccctttaaaagaagtggcttgctgctgcaaaatccatgagacagcagaaaatctgtgagtgcccatgtgtaagagggggaaaatccaccttcaaacacacatcctcactggagaacctaaaaatccagatcatgggagaaaaatttaaccttacctagtgctgaaacaaaatttagagagccgagtgaaatataaaaatagaagaagcaacagcgggaagagccctgtaggcactcccggttcccagtgaagcccagggaagtcatttctgactttaatctcacaggggtccttggggagtgctgccagtggaactgaggaaggaccacttggagacagaaacttccaggtgaactttgtaataactttgacggagagcaaattttcctgggcacaatcaagatggggaaggcgtaaaggggaagtacagatatgagcacataagccacagcagtcgggaaggggcggagtccaaaaggctagcttgctttttcagcaagtaggcttgtagcctgggccaaaatcttggccctgcaaaccccatgctgttggtggggcatggtgggagtgagactggccttgctggctgcatgggagctgggtgaagcctgtcactgctggctttcccctacttccctggccaccagtatgacacagcagaggcagccataatccccctgggaacataactccattggcctgagaaccacacaactgtccttcacagcagctgcagcaaaccctgcccaaggagattctgagctcagatatgcccccacctgatggtctttctctacctgccctggtagcccaagacaaaagactgtaaactcttgggagctttatggccccactgatcacctgggaaacccaaatacttatccaggcaaccttagggcaagcttgtatccccaccacactactgcagctgatgctttcttgaaagcgccacctcctggctggaggccaaccaactcattatagcaactcataaaagaacaaccctgccctcaaaaggagaaaacaacagctaattccaccacctgtgacatcctggctaaccagaggtcctgagtctgtccacgtgacaattcactgctagcacaaccagcattaaagaaaactagcatacgaaaccaaactacaaccaaggaccctcacagagtccacttcactctcctgctatctccaccagagcaggtgctggtatccacaactgagagacctgaagacggactgcatcactggactctttgcagacactccccagtaccagctcggagactgatagctctggccgggtggctagacccagagcagcaataacaataattgcagtccagctctcaggaagccacagggggagagcaccacatcaaggaacaatgtcgtaggacaaaataatctgaacagtagccctcaagccccagatctttcctctgacatagtctacccaaatgagaaggaaccagaaaaacaattctggtaatatgacaaagcaaggttctttaacaccccaaaaagattacactagttcaccagcaatggatccaaaccaagaagaaaactctgaattgtcagaaaaaaaatttagaaggccaactattaagctactcaaaaagctactcaaaggggcaccagagaaaggtgaaaaccaacttaagggaattaaaaaaaaaaaaaaaaatacaggttatggacaaaaaaaatctccagagaaagacagcataaataataaacaatcacaatttttgaaatgacagacacacttagacaaggcttttgaattaacccaatctgacaaatacaaagaaaaaagaataataacaataataataaaaaataaagcctctaagaagtctgggattatattaagctaccaaaactaagaattggtgttcccaaggaagaagagaaatctaaaggtttggaaaacttacttgaggaaagaatagaagaaaacttccctggccttgctagagatctagacatccaaatacaagaagctcaaagaacacctgagaaattcatcgcaaaaagatcaccacctaggcacacagtcatcaggttatctaaagtcaagacaaaggaaagaatcttaagagttatgaggcaaaaacatcagataacctataaaggaaaacctatcaggttaacagcagatttcttggcgaaaccctacaagctagaagggactggggtcctatctttagcctccttaaacaaaacaattatcaaccaagaattctgtatccagcgaaactaagctttgtaaatgaatgaaggataaagtctttttcagacacacaaatgctgagagaatttgtcagtaccaagccagcactacaagaggtgctcaaaggagttctaaatcctgaaacaaaaccttgaaacacaccaaaatataacctccttaaagcataagtctcacagggcctataaaacaataacacaatgaaaaaaaaaatctaagtattcaggcaacaactagcacaatgaatagaatagtacctcacatctcaatactaatgttaaatgtaaatggcctaaatgctccacttaaaaaatacagaattacagaatggataacaatttaccaaccaagtatctgccgtcttcaagagactcacctaacacctaaggactcacataaacttatggtaaaggggtaaaaaaagatattccatgcaaatggacaccaaaagtgagcaggagtagctattcttatatcagacaaaacagactttaaagcaacaacagttaaaaaagacaaagtgggacattatataatgataaaaggactagtccaacaggaaatatcacaatcctaaatatatatgcacctaacactggagctccaaaatttataaaacaattactactacgcctaagaaatgagatacaaagcaacacaaaaatagtgggggacttcaacgctccaccaacagcactagacaggtcatcaagatagatggtcaacaaagaaacaatggacttacactataccctagaacaaatggacttaacagatatttacagatcattctacccaacaactgcagaagatacattctattcattagcacatagaatattctctaagatagaacatacgagaggccacaaaacacgtctcaatacatttaagaaaactgaaattatatgaagtactcgctcagacagcagtggaataaaatggaaaatcacctccaaaaggaactcttgaaacgatgcaaattgcatggaaattaaataatctccttctgaatgatcactgggtcaacaatgaaatcaggatggaaatttaaaaactctctgatctgcatgataatagtgagacacaacctatcaaaagctctgggatacagcaaaagcagtgctaagaagaaagttcatagcattaaatacctacatcaaaaagtctaaaagagtacaggagacaatctagggtcataccttaaagaaccagagaaacaagaacaaaccaaacccaaacctagcagaagaaaagaaataacaaagatgagagcagaactaaatgaaactgaaacaaaagagacaataaaaaagataaatgaaacgaaaagctggctctttgaaaagataaaccaaattgatagaatgtgagattaaccaagaaaagatgagagaagatccaaataagctcaattagaaatgaaatgggagatattacaactgataccacagaaacagaaaagatcattcagggctaccatgaacacctttatgcacacaaactggaaaacctagaggagatggataaattcctggaaatatacaaccctcctagattaaaccaggaagaaataggaactctgaacagaccagtaacaagcagtgagattgaaatggtaattaaaaaaaactgtccacaaaaaaaaagcctaggaccagatggattcacagctgatttctatcagacattcaaagaataatttttatgaatcctactgaaactattccaaaagataaagagggaatcctccctaaatcattctatgaatccagcatcgcccttataccgaaaccaggaagggacacaacaaaacaagaaaactacagacagatatccctgatgaacatggatgcaaaaatccttaacgaaatactagttaactggatccaacagcatatcataaagataatacaccatgatcaagtgggtttaataccagggatgcagggatggtttgaaatacccaagtcaataaatgtaatacaccacataaacagaattaaaaacaaaaatcacaggatcatctcaatagacagagaaatagcatttgacaaaatccagcatcctttatgagcaaaaccctcagcaaaatcagcatagaaggaacatgccttaagtaaaagccatctacgacaaacacagagccaacattatactgaacagggaaaagttgaaaacattccagctgagaactggaacaagacaaggatgcccacttttaccacttctattcaacacagtactggaagtcttagccagagcaatcagacaaggaaagaaataaagggcatccaaatcagtaaagaggaagtcaaactgttgctgtttgccaatgatatgatcgtatgcctagaaaaccctagagacttatccaaaaagctcctagatctgatcaatgaattcaataaaaggttgggcacagtggctcatgcctgtaacccgaacactttgggaggccgaggtggacagatcacttgaggtcaggagctcgagaccagcctggccaacatggtaaaaccccatctgcactaaaaatatgcgtggtagcgggcgcctgtaatcccagctactcaggaggctgaggtaagagaatcgctggaacttgagaggcagaagttgcagtgagctgagtttgcaccattgcactccagtctggctgacagagagagatttcatctcaaaaaaaaaaaaaaaagttttgaattcagtaaagtttcaggatatgaaatcaatgtacagaaatcagtagcactgctatacaccaacagtgaccaagctgagaataaaatcaagaactcaaccctgtttacaacagccgcaaaaaccccacccaaaaaacaaaaacaaaatgcttaggaatatacctagccaaggaggtgaaagacctctacaagaaaaactacaaaacactgttgaaagaaatcacagataacacaaacaaatggaaacatatcccatgctcatggctgggtagaataaatactgtgaaaatgaccatactgccaaagcaatctgcaaattcaatgcaattcccaccaaaataccatcatcattcttcacagaactagtaaaaacaatcctaaaattcacatggaaccaaaaaagagcctacatagccaaagcaagactaagcaaaaagaacaactctggaggcatcacattacttgacttcaaactatatataagactatagtcaccaacgcagcataatactggtataaaaataggcacacagatcaatgaaacagaatagagaacccagaaataaaccaaatacttatagccaactgatctttgacaaagcaaacaaaaacataaactggggaaaggacatcctattcaataaatggtgctgggataattggcaacctaaatgtagaagaatgaaactggatcctcatctctcaccttatacaaaaatcaactcaagatgtatcaaagacttaaatctaagacctgaaaccataaaaattctagaagataacatgagaaaaatccttctagacattggcttaggcaaagacttcattaccaagaacccaaaagcaaatgcaacaaaaacaaaaataaatggaacttaaactaaaaagcttctgcacagcaaatgaaataatcagcagactaaaaagacagcccatagagtgggagaaaatctttgcaaactatgcatccaacaaaggactaatatctcaagtctacaagacactcaaacaaatcagcaagaaaaaaaacaaataatcccattaaaaagtaggcagaggacatgaatagacatttctcaaagatacacaaatggccaacaaacatatttaaaaaaatggtcaacatcactaatgatcaaggaaatgaagatctaaaccactcctgcaagaatggccttaattaaaaaaaaaaaagtaatagatgctggcatggatctggtgaaaaggggacacttttacactgttggtgagaatgtaaactagtacaccactatggaaaacagtatggagattccttaaagaactaaaagtagatctaccgtttgatccaataatcctactactgggtatctactcaagaggaaaagaagtcattacatgaaaaagacacttgcctgcacgtttatagcagcacaattcacagccgcaaaaataggaaaccggtccaaatgcccatcaatcaatgagtggataaagaatatgtggtatgtatacaccatggaatactactcagccataaaaactagtgaaataatagcatttgcagcaacctggatagtgttggagaccattattctaagtgaagtaactcaggaatggaaaaccaaacatcatacattctcactcataagagggagctaagctatgaggatgcaaaggcataagaatgatacaatggactttgcggactcagggggaaagctgggaagggggtgaggataaaatactacacattaggtacagtgtacactgctcaggtgataggtacaccaaaatctcagaaatcaccactgaataatttatccatgtaagcaaacaccaggtgttccccaaaaacctatttttttttcttttaaatggctgaggtgggaggattgcttaagcctgggaggttgaggctgcagtgagctgtgatcatgcaactgcatgccagcctgggtgacagagtgagatcctgtctcaaaaaaaaaaaaaaaaaaaaagttcaaacactatacacatgaaaagaataaaaagcaaaacttctcttttatcccttctgcccaagttgacttttctactcattagaggtatcaactattactggtttagatatctttcttactcagagaaacaaatatattatattttgcatatattttaaaatacttgtgtgtagatgtatagctttgatgtgtataaaaatacatacttattcctggcctcaagcaatcctcctgccttagcttcctgagtaatggggattacaggcatgagccactgcgtttgtctctaccgcattctttttctttttttgagacacagccttgctctattgcctaggatggagcgtggtggtatgatcatagctcaatgcagactcgaaaacctaggctaaagcaatcctcccacctcagcctcctgagttgctgggactataggcatgcgccaccacactcagctgaatttttaatttttttgtagagatggggtttcactgtattgcccaggctggtcttgaacttctgggctcaagcaatcctcctgcctcagcctcccaaagtattgggattacaggcatgagccaccacacctggctgtttatgatatttctaagagtatctgagaacaaatggaaccttaactcactggtgggttgtgtgaagaaaaaacaaaaacttggttccttttcctgatgcacaattcaaatacagaactaaagctacacctaggattctccattatcttaagtcatttggaaaaaagtgacagtgtatttcaatgtcttacaatgagaagcactgtctatgtgcaaagacgtattatggacttataaacacagctcatatctacccataaaatgcaagatcttcagtcttttactcaattttttccgatttcatcctctctctcttatgaccctttacttacccgttgtgtgtgaggattttcaggttcctgccaaccgccactagctacaaaataaaagaatattaaacaagactttcataatgtgataattttattttcataaaacaagtcttctgtaggccataaaaagaaacttaaaacataagttatatagaccattctggtctatataactatagactataatgttcagaacaaaattttaagaaaacatctaatgatggtgataacaatcaccaatgcacagccactgtgccaggcacttgaaatgtattacatttccttttattctcataacaaccctctgaggtaaggactcttattagtctcattttatatatgaggaaactgaggctcagagatgttaaataacttgctcaaagtcacacggagagtaagtggtaaagccaggattcaaactcagtctgactccggagactttgctcttatctgtaacactgtgcattttctaagttctatgaccttggcttagagaagaatttcttacgtaagaagcacacagcataaatcacaaaggaaaagattattcaagaaaactgaaagtactgaaagtaaaactataatgaacacttttaacaaatggtgctgcaacaatggaatatccacacatcaaaaacaaaacaaaaacctcaaaaaccaaaaaccaaaaggacccttacttcaacaacatttacaaaatttaccttgaaaagagcaagacttaggaggagccaagatggccgaataggaacagctccggtctacagctcccagcgtgaccgacgcagaagacgggtgatttctgcatttccatctgaggtactgggttcatctcactagggagtgccagacagtgggtgcaggacagtgggtgcagcgcaccgtgcgccagccgaagcagggcaaggcattgcctcacttgggaagcgcaagggatcagggagttccctttcctggtcaaggaaaggggtgacagacggcacctggaaaatcgggccactcccacccgaatactgcgcttttccaacaggcttaggaaacggcgcaccaggagattatatcctgcacctggctcggagggtcctacgcccacggagtctcactgattgctagcacagcagtctgagataaaactgcaaggtggcagtgaggctgggggaggggcgcctgccattgcccaggcttgcttaggtaaaaaaaagcagccacagctcaaggaggcctgcctgcctctgtaggctccacctctcggggcagggcacagacaaacaaaaagacagcagtaacctctgcagacttaaatgtccctgtctgacagctttgagcagagcagtggttctcccagcacgcagctggagatctgagaacgggcagactgcctcctcaagtgggtccctgacctctgacccccgagcagcctaactgggaggcaccctccagtaggggcagactgacacctcacacggccgggtactcctctgagacaaaacttccagaggaacgatcagacagcagcattcgcgattcacgaaaatctgtggttctgcagacaccactgctgatacccaggcaaacggggactgaagtggacctctagcaaactccaacagacctgcagctgagggtcctgtctgttagaaggaaaactaacaaacagaaaggacatccacatctgtacatcaccatcatcaaagaccaaaagtagataaaatcacaaagatggggaaaaaacagagcagaaaaactggaaactctaaaaagcagagcacctctcctcctccaaaggaaagcagctcctcaccagcaacggaacaaagctggatggagaatgactttgacgagttgagagaagaaggcttcagacaatcaaactactccgagctacaggaggaaattcgaaccaaaggcaaagaagttgaaaacttcgaaaaaaatttagacgaatgtataactagaataaccaatacagagaagtgcttaaaggagctgatggagctgaaagccaaggctcgagaactacatgaagaatgcagaagcctcaggagtcgatgcgatcaactggaagaaagggtatcagtgacggaagatgaaatgaatgaaatgaagcgagaagggaagtttagagaaaaaagaataaaaagaaacgaacaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaatgccacaaagatactcctcaagaagagcaactccaagacacataattgtcagattcaccaaagttgaaatgaaagaaaaaacttaaagggcagccagagagaaaggtcaggttacccacaaagggaagcccatcagactaacagcggatctctcagcagaaactctacaagccagaagagagtgggggccaatattcaacattcttaaagacaagaattttcaacccagaatttcatatccagccaaactaagcttcataagtgaaggagaaataaaatactttacagacaagcaaatgatgagagattttgtcgccaccaggcctgccctaaaagagctcctgaaagaagcactaaacatggaaaggcacaaccggtaccagccgctgcaaaatcatgccaaaatgtaaagaccatcgagactaggaagaaactgcatcaactaacgagcaaaataaccagctaacatcatcatgacaggatcaaattcacacacaacaatattaactttaaatgttaatggactaaatgctccaattaaaagacacagactggcaaattggataaagagtcaagacccatcagtgtgctgtattcaggaaacccatctcacatgcagagacacacacaggctcaaaataaaaggatggaggaagatctaccaagcaaatggaaaacaaaaaaaggcaggggttgcaatcctagtctctgataaaacagactttaaaccaacaaggatcaaaagagacaaagaaggccattacataatggtaaagggatcaattcaacaagaagcgctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctgcaccaaccagaccttatagacatctacagaactctccaccccaaatcaacagaatatacatttttttcagcaccacaccacacccattccaaaactgaccacatagttggaagtaaagctctcctcagcaaatgtaaaataacagaaattataacaaagcgtctctcagaccacagtgcaatcaaactagaactcaggattaagaaactcactcaaaaccgttcaactacatggaaactgaacaacctgctcctgaatgactgctgggtatataacaaaatgaaggcagaaataaagatgttctttgaaaccaacgagaacaaagacacaacataccagaatctctgggacacattcaaagcagtgtgtagagggaaatttatagcactaaatgcccacaagagaaaccaggaaagatccaaaattgacaccctaacatcacaattaaaagaactagaaaagcaagagcaaacacattcaaaagctagcaaaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccgatcccacagaaatacaaactaccatcagagaatactacaaacacctctatgcaaataaactagaaaatctagaagaaatggataaattcctcgacatatatactctcccaagactaaaccagcaagaagttgaatctctgaatagaccaataacaggctctgaaattgaggcaataatagcttaccaatcaaaaaaagtccaggaccagatggaatcatagccaaattctaccagacgtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatgcagcagcacatcaaaaagcttatccaacatgatcaagtgggcttcatccctgggatgcaaggctggttcaacatacgcaaatcaataaatgtaacccagcatataaacagagccaaagacaaaaaccacatgattatctcaatagatgcagaaaaggcctttgacaaaattcaacagcccttcatgctaaaaactctcaataaattcggtattgatgggacgtatctcaaaataataacagctatctatcacaaacccacagccaatatcatactgaatgggcaaaaactggaagcaatccctttgaaaactggcacaagacagggatgccctctctcaccactcctattcaacatagtgttgggagttctggccagggcaatcaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcgggatacaaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggacctcttcgaggagaactacaaaccactgctcaaggaaataaaagaggatacaaacaaatggaagaacattccatgctcatgggtaggaagaatcaatatcaagaaaatggccatactgcccaaggtaattgatagattcaatgccatccccatcaagctaccaatgactttcttcacagaattggaaaaaactactttaaagttcatatggaactaaaaaagagcccgcattgccaagtcaatcctaagccaaaagaacaaagctggaggcatcacactaactgacttcaaactatactacaaggctacagtaaccaaaacagcatggtactggtaccaaaacagagatgtagatcaatggaacagaacagagccctcagaaataatgccgcatatctacaactatctgatctttgacgaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaagatccagaatctacaatgaactcaaacaaatttacaagaaaaaaacaacctcatcaaaaagtgggcaaaggatatcaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaatactatttgacccagccatcccattactgggtatatacccaaagaactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccacaaaaaatgatgagttcatgtcctttgtagggacatggatgatattggaaatcatcattctcagtaaactatcacaaggacaaaaaaccaaacaccgcatgttctcactcatagatgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataagaaaaaaaaagaaaaaaagaaaagagcaagacttaaatgtaagtgttaaaactacagcacttctagaagaaaacatgggtagatcttagtgacactgggttaggctaaagtttttttaataggacacaaaaaacacaaactataaaataaaaaaattggtaaattagacttcactgaaattagaaacttgagttcttcaacacacactgctgagaaaaggaaaaggcaaggcacagactgggagtaaatatttgcaaaacatatattcaacaatggacttgtatccagaatatagaactcttataactcagtttaaaaaaccaaatcaaaacaaaccaacaacaacaaaacccagttaaaaagtagggaaaagatttgtacagacagttcaccaaagatatatggctggtaaacaaacacaatgagaaaatgcaaattaaaaccacagtgaagtactgctgtacatgtgctagaatggctaaaatgggtaagactgacaatatggcaagggttgtcaagggattggaactctcctaatttgctggggaggatccaaaattgttcagtcactttggaaaacagttgggcattggccaggtgcagtggttcatgcttttaatcccagcactttgggaggctgaggcaggagaactgctagagtccaggagttggagaccagcctgggtaacatggagaaaccccatctctactttaaaaaataaaaaaaaataaaaatagtttggcagcttctagacaaattaaacatacacttatcctatgacctaataatttcactctttggcacttaagaaaaatgaaaacatatattcacacaaagagttataggcaaatgttcatagcacctttattcacataagccaaaacccaaaaacaatccaaatgttcaagtggagaatgaataaacaaacatgttcatacaacagaatactactcaacaataagaagaaataatataaagaagaaacacagatgaacctcaatagcattatgctaaataaaagaagacagacaggaaagactgtaatgtaagactccaattacatacacttctagaaaaggcaaaattctagtgatagaaagcatatcagtctagtcaggggccgggaggttgggggaagaaactgactgcaatggggcatgaggattctctagggggacagaaatgttgtgtatcatgattatggtggtggctatgtgattacacacttgtcaaacatcacagaattctacacttaaaattggtaagctttattatatataaattatatattggtaaagctagccaaataaagggaaaaataaaagtataatgagataccatttcacaaccatcagtctggaaaaattttagagtccaaaagtactaagagctgacaaggaactggagctacaggtagtttactcttacatattactactaggagcaaagactgctaaatcattttggagtgctaaggatgtacacaacttatgactggcaattttacttctagttatatagaaaagtccttacacttgtgccttaggaaacacatacaagattgcttccagcagctatattttttcaaaagcaaagaaaatgaaaacaacctaaatgttcattaagagaagacggaataagtaaactgtggtgagtcatacaggaatcaactgtgtatcagaaacataatgctgatagagtaaagttgtagcaggatatatacagtatgttttcatttgcttaaaagtgaaaaatgttatttgtttgtggctgcatacatatgtggagaagtataaagacatgtatggatgctaataaacactgaattcaggattgtgattattatctctagcgggcagagaggaagataaagtagggggagggcttaaactgttttggctgtttcatttcttaaactgggtgataagtacatgaatatacatatttcatataaaatcacttttttcaaaacaaaaaggacgcaattaccttgctgaaggtgacattgtatcctcttgcaagaaatggcagaaataacactttagtataatattattttagaagttgcctcacttaaggcaatcatgaaaaataattatgtgaaagaaatgtttcagctgtaatatttttaaacgtctgaatattttatctaattgcttcttttgaactggtaatttattctaagtagcaatttgggagacataataatctcattgtaagtttttctccgtacattacagacaagtacttataaataaacaaatagttctaacttaagtggtttcagggcttctgagataccaatgacatcaaggaggaaatgaaattatctgtacgctttaagagctcctggtattcaattatccctgttgagataccctagaggagatacagttctagaagccagcataagtttatagttctgaaatataaattctccaatcttcatgactcataaaccaaaaagcataaaacactcactaacagagtaacaaactgagaaatctacttggatttccgggctgtttcttttacttgataaaaagacacaaaatacaaacatgaaaaaacaatactttagttcactgaggcctacattatgccactttgaggttgctttttaacatttaacttactttctttaacttatctcctatactgacactaaaacatatacacataaatacttactggcaattttcaaagatgttacagaatctttctattttcagtcacacttcaggtaaatagctacccaccaatgagcatttttaaggaactaagatatacttatttaactttctgtttttgaaaagagtatgtattttatcaactcaatgtacaaagtcagaaaaaccatcaacagctcaaagcattctaaaccaaagagcaaattcaatagaatcaaggattaaatttttaagaacatagttgaatctaaagaacttcacccatatttacttccaaattgtgtaagaatctatagaaaggttttagccagtctgcttcattttagttatgtcaaatgacatataatgaatttgttatgagcttcctcatttattagtcaataagctgtactttttatgaaaatcccaaaatgagaatttttacaagtttaaaatgtttttagaaaattaaacaatgaaacctcagaaaaaaaaatacggagttagtgatgctactacttatataaagcataaatagcaactcaagattttattaattttttttaaactttggatcacttaaatcaaaagcaactcaagattttgaactgactgtacagagaatgtttccactctatgatgttaaccatgaaatacagaatttgcaaaaataaagtttcgtgataaaattaagtgtaatctgttctaaaacactcaaacactcaaatgatggaggtatataatgccttaggtggtcttaaatccaaacataccaatttttctctttcactgataaacattttatatatatacgtaaaagtttttgagcacatgtttgaatgctccaggacagacatttggacattgaattactgggcagaaggatataagcaatttaaaattttaataaatgttttaaaattggtctccaagatagactaccatagtgtatgagagaactattctcctatgttctagccaacacttgatacaaccagattaaacatgttgtaccaaatagaaggaagctttaatttgcatttacatgactactagggaagtcgaatacatctttttgcatattcattgaccatttttatttctactatgagaattgctgctcatatcctttgcctgtttttctactaagtctttttcttattgacttataagcgttcctcatttctgagtattcatctttagcctgttatataagacccaactatttttcttagtttgtcatttttatctttaaagattttttttttttttgagacagagtcttgctctgtcacccaggctggagtgcagaggcccgatctcggctcaccgcaagctctgcctcccaggttcacgccattctcctgcctcagcctcccgagtagctgggactacaggtgcccccaccacgcccagctaatttttgtattttttagtagagacggggtttcactgtgttagccaggatggtctcgatctcctgaccttgtgatctgcccgcctcaacctcccaaagtgctgggattacaggcgtgagccaccgtgcccggccttatcttttagttttatccatgatgtcttaacatgaatgtttatttttcatgaagagcattaatattttgattccaagaaagtaccagatttataaaagctattttatcaagtctaagaaaactaaatattatcccatctcagataaaacactaaggtctacaaatgtgaacatatgggaacacagaagagttaatgacaaaatattctgaatttagctcctatcgccccaacgggttacagaaataataatctatgggcaattatagcactgtcaattgtacaaaatttcatattgaagtccatctcactcacctacagatttgtctgccatgcccacatctctagacgtccagcgacaaaatccacatgccaggtaataggctttcttcatggtggtcttggctgggtcatctggaagctgtgtggagatgctcgtggcccgagtagagagggtgtgcatgcagccaggacagtcaaaacaattggcacatctgtgacatgacaaacacaaccattcattcaacaaatatttatcaaggaattcaagagagaacaaatataaggacaagtgtctctcaagaaaaaacagtaacattctgcaggcctcttaccaactttgctttaacagttcaagagtactatatgttcattagtttaaaaaatatgcagttatcgccaaagtaagaattagagcccaacccaatcctactccacagagagaaccattgttaacagatggagtttatgattccagactctttttatgcttatattgatcacaaagatttctgaggaagagaactgtcacagcttatgcctttagagaggacagaccaactgtgccatagaaaacttagagtcaacaatacaagaagctgtgaaactggatttggaaaataaccgactgctgtgccagagagcttcaacagaaagcaaacaatgctatcaaactggaatggttcagaagcagcatattttcagggctttctgttctctccttaaatgctacttttcctagtgctcagccaacatttctcctttaggaggtccctatgtcttcttgcttttaactctcccaccagcacagattatcaagatttcacctgcagtcctgtacctgcttgaagttctgttctataatataacttgcattatctgttatagtctgccatctggatactatcaaaagaagataataatagtactcaccttacaaggaagctttgaggattaaatgataaaaattaatttgtggaaagtatacaaaacagtatctggttatcaggggttacttctcagggcaggaaagacaaataatagtggttcacatccataaaggtatgggggtatgactaacagcaaaaggactttcacttcaagctaaaaactaaacaccatccagtagcaatgagcaagcctagcagccatatcttggtttctaagactattctccaataaagtgaaccaaggctccttggagaaacaactctaagactgagacagaaaatatacaagatgaggctgggcacagcagctcacgcttgtaatcccagcactttgggccaaggcaggtgaagtgcttgagccaggagttcaagaccagcctgggcaacatggcaaaagcctatctctccaaaaaaatacaaaaattatccaggtgtggtagcatgtgcctagtctcagctactcaggaggctgaggtggaaggactgcttgagcctgggaggttgaggttgcagtgagccaagattgcaccactgcacttcaacctaggcgccaaagtgagaccctgtctcaaaaaaaaaaaaatacacacaaaacatacacacaagatgagtctggagtatcttgtagtactggtaagaaaatgatcaaagtaatgaacagagaactctctcctgctcctaatgatgggggtatgtcaaagggatctaggagtcaactgaaagagctcccaatggccaaagctgaaataatttgagcaaaataaataaagtagtattggattacaagccaaaatataaaatgaatattcataatcccactgtcctataagtaagtgatttaaaaaacaaataaacaagaggagaagagacagatcttccatgcaaaagaattccaaatccaaataatttatgcagatagtcctcaaggacaggggagcataattctctagtctttatgggctgtgacagtaattttccttccaaaaagtagagtacaaaaaaagaaggaaaagcagtaactttacagtggagaaacctgacaaacactagctcaagccagataatcaaggttaacaccaacagtgacaagtcataagtatttacccttgatatgatgtaatcaaagatggcactttacctctgtggttctcctccgcaaaatacattcccctagtctgatgagaaaaaaacatcatgcaaatcctaatgaaatgacattctataaaatacctcaccagtactcctcaatacttttgaggtcatcaaaaccaaggaaattttaagattctcctatcacaccacacccaagaggagtctagagacataactataaatataatgtgatatcctgaaaagaatcctggaaaaaaaggagaccacagaaaaactaaggaaatctgaataaaatgtagtgtattggttcattaattgtaacaaatataccacactaatgtaaaaagttaacaataggggagactggatgtgaggtaaatgggaactctccatactatcttcaccataattctgaagtacaaaactgttctaaagtagaaaatctatttcaaaaatcaaaggggatttcatctttggcaatggtgatgcttaaaaatgaaaaagagctggttaaaaaagttaatttcatgtgtcttttttttttttttttttttgagacaaagacttgctctgttgcccaggctggagtgcagtggcacaatcttggctcactgcaatgtctgcctcccaggttcaagcaattcatctgcctcagcctcccaagtagctgggactacaggcgcgtgccaccacacctagctaattttttgtatttttagtagagatggggtttcgccatgttagccaggatggtatcaacctcttgacctcgtgatccctgcctccgcctcccaaagtgctgggattacaggcgtgagccaccatgcctggcccatgtgtctttttaactagctattttagagaacagtcaaggaaaataggaagaaaaaaaaaatcagtccaggtcttacctattcttttttagtttggcttcagccgatggcatattttctaaacaactgggacaataatgggagtccacctaggaggaaacaagaaagaaaaaaaaaaccagaggagaactcagtttaacttgtgtatatgtcttgtcaaatagtgaattttaaaatatgttatactgtagcagaaagtagactgttttctgcttagggtttattcttcttcagtcacctgttttttttttttcttcttcttccggatttaaaaaatccttctatttttctgatctttcctattccatcatcagggttttatgtgttaaaagttgtttatttaacaatctacaatttccagttgaactccatagaattctatgattaataaagagattaataaaataatccaatttgtaacattgtgataaaatatcctcctgtctaggctagctttatatgactataaaacttgaccatacttttaggttttgaaggacatttttttaaagatttctcattattgaagtaatacaggttgactgaaggcaagcataaatatttatttacatagtcagctatggccaaccaattagagatttttaaacaaattaatgggacagtcttattgtacttaaaaaactggagtctaaaatttaagttcattttattttttaaaagtctgaataattattttctttaatgtaggtcctatttgacaattatagaactctagtcacctgcaaatgaaaagacaatcactggaacataaatactatgatagaaactggcttttttcatcatctgctataaacaggtcaatttgaaaagattaataaagttgttgctcaaataatctccaggaacataaaatacaatattgctaactaacctctgcactgactcatcaaaaaaggcaaaatacaagtcattcctttttgccccctttccaaattctgcttgtccgttcatgtgcagctccagacccagattctccattagaacttcactgcctgccccagccctcagagcttcatctttccctaaactctaatggcctccatatcacaggtacacatcaggctgtaaaagatgctgtcacagactggatgtcctaattgaagagagtcttagagacagatcatggagactgagcactctattcaccacaggagaatatgatccaataaattctggaggtggagctggaatagggaatcatcaaggagatacacataaggaaagtgctaatggagatgagaagaaaaatcgatgccatatttttaatatatacgatttttcttgtattatttaattgcttttcttgactattcctattatgaaaagtatcttcaataaaataagttattaataacacataaaatggcttatagtatgtgttttcatatgcatttattttaacagtcccgggatcttcagtaaaaaacactctgagttaggctgtttagattcaaatccaggtcctccttcccacccccaaattactggctgtgtgacttacagcgaacactctgtatctgtttctttacctgtaaaaaaaattttttaaaaaaagtatccacttaaattggtttgaagattacataaagcacatgacatatagcaagtatcgaataagcagcaactattactactatcagctttttcttcactaagactatggcttattaaacagcgcattttatgtcttactcgccttttaatccctaaagcttactgaataaacaagatgtgccaagcgctgcagaagttttggggttttgttatttggtgactttttactggccggggtcttctttttgaaaaatccaacttcggacgcccacttgtgccagggaaggacagcattgtcctctagctccataaatacactttcagcttcttacatgacatactgtattctgagcgcttttcacataactcacgccgccccaacctcttcccggctgcaggccttggcctgagtcaggaacagggcaaggcagtctgacgagggcccagtttctggacaaaagaggaacagaactttcaggatgggagaactatgaatgagaacgcctgcgcctccctccatcctcgcaataaatcctggaaaggcagt

SEQ ID NO: 633 - DNA, 50350 bp, Homo sapiens; identical to SEQ ID NO: 631

SEQ ID NO: 634 - DNA, 665471 bp, Homo sapiens
tttattttttttaattttatactaagcttttggctatgtcctttcaaagaggtctcccttatctcaagtagtatttattctccacacctaatccagcttcttatcatcatttcaccttattttttaataactctcacagtctgaagttatatttatcatgtagttgtttatttattcggtcctctattataggaatgtaagtaacttgaaggaaattacactgttggtcttgttcatgtgtctactcccagtgccaaaagcagttcctagcatgtttttgaaatgcaataaaatattcactatgcaaatgaaaactgatttttttttgagaggggcagtgtctgccttaaataatacctcattctggaaaacacaattaattatggtagaaactggagagaaatttttttcttatggagaagaaagccctcaaatccccaaatggaggcatagaaaagctgagaaataagttcacatataagcttaggtctgcatttcttgcaaataatattctaataatgtgctctgaaataaacaaaaaagtttcagataaacttttattaatattttgtttagctccatagtttataattgatctatggtttataattgatctatttaaaagatctatttatacttaggctaacacaaacattcaagagctaaatcattgccaagggtatataatgtctacaacctaaatgtagtggctctgacacacacataacaacaacaacaaaaagactatttgctgataggttgaaaagaaataaagaaaaaaatcagttattgtggttatttagtcaaagaggaaagcaaaactgagattgacatagcatatcaactactctgtactcactgtgcatggggtctgcatccatggctccccatcaatttgcattggcagagacttgctcgtcctgggggaaaatatttcattgtaagtattgcaaggaaatactttatattacagactatatgtgagatataagatgatgagaccagggaaggcaatatggtaatagttgggctctaaatttatctccaatgaaaggagcttcaactctccactattaataaataccctgaaaagtaccttagtcacaggaatattatgagcttcctggtaagtgtagtgacatttaaaaaaattctggatgccaaaagaaaaatttcagggtttatgtttaatgacacgatcagaatttctacagccaaaagagattccttgtttttataaccctacattgcaaactgggagaaaggtgtttctcccagttcttctagcaccaacacttccagataaataacatcaattattcctgtgctacaatccgtggcttcacctgggcagatcacgaggtcagtagtttgaaaccagcctgaccaacatggtgaaaccccatctgtactaaaaatacaaaaattagccaggatgtgttggcgggtgcctgtaatcccagatactcgggaggatgaggcagaagaatccttgaaactggaaggtggggttgcagtgagccaagatcgtgccactgcactccagcctgggcaacaagagtgaaactccgtctcaaaaaaaaaaaaaaaaaaaaaaaaaattggggggaaattttgggcaaaaaaaatgcttgaaaaagttaaaatttaaaacatatataaaatcttactgtggcactttagtccatgaaatgatttaagtcaatggtgtctcatcattgttttcatagataatttgcccagtaaatactttggtgcttcagtagactaatatgagtataaatcataaaatttgtatgtttgaattcgtgcatcaatatgtccatggtagtcaacaagagagaatcagattccaacaaaccatatcagtaatagctaaccaatattttagacaatctgccaatgtccattattttgaaatatattagtattaataactgattatttggagcccaaagaagacaatgttactatcagagttctgcatacttttaattagtttgaggctatgccatatcaaacgcctttgtcagttacagaaagggaactacctgatgaccacgcaggagcactgagccagccgccggccagcacttttcaggcctgtgtatatttgccccatctccatggctccttccaagccgaccacctccagcagctggtcactgagatctgaaagaaagtagatgccttttaagttgcaatgtgtatacatatgtccacaatttaatgccatttgatattatggagattaaaaaaaataacagccacttcacaaagaaagcttgtcttagaaacttaaagtaataaaaagatggcctacttttataactctcagtttaactaaaccttgaggttctgtggaaaatgatttgctgtcagcttattctaaaacaaaatgggaagcacagattctgagccaaataataccaaaaaaaaaaaaaaaaaacccagtagtttttaacatcaacaaacttaatgttattccacatgtatataaggaccatttatacatcccacatcagacatttggcagcaaatacacatttcaacactataaataaaatatgaggatatgctgtcaaacatgattttgttaaattacttgaacaagagaccttggagatcatggagttggagcttctcattttatacattagaagatgggagtccctaaatctttgagtaacttgtctgtagtaataggtaactgtacagaagttcaagaaacaatagtaattttgtgaaatgtttttccgatgttaaggaatattctacaaaatactgtttggtagtatactagataattagtcccatgcaatcattattattaaatttttttttagcagaagacattaaaaaggggctaatagttaagagttgtcgcttgttgagtatttactaggactaattactttatattatctcatttgctcctgctccagaccaatttaagataaatgtgattctcctcatttacagatagagaagctaaacattggagatgttaataattattcatattcacatacctagaaagtgacagagccaaaaagtgaacctaattgctttgatgcactatgctacatttgataaatcaatcatatgaaaaggacagaatttacaacgttttagaaatcatcttaacataaaggtggaggttggactgcgtgagcttcaaggttcctttccaatctgaatatttgcattcagccagaaagcagaagttgaactcacatcaatagaatcccacacagtcctgtcccaagactcagtgacagcccatctgctcacctatttaactcagagtgctgagacccttgatttggaggccaaagtctaggtgcatatatatggttcttttccattgtaatattcttatgtgtttttgtgtattttcaaatataaatacacaattgtacattgtttagtagcagaaaaactagaggagtggaatacggtgggaggcatgattattatacaagaaagccatgtaatagttggtcatatttgaggtcggactcatagaaaaacaagcaaatgtgttttgtagggaatccactttgtacagaaagtgctcactcctcactaatgactccattttagcatagagtttagagatgctaatgatttattttcagtgtagttcaactgtgtggcagcaaatagtgctttgcaatctccaagttcgttaagcccaggatcgtaggtaaatttaataaaagcactttaaaaagaatatgcaaccaagccaccaaacttttaagtgaataataaaaatctattatttttaactttaagctgtagctgtagcaccggattactccaagtaaaaacaatattttagctacaaaatcaaatgttaacttagagcttccaccttgctgttctaaaccccatttagacttatttctcatgaaacttattctgtgtttctagtttaaattcatgttgccaagaacagatggacaaggaatggaaacatattctttcagctgtagccggcactaaaatgtgcttggctctatagcctgggtgttaatatacgcatttcttagatatatgtcaaccagaaaacgacattgtggcaagcactgaagccccagatgtgtgcctgctgatatttataaaacaacaactaccaccacgatgatcaccaccaccacaggactggagttcgcatttagtattgtagattttgcacggcctgattcctaaataggtagaattctgtgttaatttctgcaatgatctgaaactggttgatgggaaccattctataagaaatgaaacactttctcaagacagagttaatctgtgagccctaactttttcatgaatcacagggatctgtctacacccacaccatattgctactgtctaccaccctccttctgatttttttctttcttttaatttgtctttgtttttctgcatgcaaaaatgccttgaaaatcaattctgctgttaataatcagtaatgaagatatttctcatagacttagaacacccaggcttttaaactttcatgttcttgctaacacaaataattttataggaatagtgccatctttactaactctagcaaaggcaaataaataccatactccttttaattaggcattcagggagagaaaacaaaaacaaaatgaaactctaaatttgtgttgcacgaatttgcccccataacacttccacattttttgatacagcacaatctgcaatctgtctgtatacaattgatgccccctacctgttaatctttgagatcagggtcctgattgatttcagacagagagagtttctatctatgcaattttgaattctgtttctatatgtggtatcctttggaacatcagacttcctcacctcacattctagctaagagttattttaagaacagttctccttgggatggcctaaccagctagatcaacctatttaattggtttgctacctggctgctggcttcatatttaagagtgtgagcagcaaaagatggcctatggaccaaatctggcccctagccctttttgtatggctcacaacaattaagaatggttttatatatttaaaaatataaaaaaataaagtactataacatctgaaaattatataaaattcaaatttcagtgcccatcaattagtcttcattggaacacagccacattcactggtttaggtcttgtctatgtctctttttgtactacagaggcacagtagagaccatatggtcgacaaagctgaaaatatttactatgtggacctttagataagtttgcccacctatgctttagagaaacatgaacactttcaggtcactaaggttgtcactttagtactgcagctataaatgctaaatggcaatttattttttagtgcctgaaagacataatgttccagcattaattccacagtgtatgtaaccatgcatagaacagctgttctccaccagggagtctcaccacacttgtgtactatgagcattgccacaatccattggttatttatcacggaacaccaaaagtttccaaataattttattacaaaagaaagtagaacagtttaacattcattagtgtgctcaatcattgcctctggttggcttccttgagtgtgagaaaaagaagaatcatagataggaaggcagaagttgcaaccagacctggagattcaggtgggaaacagctctaccttcaaaagttaagtgtcaagaactgtgaaatcctgacaccatgatactgaaatccatttgtgtctatctagaggaagacgttgcttttgttcagtttaatgttataaagtatacttttgaaggaaaacaaagtacgtttctgaaagcatttatatgtctttttaaatacctccatgggagtaaacagagacaagctttcatattaggtattttcacatttaaaacagaacatctataaaaggtatttcagagggaagaaacttaataaaatcatcaaaattgggtcatattggatcaagattcttaacacatggtctgtgaatctgaataggaaaaatgcaactttattttcactaacatgtaattgaaattaagcatttctttcaaatataaatgtagtcaggaatacctgtgactttgtcactgataaatatcacgttatagttgttacaatatttcctactttaagaaaagataatacgttttaattatccacaataccaaaatatctacaagtctctataaaataaaataacacattaaattttattttttttatttttatcttatgtaatttttcaaaatgttatttatattcattatgtcaaattttaataattattgaacttctagattttaatttgttaataagaaagcatatatatctctaaatcaaaatttctaacagcattttaatctaatttttcatagaaaagcatatatatctctaaatcaaaattttaacagtattttaatataactgactcccttttttagcctacgtattttatcttataaattttaaaacattatgtctgagaagagtcagtagatttcaccagacaggcaaaaagactatagcacaaaaatggtaaggaaccctactttagaatggaatttgtcattttaaagtttataaatctttataaactttataaatctgtgaaaataattagtgctgcattcatctgttacacaggtaatcagggatatgaatgtaaatttgaaagtcaggggcacatatagattagaggacacacgagcagctcagctaataagtgggtaatatttattcatagcttagtcttcatttttgacagttatgccctgataatatgtctcattatgtaattgtttcagactgccatatgtgaagaaacagaagagaatgcattacaaacacagaatgaatgtgggttgtagcatttcgcagaatatagtgggtactgaagaaagggggagaaaggctggagcagagtagtataaacccctttgtgcagagtgtccagcaacattctgcaccactgtcagaggccatgtggaggtactcattgactcagcaggagcattttgaaatcaacataaattgctaattataatgacacttattgagccattatttggccatagtaagaccaggctagctatggagttgtaccttttgagtgtttgtagattgtatgccttccagtgatgtttcatttatctagcaacattatgaaacatgtctgaggaccaagaataaacttttaaaaggccaaggaacatatgaaatccattcactagagtgaataattcaatgattcgtcttcaaaatgtccatctacttctaattgattcttaatttagatatacttctcacaagcataaatgcctgtttttcctgacctacataacccagaagacataaattttaaaagggggtgggtaggaagagttttagcaaaaatttattaatataaactgtgtttcagagtacaagtatgtaaaacataaaggcaggctttttgcacctgaaggaacatacaatccaattgtaggtctattaataaaggagaaactgtatggggaaggctaatatatctactatatgcctgctatgagcaggctccctgctaagggatttataggcatttttccatttaagactctcaacagtcctttgagataggtattattctcctcattttattgacagggaaactatgtcacttgttcaagtctttacatagaattgaaaatctggttttctaaataggtatgcttgactctaaattccatgttactgtgacaacagtaagaactaaccaattaaatgttaacagttctcttggatcatcatggcggacaggaggcaggactagattgcagctccagacagagcagctcgcattgtaaattttagctcaatagattgcaagaacaaaccagcaatctcgagaggacacacagacgctctgacggaagtggactgctcctgcggagcctgggagaccccccaaatactgagtgcccaactgaggaagtggaaaagggagaccctcctctccccatcacatgcccccactagagaagctgacagtccatttgcaggagaagtttccggctttacttggagctgagtcaatttggaaagctaagccaagtacaggggtagaggaagcagcagaaaggccctgggagctcctggagtcccctaactggccgttcctgcctggcaccataccacagggatccaacgggagggtgaccagaggagcagggggtaaaactccacagggagaaggaaatctctagctaaactttgtaacaatttgaacggggtgggaagccacctggctagaactcaggagagggcgcaaatctggtgtgcaaactccacaggcaggggaagaaccaagaccttttctttcgcagttgggaggtgagttttcaggccggtctcaccttctgcctggaaactaactcgggtctgttcgtgggggcacggtgagagttagaacgggccttcagtttgcatgggagctgtgtgaggcctgtgactgtgggctttcccccacttccctgacaacctgcatgactcagcagaggcagccataatcctcctaggtatacaagtccagggacctgcaaatctcatccccatcccccatgctgcagctgcagcaagacccacccaaggagagtctgagctcagaaatgcctaaccctgccctcctcctgattgtctttccctactcaccctggtagtggaagacaaagggcatataatcttgggagttctagggcctcgcccactgccagttcctctctggaaagcaccacctcctggcaggaggtgcaaaaaaagcattggattaaatccagcgtctctttatgattaaagctctcagcaaaatcggtatgcaagggacataccttaatgtaataaaagccatctattacaaactcacagccaacataatactgaatggggagaagttgaaagcattccctctgagaactggaacaagacaaggatgcccactctcaccactactcttcaacatagtactggaagtcctagttagaacaatcagactagagaaagaagtaaagggcatccaaatcggtaaagaggaagtaaaactgtcactgtttgctgatgatataatcttttactttgaaaaccctaaggactcctccagaaagctcctagaattgataaaagaattcagtttccagatgcaggattaatgtacacaaatcagtagctcttgtacacaataatggcgaccaagtggagaatcaaataaagaactcaaccacttttacaatagctgcaaaacaaacatcttaggaatatacctaaccaaggagtcgaaagacctctacaaggaaaactgcaaaacgctattgaaaaaaatcatagatgacatgaacaaatggaaacacattccatgctcatggatgggtagaatcaatattgtgaaaatgaccatactgccaaaagcaatctacaattcaatgcaattcccatcaaaataccacaccatcattcttcacagaattagaaaaaaaaattctaaaaatcatatagaaccaaaaaagagcccacatagacaaagcaagactaagcaaaaagaacaaatctggaagcatcacattacctgattttaaactatactgtaaggccatagtcaccaaaacagaatggtactggtacaaaaacaggcacatagaccaatggaacagaatagagaacccagaaataaacccaaatactacagccaactgatctttgacaaaacaaacaaaaacataaagtgggggaaaggacaccctttttaacaaatggtgctgggataattggctagccacatctagaagaataaaactggatccttatctctcaccttatacaaaaatcaattcaagatggattaaggacttaaacctaagacctgaaactataaaaattctagaagataacattggaaaaactctcctagacattggcttaggcaaggatttcatgaccaagaacccaaaagcaaatgcaataaaaacaaagataagtagctgggacctaattaaactaaagagcttttgcatggcaaaaggaacagtcagcagagtaaacagacaacccacaaagtgggagataatcttcacaatccatacatctgacaaaggactaataaccagaatctacaagaaactcaaacaaattggtaagaaaaaatcaatcccatcaaaaagtgggctaaggacatgaatagacaatcctcaaaagaagatatacaaatggccaacaaacatatgaaaaatgctcatcattactaatgatcaggaaatgcaaatcaaaactacactgctataccaccttattcctgcaagaatgaccataatcaaaaaaataatcaaaaaacagtagatgttggtgtgtatgtggtgaatagagaacaattctacactgtgggtgggaatgtaaactagcacagccactataaaaaaacagtgtggagattccttaaagaactaaaagtagaactaccatttgatctagcagtccctctactgggtgtctacacaaaggaaaagaagtcattattcagaaaagatacttgcacatgcatgtttatagcagcacaattcacaattgcaaaattgtggaaccaacccaaatgcccatcaatcaaagagtggataaagaaactgtggtatatatattcaatgtaatactacacagacataaaaaagaatgaattaacagcatttgcagtgccctggatgagactggagactattattctaagtgaaataactcaggaatggaaaaccaaacgtcgtatgttctcatggatatgtgggagataagctatgaggaagcaaaggcataaggatgatacagtagactttggggacttggggggaagagttggagaggggcgagggataaaagactacaaatatagtgagtgtatactgctcaggtgatgggtgcaccaaaatgtcacaaataaccactaaaaaacttactcatgtaaccaaatatcacctgtatcccaataacttatggaaaaataaataaataaataaataaatgttatcagtgatggaagagaaaaaagtgctacaaaggaatacatacataacaccttaaaatagtccagcaaacagtcctaccaataaatcatttcaaatgtaatcacaaaattaaaatgaagtacaaagctcccatttataataccatgtggggtaatgtatgaagaatactctggagaagctcagtaagaaagctaagagcctggccctgctgtactcacatgcacctctgcctggcccaacatctggttcagcagcagacaaacctccctggacagatagccacaggcctgcttggcatcaccacacctgcacacacctgagcccagcctgacagccagtctgggtggtcccatttccctgcaaataccattgcaggaatgcctggcaccattgctctcatgcttggtccaacagctggtccagtgataattctgctttcctagacagattgccacagagtccaacaaccagcctagcgctcctgtcctcagcaaaactacactgctgccatcacaaacgcctgcagcctagagcactgaggcaatatatatcactgatgaggattacagctgaagaaactgcatgaagactacagtactgagtcgacctagagctaaagccaatgcaccacatttaacactaggacttgtttacaggaaaacatttatccctacaaaagctactccataatgttggaaaaaattgactacacaattagattcacagatataaatgtagggacacaagaaacataaaaaagcaaattaacatggcacccacaaaatgtctccagtaacagactcccaaaaaggacattcatataatatctgaaaaataaattcaaaattatgattttaaggaaactgagcaagatataagagaacacagagaaacaattcaataaaatcaggaaaacaattcatgatccgaatgagaaattcaacaaagatgtatataaaataaaaaaagaaccaagcggaattggagcagaaatattcaatgaatgaaatgaaaaaaatacataactgacagcttcaacaacagacaagatgaaggagaagaaagaatttatgaacttgaagacagatcttttgaaatagcccagccagaggaggggaaaagaaagtagaaataagaaaaatagagaatgaagaaagcctacaggacttatgggacaccatcaagtgaataaattttctcataataggagtgtcagagggaaagagacggagaaaagcacagaaaatttatttaacgaaataatagctgaaaaattcccaagtattggtagagttatgaacatccagattgaggaagttaaaagatccccaattggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagcctagatcccgccactgcactccagcctgggcgacaaagcgagactccgtctcaaaaaaaaaaaaaaaaaaaaaaaaaagatccccaattacattcaatccaaaaaattctctctgaggcatattataatcaaaccgtcaaaagtcaaagacaatgaaataattctaaaatctacaaaagaaaagtatcaagtctcttataagggaatctgcatcacactattagcagatttctcagcagaaaccttaaagctggtagagaatgggatgatatattcaaagtgctgaaagaaaaaaaagctgtcagttgagaatattatataaagcaaagatatttttccagaaatgaagaagaaataaaaatttttgcagataagaaaaagctaagggaattcattaccataaagttggtgttacaagaaacacttgagagtgctacaaatggaaacaaaaggaccataattactaacaggaaaacaagtgaaagtataaaactcaccgtagagtaagttaattaatcaaattcctaatatttccagtgatatgatacgtctttcaatcctctagtatgaacgtttaatgtcaaatggtcaaaaccaagaattacaattaatggcaaaggaacacaccacagataaagaagtaaattaagtgaacaaaagtataaattttagggggaaggaaaactgtctagagtaattttatgcaaccaaagttaagttgccatcatcttaaaatagtcaattctaactacaagactctttatgttagcctgtggtaatcacaaacaaataatgtactgcagacaatcaaatgagaatgagaaaataaagcttagcaccacagaaaaccaccaaaccacagaggtaaatagcaagagaagaagaaagaaataaggaatctacaagataaggaaaaaataatgaacaaaatggcagaagtacttatctaacaataataaccttgaatgtaaatggattaaattttcccattaagagacagaatggctgaataggcaaaataaaataaaataagacccaactatatactacctaaaaaagattcacctcaaaaaaggcaggctgaaagcaaagggatagaaaaagatattccgtgcaaacaaaaacaaaaattgaacagaataagccatattgatatcagataaaagatattttaagtcaaaaactgttaaaagaggcagagaatgttattatatataatgagaaagggatcaattcaacaagaggatataacaattgtaaatatatatgcaaccaacacaaaagcactcaaatatatagagcaaccgttattagatctaaagggagagatagaacacaatacaaaatagtaggggattacacccactttcaacaagggtaagctaatgacaaaaaatcaacaaagaaacattggacttacactgcaccatagaccaaatggacctaacagacatttacagaacatttcatccaacagctttagaatacatattcttttcggttgcacatggaacgttctccaggatgaatcacatattaggccacaaaataaatctcaacaaatgtaagaagagatgatcagctatcttttcgggccattatggtctaaactagaaattaacaaaataaaattttggaaatgttacaaatagatggaagttaaacaacatccttttagataaccaatgggtcagtgagtaagttaaaagaaaattaaaattttcttgagacaaatgagaatgggacacatcttaccaaaacccatgggacacaataaaaccagtactaaaagggaaatttatagtaataattgtctacatcacaaaagaagatttctatgaaacaatccaacaatgcatctcaaaggcctaggatttgttattaatttaataataaactaaagccaaaattagcagaaggaaggaaataataaaactcagagcagaaataaacaaaattgatgctaagaacaaaaattcaaaagatcaacaaaatgaagaatttgtttttttgaaatgataaaggaaaatcaataaaccacaagctaggctaactaaaaaaaagaaagaagactcaaaaaaataaaatcaaggatgaagtaggagatattaaagctgataccaacttttttttgcaatacgtttgcagctagaacaccagtgtcatgaaaaccatccctaaagtcaaatgggaaagaaaagaaaaagactcccatcaacattgtcaaaattggacacattgattcaggcaagtccaccactactggccatttgatctacagatgtggtgggattgaccaaagaaccatcgaaaattttgaggaagaggctgttgagataagaaagagttacttcaagtatgcctgggtcttagataaactgaaagccgaacctgaacatggtatcaccattgataccctgtggaaatttgagaccagcagttactacttgattattattgatagtctgggacacagatgctttgcgaaaaacgtgaatacagccacatttcaggctgactgtgatgtcctgattgttgctgctggtgctggtgaatttgaactggtgtctccaggaatgaacagacgtatgagcatgcatttctggtttacacactgggtgtgaaacagttattgttaacaaaatggattccacttagccactctatagccagaaaaggtacaaagaatcattgagaaagctgaaacttaagaaaattggctacaatgccaacacagtaacatctgtgccaatttctggttggaattgtgacaatatgctagagccatgtgctaacatgcattggttcaagggatggaaaatcacctgtaaagatggcaatgccagtggaactatgttgcttgaaactctgcaatgcatcctatcaccaactcatccaactgacaagcccttatttgtggtctgcctctccaggatttctacagaattggtgattttgatactgttactgtgttctgagtggtgactgggttacctttgctccagtcaatgttacaactgaagaaaagtctgttgaaatgcaccatgaggctttgagcgaaactcttctgggggacaaagggggcttcaatgtcaaggatgtgcacgtcaaagatgttcactgtgccaacattgctgatgacagcaaaaatgacccaccaatggaaacaaatggctttcctactcaggtgactattctgcaccaaacaggctaaatcagtgacggctatgtccctgtactggattgtcacacagttcacattgcttgccagtttgctgagctgaaggaaaagattgattgccagtctggtaaaaagctggaagatggccctaaatacttgaagtctggtgatgctaccattgtcgatatggttcctggcaagctcctgtgttgagagcttttctgactatcctctgagtcattttgctatttgttctatgagacagatagtcgctgtgggtgtcatcaaagcagtggacaggaaggctgctgatggtggaaaggtcaccagagttggtgaggaagaaataaaaggcatccaaactgggaagaaggtagtcaaattgtccctatttgtagatgttataatattttacataaagaaaactctaaagactccaccaaaaactagtcaaactgaaaaacaaattcactaaaattgcaggatacaaaatcaacatacacaaatcagtagcatgtccataggataatagtgaactcgctgaaaaagaatttttaaaactttcttttaccatagctacaaaaaaactagatacctaggaatatatttaaccaaggaggtgaaagatctctacaataaaactgtaaaactttgatgaaaaataaatggaagaggacacaaataaatggaaagacatattatattcatgaattggaagaattttttttaaatggtcatagtacccaaagtgatctgcagatttaatgcaattcctgtcaaaataactataatattcttcagagcagcggtcctcaatgtttttggcaccagggactggttcatggatgacagtttttccacagaccagccacagggttgggaggtggttttgagatgatccaagtgcattacatttattgtgcactttatattattagcactttatttatattattacattgtaatatatagttatatattatttcattatgtattacaatgtaataatacaactcactataatgttgagtcagtgggacccctaagcttgttttcctgcaactagatgataccatctaggggtgatgggaaacactgacagatcatcaggtgttagattcacatacagagtgctcaacctaggtcccttgcatgcgcagttcacaatagggtttgcactcctatgagaatctaatgcagatgctgatttgacaggagtctgagctcaggcggtaatgcgagtgatggggagcagctataaaatacagatgaagcttcactctcacctgctgctcacctcctgctacgcgacccagttcctaataggccacagacccatacgcctgtttgtggcctgggggttagggacccctgcttcagagaaatagaaaaaaaaaaaaacaactataaaattctgtagaactacaaaataccctaaatagccaaagacatactgagcaaaaagaacaaagtggaagggatcacaccacctgacttcaaaatacactattatacaaagatatagtaaccaaaacaacatggcgctggcacagaaacagacacatagactaatagaatagaatggagagaccagaaatacattcaacacctacagccaactgatttttgacaaagatgccaaaaacacacattggggaaaaagtagtctcttcaataaatggtgctaggaaaattcaataatcacatgcaaaagaatgagactagaccctgactcatgttatgtacaaaaatcaactcaaaatgaattaaagatttaaatgtaaagtttgaaactatgaaacaactagaagaaatcacagagaaaatgctttatgacgttagggtgggcaaggactttttaaataagatctcaaaagcacagacaacgaaagcaaaaagagacaaatggagtttcattgaactaaaaagcttttgaagaggaaactattcacagagtaaagagataacctagcaaatgggagaaaatatatgtagactatacttctaacaaggagttaatatatagaatatataaaggaacacaaacaactcaatgggaaaaaaacccccaaatacctcattttaaaaatgggcaaaagactttaatagacattctcaaaagaagacatacaaatggccattagttatatgaaaaaaatgctcaataccactaatcataaaggaaatgtaaatgaaaaccacaacgagatgttacttcattccaattagactggtggttatcagaaagacaaaagaaatcaagtgctggtaaggttgtggagaaatgggaacacttatatgctgttggtagcaatatatactagtacaaccattatggaaaacagtatggaggttccccaaaaatagtcaaaatagaattaacatgtgatctagcaattccactactggatgtatagccaaaggaaatggaatcagcacgtcaaaagagatatctgtactctcaacttctgtagcactatttataatagctaatatattgaatcgacctaagtgtccaacagtggatgaatggataaaaaatgtggcaaatatacaccgtagaatattattcagccataaaaagaataaaatcctgtcatttgtgacaacatggatgaacctggaggacaccgtgttaaccgaaataagccagacacagaatgataaataccacattatctcactcatttttagatgtggaatagtaaaaataatttttaaatataacaagaagataagaatctggtacataaatggattaacaagagtcatttaaaaaatctagcagtgtgaaatgttgcattccctgttgaaatctaaaaatgaggggttaatatatgttatattatgttatatatgtatgcagaaatacatatattctgttatatatgtacacagaaatacatatatattcatagtggaagcctgactttaaaaagaacttttcaagaatggatttgatcatctcttttaaagccatctagtttttgaaaacaaccagccggagctgactataactttgtttttatgctaaaattctgaactcctttaaacgagtctaaaataaggaaagaccagaaatcacagtacagcatattgtcaacaacctctctatagcgaccaaaggagttcagggcctgcaagtcactgtgttatagtgtacttgaaaagtcatctacaccacaggaacgcaaccaaataaataagtatttcaccgacaaaacccatagagaaagagtttaaagacttcccacagcaatccattgctgccactagccatgtgtattatcagtaaatgtaaatggtgtaaactagtggtgaatatgaacactgctgcttctgggttcttgaagcagtttgttctcgttaagctttgtgaagggactgaaggctttcacttgttttctgtgtgaatgagccgttagtgtgtgtgggaatgttttcacagcaccatgcctcttctgcccttttctataaactgagctacttcacgtgtctcctcatattagtgccatcactaaacaaagcaagcgctcatgaatgaaggctgatgtcagcaaattctgaatagcttctggaggggcatcctgcaccctaacactgatgccagctaaggggatgaagtcaccagggagatcacccactcttattctcctaagaactgagcagttccagcaatgaaaagcaatacaaagcaaacaaacaaatattcagattaaaatgcaatgtaatacagggcagtgccaacattactttacatatgactacacggtctttacactaaatatccagaagtactgtgaaaatcagttattttcttgagatatattataaactataatgagatgtttctatggtccctttattttagtttcagtgaaacatgaaaaacacataaaaataaaattttagaaacatggtagtacatttgaactcacttataaacttaataatgctgaacattaaaataaggacagaacatgatgatgaggaaaagtgatttacagtaaacatttccttgtaaaacagaactgtttctggtatccaatttaccctggttgcatgtaagtcttacgtgcttagcaagagattgaaagactttataatatttgaggttattgtgcataaaaccattgctggtcagaagtaaatcttactgtcttggcagtttgtcttcagagaataggcgacatgtctaaatagaattaaatctcagcaaccttcatgtagaactgtttgttgccgaaaaatataggattatatcatgacgtctggtgacttgccagagaacccttgaaaccctgctgagttcaaggctctgcacaacaggaatgtcatagtttctgcttagaacagtgtgtgtatttaaggagttttgctgttaatgcaggactaaggacccctcactcatgaactgagacagggactgttattgtcgaaagcactaaacacactttcctcattgcctcaccatttaaagatgagcagtttttgactcatgcctcaaagaaagaattattctagtcataaaagcctgctaaagttttcttttttaaagcttataaacagactgcgggcagattgaccatcatatctaataagctaactgttaacaagttagtacagtttagtatacacctgaatacttctattttctatatttttctcctccccccacactccctttcttttgaagtaattttatttcatgaccttatgtctacagaaaaagaattatattactgtcttggattactaaattgaattaatgttgacataaatagttttatttggatggaattttaaaattaattccatttgtaaataaccataagaaatacaatctcctttgtcatttcgatcacaaagtagcagagaaatctattccacacataaaatcacttagaagagagaacttgcaacttactacagtataagagattttcagtatctagtcaccttatgactcatattaatcatgtactgacaagtttccaaagagcttgaattaaaaaaaaaataagcccttgtatatagacatgttgaaggacttagataagtacaaaaaatctctgtgaaaaagttttcattgatgttttaaaaagcgtgttattttatctttacaaaggaactgcactaacactaatctagcttttggaaaatacagcaacattcatgactaatcgtagtgtgaaaagtagaaatggacatgaaaagtatcatcacctctagcaacacttgaaaccctaagagaggttcaaatgcaaactttcagattttcaacactgaaaaaccaaggactttatcttccctttcaaggagttgctttgtggggcgggggaaaccaaaacctcttttgtagtacaaactttgccaatatatctgattctttttctacctcctcttagaagagatataccccctttttaatagtttaaaaatactattgcagtgaaactcttggtacaaaggaaaattattctatttagtcgtattcttttaaaagttatttgtttaaaagggcttcactgtattggtcttgcagcccttcatacaacagaacaaaagcagttctatgaaagaagactaaacttgaacaaaccgtaaaaaaaaaaagcaaagttcctctctgtttttatcaaatttgattgctgcagctgttcccagtttctgtattttaaaaatagccttattcagtgccttgttggctaaaggccagagtgccattagaacatgctgtacggaaaacctctattcagttacagatacagaaatatatttaagatcagtgggggtcatctgcagcaaacacttgtaaaggaaaatcgaattttaatgtgtttggactgattgccacttttaccagatagtttaaagcttccatatagaaccatcctattattttttcttttaggtaaaaatgcaaaatgcgtatgaacttcattggacaaatattattagaaaggtctgtttctcaaataacaattgtacagctgagatacacatttcaaagaatacctactagtggtttctgtttgacaagctcacaggcattcatcgagtgaaaaggtaggtaatattgagcaaatgctacaaatggaatcataacttctttctgacacagtcctcctaagtaaggtcacgaggtgtgaaatagattgatctgcccaagggaaatgagtctggggactcattttggacttaaagtgtgtggggaaagggtgaaagaattgagttattcagtgatgtttcagagttgaccttcacatctcttcagttctttcctttgcctcagcaaaggattgaaattagcatttgggactaaacagattcctgtaggagtcctaatttgagttgtaagtaaaaaggatctgcttcgcataaatcatcaataaaaaggaattttgattccaggtattgaaaatagtaagaaaaaattagaaagcagaggtctagggaaaactaaggtgagaagaaaaaatttcattagggaaatatacagcagttgtcaaggtatgggaacatctaagatttcacctttcttgaaagctaacatgttagcctgccacagctttgttgaggctggcagaagacatgagttccctgcatcagagacccaagacgttactatccacagcaacagcagtcaccagtcttaacatctaaatcagtcccccaaaccccaacttccatagggtgaaacaaagaggtctgggagatacctgcacacataatgggctgcattatagaagagaaacccatggcttacaataccttgatctttcataatagaaaataagcctgcctgatctcttcccagctgccaaactggctaaaaaatgaagctcttattgacatttttatggttatatgtgaattgctaccatgatggtattaaaatagaagagatatcaaaatatttcacaatcagcaagagtactggccacagtgtatcctagatattgtaagaaaatagggtcccagaggtctctaaggtacctggcattgatactttaaatgttggatttggaaaagtctgggaggtcatgaggagggatagggggaacctggaaggacagggcgaactgtgcagaaatatttaaataatttaacatttggtacagctatgctgaaggtcccagtggaaggtactaaactgaaatatgtctcagaagttctgattcctagtcctaaattttgatttagctaaagggcaacttcaggtaagtcatttaatgtttctgggacccagttaccctatctctaaaagagaaatggtactgaccttagattgtgattaaatatattgttccaatcagttacatagtaatttttttgctcattctctttctcccctacactaaataaactttatgtataagtaataaaattataaattctgtggctattccacttttgatagacaaaaatttccacgagaatagcttgaaaaatattggaagtgaagtaattgagcgtgatgggtctcagatgaaagacatttggctacaaatattaaagtggtggggggaatacagaatgaataggaaaaaggaatagaaaaacaaaagaacagcaaataaaaatgtctgatctaagaaagcatttggatcagatgaatgggaaatgtaattaggctggacacctccggaaagggcaaaaatatgagcatttccaccatgaaatcaaagtaagatagagtaactaggtcagcactctgcaggcggcctgggacaggactgggctcactgtgaacttagaagcagaaataaaatccacatggtcacatttccacaaggaatggaacaaatagatgatgcccaggtgttctaggcataaggcattgtagagcaaaaagttcagtgggattcaattagtaagtagaacaaagcttcactataactgggcaagtggcagtgcactataatgaagctcttaattaggctaataatttaatataagtatgttactatgttattgctttaagatttctgaaataaaaggagtagtgacaacgaagtatacaatttcttagctttctggataacaatattgcaaagcaagatatttgttatttagcaaatacttactacaatgtcagaaattatgaaaacaaggatcaaaacaaacaaacaaacaaaaacaaaatctagctcctgagtatatagtggtgtacagggcacaaaaagagacctttactacaataattgacaaggagatgttcagatttcactccaggttcagagctggcctttaagtctagaacttctggaggccaacatgccactgcatagaggtcattctggttaataaattgagcacaaggattcacccattcctgaatctagttctttaaagttgtttagtaacaattctcctttaatactttctcttatgttgccagtcctctgctaaatgttataaaaacacaatatgtttatgactcttttgtactcaacctatactatgaggcagcaatgagagaatcaaaaaattacatggtgtggcccccagagtgcaagacctagcagttaaaaaatgatacctatcactgtgcactttggctacctcattacctagtgagacaactcctcattgttgagcataatcactaggaatattttagtgcaactcatgtattccccacattacccacaaaagccgtcctcatttttacacaggtgttatgaatttctaattgtctctttttgtttcttcttgattaggaatttggcaagaatttttattttcctggcttacattttatctcaatgtttattttcttatacatattgtttcataatactacatatgatttctttgcccatttatccatttacctcatccaacaaagttacattgagcaccaacagatgcttagtagatcaatgtatgccaggtactctggaatgtgactgagatagatgtaaaaagctattagtctccttaagagcactaacatgtaaaaaaaacgtaatgtagcattgtcaaaaagggagagtgtttaactctatggaggatggttggtggtggggagagagttgggattgtagaagcttaggaaaagcctaaaaagttgtgagaaattaggtaatgaagattcagtcatgaagggcctgagagcttgggttttccttacatttgactagggtgtagttaaaaattctaagctaagtagagaggcagttagatcacattttataaaggacatttagggagttgtggaagatggtttcttcattcatttaggctgctacacaaaaataccataaactggatcgcatataaacaacaatgtatttctcacagttctggaggctggaaatccaacatcaaggcactagcagcgtctggtgagggcctgtttcctagatagctgtcttttcactgtaaccttacaggatggaaggcttgagggatccttgtgtggtccctttttatacaggcattaatcccaattatgatggcaccaccctcataacttaatcaactcccaaaggtctcactcctagtaacatcacctaggggttagaatttcaatatatgaattttgggcagacacaaacattcagaccattgcagatggattcaaaggcaatgaggtaagaaacagcagggtgatcaattagagaagcattgaaataatgctgatgagagatgatagggagttaaagtaagctgtgaccaggtgcatgagagtgaaagttgcttaggaggtagaactgacagcattatgaatagccacctggggagtgtcggaaggcattgcagtggccaccggggttcagggttggtagacaagctgatgatgatgtcaccaactaagatgcaaaatcctgggggaaaagcaagtaggaaagtaggaaacatggtaagtttgattttgcatgtgctggtattgtggactctgtgggacatccacatggagctctctatagagaggacggcctggtgaatatatatctgtagatgtgaacattatttccaaattaattacaaattaaaaaaataagaatcatatatcatgttgctttggagtttgttgttttgtttttagatgtccaaatgcataacctggcacagagcagacaatcaataagcatacgttgaattagtaataatgtattatattaagtacacttgaagctttcctgatagtcttctataagaggctccaataaagggtagactcacctttaaatttggcttacaatgagtactagctaggaacaaaataattgctcatgatttcagagaacacttcttgaagtgacaaatatatttcttttgataaaggtaaccattaatggattatctataatgtgataattgcttcttatatttatctagctctgtttagtttcccattcttttttatgatttaatgtactcatagtatttatatgcttaaaccattgttaactggattttttttctggtaaccaatagcatttcttactgatacaattttacagatggaggaaagaagtcagagaagatgaatggtttgctcacagtaattcagcagtgtctagagttcttcccatgatatcataattcctctcaacatcatgaggctactgatggaaagtgcctttaggtatctgtcattaattactaataacaaggtatttttcaggggcaaaagctgttgttacttagccacactgttgaaaactcctttgccgtgactaactcttgtcaatcctgacagtgattcaagaaaactgttaatttcattatttttatactgactttgctaaagattgaaatcaatttgctacatttttggtatcttttaaatagtataaataaattagaaccaaatctgtaacaatataaaaaaatattatatagaactgcctattaaatgttttgtgttttcaaatatttctaaaaatgattacaatttgatactattattaaaatttaaaattccgtctttgaaacagaagttgtcaggtactgatctgttactgtaagatgccaatcatattatcacatttctagttgctgaagtattttatgaattttgaattctattaaatggtgatttatttttttccagataagtcaccatgcaagaggcacttattacacatgtttttcagcatatgttgcaagtttattttaatgctgaagaggcacattatgatcaaagcagaattctgcccaatttaaactgttccaagctattttcatacattcactcatgtaatactgtaagatttacattaaaatgaatgctcgtctacaattaagcgattcagtcaacattttaaaaaaaggtgcaaatgtgtgcaacgtgaaaaaaaatcaacagatgtgcgaataatctctacttcggggccagtatcaaaaagagcagtagccaaaaaaaaaaaaaaaagttaaaagtttcagcacttatttttcgtctatcctctaaggttttctatacctaagttaaaggacacacacataaaacagtcataagacatttccttatgatgataattggattagtcaataataaattgggttgaggaacaaacaataaactacagtattcacagtagaacttaaagatggatatatattttgttttcttctgattcttatactcttctattctgatgatgaatatattccaaagcagcaatgattcacctctgttcagagaagagtacacatgtaaaaccagaatatttagcactaatgtatttttaaaagatagccagctaggatataataacaaaagcagaaagagcttctgatcctagaggtgaataaatctgcaagccagtgcatgcatgcagttttgcaggttgtataatgcataactgaaggggtcaccattcacattgtggtctaaatgaatggcatcttcttgaattttatagagcacatcctgcacaattataatgtactggggccatggaaaacatcatgagtatgatggaaatgtaaagagtttgttcagataggataactgagatcaaagtgcttcttaaaacctcatctctgttccatgagatatattttggtgaccattggaaggatgtccagttttcacctacttcagtagcagatgtggggcaaagaaaaccttgatgccaattgacagtctgtaatatttagacaatctaaagcttctggtctgataacatggataaaaactactcaaatctcatccctattctctcctcccccagcgaattaattgcaggatatttcttcctttattattttaactgagcttcccagtgacatctatttgagaaaataagaagtggaaatggcactcactgacaagcacattcttagacagggagaaaatgaattggtataattttacttaaaaatattctccattaatgtttttcaacatgattaacatttatgaaaacattgatctatattatagtaaattacatactgtactttaaaatgaggactgtgcttttgtttacaaatttcaacatgctttgctatcctagatgaaatctgaatacatgaaaacttgaggggccttatatatgtacccatgtttaatcctgatgtggcccaaggcttcaactgttctaatttattgcagctcttctacacagttctacaagtagcttggtgagctgacacatttctgtgtctatgtgggttaatctgagcaagaaaatgattagcctgaagtctctggctaaatcactaaccatactttaatccattagatgagaccacctctctacttacattttaaattgggaaacatacaacggctgagaaaacatagggcttatgctttttgatgagctaatatagcctaaattgtcttggtaaactcttcattggccctttgcccatgagaactaaaaggttcaagtgcctagtcaactggctaaaaggaagtttagcatgtttctggaaattacaaaatagccaagacctgtgttgtcacaacagggcagcaaatattctccacattgaaaaagggatgttaaaaacagggccacgagtatgggaagagaacgtacgttcatgtagatcaattctaggggaaaaagaaatgtattactataaattgttggtagttattttctagcaattctttgatatcagggaatgtatttttatttggaaacactttaagcacttgtataagctttcattgtgtgtgtatgtgtccacaactgtagctattcaagaaatatcctatgtttttatcctcttaatcaacttcattcttccttcatgttcccattgctccaacctatcagtaaatctactctcagatatcttacaggcttatttcctctctaaagattgtataacagctaggaaaatgtgaaaatagcctctcatcttagtgtgtcatactgtcactgtgtattcatgtgacacaagcttgcattctgatgccatgtccatgtggggctgaggaaacttgtggagattcatcctgatatctgcctccccggatgcattcacatctctttcaactgataatgtctttccacctcctcaaaactcttccagggagcagctatggttctacattgttcttgagacccacccacagtaaccatcttctctgcttggaccatcagaatctttcctatctcttttcttatgttttaaagcttctctttcttggggacacctcatatcatctcttctgggagcagaagttatacattgttggccagagggttgaatctggttcacagaattgtttggctcataacatattatgttctaaatttttcaacatttgttaaaggttttaaaaaataagtggattctacataaacatgtgattctgagactatcttcaaagattggaggatcagacaacattgggccaacttatcctccttataaaccttttcacctttagacaggacatgctctttccaatcacccaagtccctgcccagtgtgcttcatttctggccccacaaggcatttgtgatttgtcttctgatctctcattctcaactgcttctatgttgtactctgcaaaaaatcacacggccagaatgagggaatgaaccttactacgtatgggaagtagaatcttactatagcttactaaaatagggtggcaaaatacaggcagataggccaaataatatgatatatatatgtatgttatagaagatagatcaattgattgacaggtagatagaagcaagaaaaactatagactttgggtaagatcatttctggtatacaataccaactagttgataattaatttaataatgcacatattcaaaataaaaacttgcatattaactacaaaatgtaaattctcttaaaacttggctttactgaaatgagctatacagacataatatgtgtccttatagagactacagtctatactaagaaagactgtaaagagatgtggaatccacataggaaaatgtgtaattaaaacaccagttgaaaaacatgataggggttatgacagggctaagtccaaggtgatagatagtttgtaggaagaaaaattaaccaaccttaagggaagatttgcctgaggaattcatgtgtaagcaacaactggaagcatgtgagactcatatccaggtgaacaaggaggtgatggtggtttcaggaggagaaacagcaagtgcaaaagtacagcaaaaggtgagatgaaatctagtgcttaaatctacctagaaaccgttcagtatggttgcagcacagaatttcagggcatgtgggagaaaaggcatattaggcttaataaggcaagcaatacctgggcatatgaccttataaatcatgttaaagagtttgaacttacataagggactgtgggtccccactgagatattttttacagtaaacaacataatcagatttttgatgttgagaaatcacatgaacctgctgaaatgtagtttctatacccataaaataggaatagtgtcgtatatcctggttgcctcattggattgctgcaaagatcaaatcaaataatatatgctaaaattcagcaaattctaatatgcaagtaatattataatgcataaagtttatttattgttgcaactattttttgtagaaagtgtgtgagccaatctctgataggctaatagattgtactacatgacaatgagtagtaaagcacaactcatatcagttattagcaaacattctattaagaaatgtgaagaaaacctaagtattagggtaaaaatgtatgagatggaatttataaatgttggcaataacttttaattaatcttttattatactgtttctcttactgggagttgaagaggttgatcatgttttcttgctgcccaacactttttaagcaacttctatgtttcaggaataggaaccctgcctttagagggctacagaagctctctccctctgcctcctttgaggtcaacatgtgatccatcagtatgtgatccatcaacatatgatccgatagcacctgatccctcagactgtaatctatcagagtgtgagtcatcgtgtgtgggatctttcaaagtgtaatctgccaacatatgacctaagctttgccagtcgggtgcattggtgtgagatgtttggaatgcagtggcttgaagagggagataacaggcagaaacagttctggccaggatggcatggagacattctgttctctgagggcatggagtccgaagtcctaggggtagcatcctgtgcccagcttctctgtggtgaggtgttggactcatgcacagaagcagagacattaaggttacctgtgggaatgccaggcaatgtacttggtgagtggttcctggctgtatggcttttaagcctaattatctgtcctttggagagattttgggggtaactaatatcagtaaacatgttccttttctcctcccacaaatgagagtggattctgtggtttacaagtaaaaatcctgactgataaatgtgtcaaaataaaactgttttttcatcttaaggtggcaacctttttttactcctttattgtacttgggaaccagggcacacaaaccatgaggatgagtatataaatgtggaacaaaagaggggaaggaaatggattccaatactctatcttcaaagtgaactaaaaaaatgtaaaatgaataatccccaaaattatatatgacttgtcagcacaatttctcatttgaaccttgaaccagcatctacagaactttgtagatgaacttctatagaagtttgtttgtaaagctctactctatgatattctcagtaaagttttacagtgattaaatatgcaagcttttatatgagttctgggtccagattgttgctccttaagttattaattgtgtgactttgaaaaaagtatttaatctgtataagcacctgtctctccagtaaaataaaacaaaatatccagtgagagagtatattcaacacatttagtgctatgcttggcccaagacagacctttaatagttgctagtactgctaacaattaaaataaaacatttacttgagcttgaaaaaatatttcagggatggaacaggaatagtggggactagtattcgggtttttaaactgctggtggaagtgcagtattagaaggccttaaaaacttgaagaaaacaaagaccagtctaggataaagaagtatattctacttaatcttcatgtttgaagtaggaggcaggaaggattaatgggggttcaacttctacttcaaacagtttccctcccttttgctgggttgcaagggattgtaaacagcctcaatttctccctctttatacatcttcttccctctttcttctgtgttatgcattgatatttctttatgtttgtgtgtacacatatactagtatttctgtattgagtaaaataattcaaaacgagaatagttgcattaattttacgacagttaaaggaaccggctttattggttccattcttcatttttctgcattctagccttctcgctttggttttgaaatatagaagtactaggtagcctctgtatctagcttgattctttattcactgaaaacacagctagtgttttttcagtcctatatgagtgctccaagagttgttagaaataaacaaaagaatattcatagcctcctggaaatagctagtttttttttttttcatttatcctttttactttcttccttttggattctcctcttctttccactccatctcttaattggcttgcttcttggtagcctatatattctatacaatgacttactaaattactggagtaatatcgacatacttgcatacatcgtttctcttttttcctgtagggcacatgtctcaaacagaatataattatagctagatgctgagtgggaaacaagcagtccttatatattgaggacatgagtataagcctgagtaactattactactgatagaaaaaaaaaaaacgccaaatttaaaaaaccatcaccattcatcaatttttaaattgtatctcatgtttaaacatttatttgcttcaaatgaataattaaagtcagtcccatctccccctaaaccaaaattaagtagcattgaaattccttttcatagagagatatatacgacaagattgggtatttggaaagatacagacactgcttgcaactataaaaacaagatcaaaacatttggatgccctttctccacttcagtaggacagcaactacacaaggctattctctggagtaatgatcttgtctccttccaaaggtttttttatcctatattcaggaggtcatatgcagtcttcagctgcacagagctccactcctattaatttaaaatgggggctccagaggttcacattcagcaaaatctgccccttaagaggtaagctttaccaatctcccatttgaagaaaaaaagaagcgtttatctttggaaaaaataacctacttaaatagtctatcttccctaacaagaaataaagaaaaacttcagacataagttaataaaatatccttttgattaaacagagttcactttattttcatgttttggcaacactgttttagtggatttgcatgggggggctctggtattgttattttatcattatattatcattttgttaagctatctggcaaattgaaaaggttattcaccctatggctgtctttttttttttaatgttgagcattcattgaaaagaatgaaagaaatctggttgaatatgcaggtgcactaataaatgggtggtctttggattacagtatttatgtgtactgtggcaaagctgaacagaaacctaaatgttatacatacaaagtggtacaacaagaacatctgtgttggggggattgaactggcatggctaacacctccagtgccaggtgcaaaggaaatttcaatacagcttgagtaatcttgactgctagcatctgcctgcatcagattatctcctatgttcctagtccaccactatccattagagtatttatatgatacatctggtggtgcaatggccaagcaagaagcagcaatgcctccgttactgggggcaaatgcctgactctttaactcaatacaaaggcaaacaggaattcatttcaggcccacaggcagccagccaactcttcaagactaattagaagatagcactccagtgtgatggctgctttgtcctttcagtttagttacttacatatccatgtgcacaatctgcagacatttaacttttcattttaaaatcctatttctaaatatcatttccaggaaaataacagggttttaatatgttgccagaatcacaacagagctttaatgtgacttggctcaatccaaagtctcaacatgcacctgattttcagaatgaatcaatgtggtcgggtgagaatggtggagatcatcagtccattagtctccgcaacatcaaatctcacatgtccaacaacacaaagattatgtccctctcttcaagtcttcaaatctttctcacctcaagagatgactgtgtcacctaatgcagagaaaatcagtgggattgctttagcagtctgccatctaagaatctacataaaccagcacctacctttcctctctgcttcctgttaccatagatgtgtgacacctctgtctttgactttataaagcaaacccatctcttcctgctttatacacccacatttccctgatttttgcatgcactccccctctccactgtatccttgccatctgaatatattgatccacttgcaatcctcttcaaagaaaacctctgtagatgttatgttcccctacagctatcaccttccccagggtgaaggtgttctttcacaatcaaacatctttataggtttcttcactgtgttctcctactcacctctcaaactgttcaaatctggctcctttcctcaacatttcatgagactgtatcatataaattgtataggtcccatatcttcacgctgctaaaatcaaagggcttcatcatcctaatagctattcctgcagtatttgaaacgtgtgaccattacttcctcatgaagtctctttccttagcctctactatgtgatatttactctcatgttttgtgatatttactctcatgttttgtgattttactctcatgttttgtgatatttactctcgtgttttgtgattttactctcatgttttgtgatatttactctcatgttttgtgattttactctcgtgttttgtgatatttactctcatgttttgtgattttactctcatgttttgtgatatttactctcatgttttgtgattttactctcatgttttgtgattttactctcatgttttgtgatatttactctcatgttttgtgatatttactctcatgttttgtgattttactctcatgttttgtgattttactctcatgttttgtgatatttactctcatgttttgtgatatttactctcatgttttgtgattttactctcatgttttgtgattttactctcatgttttgtgatatttactctcatgttttgtgatatttactctcatgttttgtgattttactctcatgttttgtgatatttactctcatgttttgtgattttactctcatgttttgtgattttactctcatgttttgtgattttactctcatgttttgtgattttactctcgtgttttgtgattttactctcatgttttgtgatatttactctcatgttttgtgattttactctcgtgttttgtgattttactctcatgttttgtgatatttactctcatgttttgtgatatttactctcatgttttgtgatatttactctcatgttttgtgatatttactctcatgttttgtgattttactctcatgttttgtgattttactctcatgttttgtgattttactctcatgttttgtgattttactctcgtgttttgtgattttactctcatgttttgtgatatttactctcatgttttgtgattttactctcgtgttttgtgattttactctcatgttttgtgattttactctcatgttttgtgattttactctcatgttttgtgattttactctcatgttttgtgattttactctcatgttttgtgattttactctcatgttttgtgatatttactctcatgttttgtgattttactctcgtgttttgtgatatttactctcatgttttgtgattttactctcgtgttttgtgatatttactctcatgttttgtgttcctctacatctctggacacttattcctagccttctttggcctccctttccaccatattcaacaattcaaggatggaattatgcagggatttgtcctgagtcatctcttcactatactttttccttagaaattctcattcaccaatacggcttcaattgccatcatcttgcagatgagctacacattttaatccccagcttagagtaaatcagtttcctaaacttcaagccctagcatcaaatcattcattcaacatctgaatctaatacttctgaatctaactcatcgttctctttgccaccaaaatacttttttttctaaagtacctagtccttccaaatttcaccaccatccatctaactgattaagctagataattcaccatttttgacatctctgtcttgttccttttccaaatcgatcaattagtaagtattgccaattaacttttaaaaacgtaaacattatacatgactatgtactttataaaaaatggcaataattgtcctttcatcatcactcctaatccttgggcatctttctttacacagaggtaatactaattatgaaatatattcattcaaatttttgtctattcttatactcatatatgtaccagttcaatttgaaatatatcagttttgtatatcaatttttataaaaaaatggtaacacattctaaaatttgatttattcagacaaaaacatgtcctggaaagctattttcgtatatatatcaatttgattcattttaattaatgcccaaaataccacagtatatatatccctctgttagagtttcttctatttaaagttgcgctttctcattttttctgttaacaatgctgcaatgaatatattcaagcatggctccttatatgaatgattctcaagatagagaaatagagattgaaaagatattgacatattacattcccaagtggtactgggagaaaattctccatggatttgtcacttttctgtatgtctgggaagcaaagcatcgtctgtcatttattccataatatcttttaaaaagatgtagagtgaacagccttggaaaacaacatgtctccctctggagcaaggggaaggtatgctaactcttcagtataatagcatttcccctaagcttggagttcttctcctatgatgcaaaccattgcagaagcaggtgttacctggcccccttagtgtcatcctgtgggaactgggacttcaggaactagtgcaaaaatgctgattattctggttgctgttattgctctgagtaataaactaaatttatctctggcccaggattctcatgccttccaccagctttcacagaactgtggtgacggtgatacagtttaccctctcatcatacaagtctgaacaatatcagcttcttcacattacagccaataagtgatagtaataaatgtttctttttttccaaataaaataaaagaaaaaaggtatcttatttcagtttgcatttccctagttattagtatagtgaggttttacatgttgcgttctctctctttccttcttcctctttttctctcttgccatttatctcttcccaagtactccttatactttcacttttgttcatctctgatgccaccatcctagttcaaagtagctgcaattatttcctaactggtctccccaagtctactcagcctccctcaaacacagatctgatcacatggcttccttccttaaaaacacttggtctttccaattgtctttaggataaaacttgaaacccttgacagggcctacatgctcgggataatcttgtctctagctctatttgttgacactcttgtcttcattttcaacttacatttagcttttaactttcttggatatggcacgctctttcttcttttggggatttcattcatttagaaaaaaaattccatgtgctatttcaaattaatgttttttaacaaagaaaaatttaatgtttaggaaataaggagaaaaaatctgctttggttgtaaactgcaatgaaaagaaaagaaaaagtttaggcagaaaatatatgtaaatattatatggtacttatttctggataaggggataaatgcattttcttattttagttattttaattttctctattctttctttctccaacaaacatattttgctctattaattagaaaaaataatcttaaaaaactgcttttttggcctctatcctgctctctcctattacataattacaacaaagcaagtaatgaagtttcaaaaggaaaagtttaggaagaaaatatataatttcacccacaaaatgtagcacaatttcaaaaataccaaatgaaaactaaatgcccaaacagcttctttgtcatcacctaagctaatttcaaatgaataagactaagggaatacagtactgaattgagaaggccaatgcctgcctcaccagttttagagtcagagtcacacagtactgtcctgacttccattcgctcctccctccttctcccactccattgcttctcctcccactcaacatttagtaagcactgtctatgtgcagtgaagtgaaagtccaagaagttcatgctgaaatagaggagctgatctgtaagtacctacactcatcctgatggcaaatgaacagacaaaagcatgaacgcaatgattatgaccggaggcagcagttgagtggtcttgagaaaagcatggactcttgcctggtggctgagagatgtagtgagatttctcatacagaataaacaggaagaatatggcaatctagggcaaatataaacaatcccataagaaaggaacctgtagtataggcatgcatgtgagtcaaggtgattaatgatgaacctgggagaaaattaaggttttcgagccacattagtctcaagggtaaaaaagaggcaatgtatttataaagtgccccacaaaatgcagggccccatagtaagcataaatattattcattcttcctctcccatctcttgcacgtacactccctttcaaatttcataaaagtctatgtcatgtagatgtattccaaataataataaagatggtaataatagtaaaaataaccactaatctataataagtacaattagcatacaaatgttttacacgttttatctcattcaatcttcaattactctcataaggtggctactggtattaccttcattttgccgatgaggaaaccgagacacagagttaagtaactggcctaattaaattaattcatggttgaggtaggatttgccatcagccattctgatttaggattggagctccaagataataacagtaactagaagtgtaattagtaaccagtgttatttctctgtgcaatgaaattatatgcaaatggaaaaagacaagatttgaaaggtatgcattttattcacaaaagtcaaacattaaaaaaatttatttatacaatgttaagcatgtttctctctgtatgtttgccactttgtatatatggcctggatattatttctttaagcagattaattttcagattcattcacaaacagttacaaacctcttactatataccaagttttatgttagaactttaaagagttgaaaacaagcagataacattcttgccttcctggagtttatggcctaatgagtataacaaatttaaaacaaaaatgaagatatacgattgtaaaatataacaaatgccattaaggaaataatatgaacacgttatgaaatagaacaagaagaagaaataatttaaattttttctactttaactttttaatctggacagaagtggagataaggaatgtggttagagaagaaataaaatgacactggtaaatatcagtaactattactcaactctcagccatgtctaagtttttttggactttcaaggtcacactagtgtactgttatatgtcatgagtaataaatttggtttaaatattattatgaacccaaattatagaataaaaaggtgactatgaaaatgcatatagcaggccgggcacagtggctcacgcctgtaatcccagcactttgggaggccgaggtgggtggatcacctgaggtcaggagttcgaaaccagcctggccaacatggtgaaaccccatctccaacaaaaatacaaaaattagccaggcatagtggtgggtgcctgtaatcccagctacccgggaggctgaagcaggagaatcacttgaacccgggaggtggaggttgcagtgaaccgagattgaaacattacactccaacctgggtgacagagcaagactccgtctcaaaaaaaaaaaaaaaaaaaaaaagaaccatatagcaagttccctcttttgtcaacgtgtatgtgtatgtgtgggtggggagggaggtgtgtgtgttcttaaaataacttaaaggtcttttaaaggacttacaccaatgtgttggtaatcactgtcttcagtagatagaattatgaatgattttttgtttctttccaacaatttattttctatacagtttatcagtttttatgtagtacactgaacaagaaaaatgtacaaatatatagttttaaaagtttttctgaacctctaagctaggatcttgtttcatctcacacactgaatgaaactttatgaattgagaaagccacttcattccctggccttcacatcaaatgacaagagaaagggccagacagtctagtctctaaggaactcctagagatccagagtgtatctaaagcagatgcctaagtattctaaagtcctatttatttattaaaattttaaagtgagaataattcagttttatctataagtaatattttttcagtaatactttttataattgtgaacaattgttcactactttcctctacctttatttgaatttaatgtttggatttttgtttgcttccttgggacgtgggtttttttcctagacttcaaatctctgaagccagtaccttattccagttgcaatctgtataatttcactttttccatttttagtaacattaaagaaaaaaatcatcacaaatcattcttggttgtttatctggacaagtgttctcaactattccaaagctctaagaccactgtaaacttttgaaatgagtaattataccaggtttatataaaagtcatatgctgaccagttacacgggaaattaaaaaaaaaactagaacgtacatgagaaggagaagaacaggcctcaaaacaagctaaaagtgagatgcaagtgaaaaaaaaaatcatacgtccacatatagacctgtatgaatattttccacatggagctcaaactatctagtcccttacgctttccctgtgaggtcaccatgggcttaatgaatgtaccggtgcttgatagaaagttaggctctcctcaagacaggtgactctccatctttctcactttttatcttttctttctttgtccattgaagtctagatggtgtccctctattgcgtctgaatccatggtcctgtccatacttttgtaataataaatacctttgtaaataaacccttctgaggacatcctaacttgtttgtttcctagtaggttcattactaatatgcaaatattagctttcatttggctttaaaataaaataagctttatttggaagggtagattcatatgaaaacaagacacatgtcccagatgaaacttcgtgttcataacacttaagccttcaaagtgttcagattatgtaaaatttgagagaaaagaataatcagtttcaatacgaggtattccagtattcatgtgttcaaaatagagaagaggaaaagaaatggagaaggaatttgaaatattttccaaacagatcatacacttgacctctagcttaacttagctatgatacttgaagtcatatttacaaggtcatagttttaaaaggagatacatcttgatcaagattactctatttgtctctacactgaaaccatcttgcaaaagcattcaatagttaaataaaaatatctttctaatgaaaaactagtgaaaaccacaatgatatttgcttaacctcataggtgaatttgttggtggtctaagatgtctgccaacaaaagctctttttgtgctttgaattgaccaaaggccaaatgctaatggaaatgaatacctgatctgctttgaaagtgaatcctgcctacaatgaataagagatggcttgaaggaagataaggggaagctgatcatacttttgtccatttatggactttctaaactaaaatattacattatatcctttgagaaagaagctgaaccaccattcccgggacagagtttttttttatagctttattgaaatgtaatccacatatcattcacccatttaaagtgtgaaattcagttttttttagtatattcaaagttatgtgcaaccatcatcacagtaaattttagaacattttcatcacttcaggaagaaaccctgtatcttttagatattgctgctgtattctccaatcccccacctctcaccctcagtccactattctcccagcaactaatgatctactttctgcctctgtagattttcctattctgaatatttcatacaaatggaatcatagaatatgtagtattttgtgatttccttctttcacttagcatgtttttaaggttactccatgttctagtttgcatcagtactcaattcatttttataagtgaataacatttatttgtatgaatataccatattttctttatccattcatcccctgattggcattttgattgttttgacctttggctattatgaataatgttgctttaaacattaatgtacaggctttctgtagacataagctttcagttttcatggactctgacctaagattggaattgctgagtcaatgttctaaatctatgtttagccatttgataaacttgaaagaatgttctctaaattggcagcactattttacaatgtgaccaacagggtataagggttatgatttctccacattcttggcaacacttagtgttatctgacatttttattctaatgggtgggcagtggtatttctttagggttttgatttgcattttcctaatgactaaggatgttgagcacctttgcatgtgctgattagtatctcttctatacgtatatataccatttctatgtgttctttggataaatgtctattaaggacatctgccatgctgtaattgggctatttattttttgttattgagttgtatcattacatattatagaaataagtctctatgagatatatgattccaattattttctctcacttgtgttgtcttttcactttcttgatagagtcctttgaaatgcaagttttaaattttgatgaagtccaatttacatattttttcttttgttgttcatgctgttggcatcatatatgagaatccattgctgaatcaagtttatgaagatttacccttgttttcgtctaaaagttttatagttttagatcttacacttacatccttgattattttttagttaatttttctatacagtcatgtgtcacttaatgagtggactactttctgagaaatgcatcattaggtgattttgtcattatgagaacattatagagtgcacttacacaaatatagatgatatagtctactacacgtctaggctaaatgggatagtctattgctccccggctacaaaactgtacagcatgtttactgtactgaatactgtagacaactaactgtaacacaattgtaggtatctctgtatgtaagcatgtcaaaacatagaagaggtacagtaaaattaagttattattatcttatgggaccaccattatatatgcagtccatcattgactaaagcattgttaatgtggggaacgactgtatagcacgaaataagagtccaactgcattctttgtatgtagatatccagttgtctcagcattttttgttgaagactattgtctccattaaatggtcttggcactcttatctaaaattagttgaccacagatacatgcatttatttatggactcccaattctatgctatatatatatatatgtctatccttatgttactaccacactgtcttgattactcatggtttgtactcctttttcgaaatcagaaaatgtggatactccaactttgttaatctttttgaaatattattttggcctgaatctcttgcaattccaaatgaattttagaatcaccttgttgatttctgtaaagaagccagctaggattctgatagtgattgcattgaatctgtagatcaagttggtgagcattgccatgttaacaatattaagtctcccaatccatgaacacaagatgtttatctgtttatttacatcttctttaatctcttttgacaatgttttgcaattttcaaatgttttctttcttttaattttttaaaatttttaaaaatttctttcaatgatgttttgcagttttgaatttcatttgctaaatttatttttagcattttattcttttctgaggctataataaaatttttttttaatttcattttttgttgtgttgcaagggtctagaaatacaattgattcctacctattgatcttgtgacttataagcatgccaaactcattgattagttctaatattattttggtgaattccttaagatctcctatatataagaacatgttatgtgcaaatagaaatagttttaattcttccttttcaatctgatgccttttatttatttttttgccttttatttatttttcttgcctaattgccctagctggaacttccagcacaatgttgaataaaagtgatgtaaatggatatccatgacttatttctgaataaagcatctagtatttcaccattaagtatgatattagttgtgggttttacatagaagccctttatcaggttgagtactctctatttctagtttgttgaatgttttttattataaaaattgttaagttttgttgagtactttatctgtgtgtactgagttgatcatgtgatttttggtttttattctattgctatagtgcattacattgattgatttccaggtgttaaaccaactctcattcctgggataaatatcatttgttcatgttgtataattcattttatatgttgtgaattcagtttgttagtattttgctaagaatttttgcatctatattcataaaaatattggtctgttatattcttttcttgttatatctttatgtgatttcagtgtcatgataatactggcctcatagaattagggagtatttctcctcattttttggaagggtttgtgaatagtggatattaattttttgtcttacacatttggtagaatttgccagtgaagccatctgggtctttgcttttctttgtgggtagattttgattactactctgaattctacacttatcaattcagattgagtccatttcttcttgagtcagtttcagtagtttgtgtctttctaagagtatgttcattttatgtaagttatctgatgtagtggcattaaattttttatagtattgttatagtcttttcttttttaaaggctgatagtaatactttctctttcatttctgattctactagtttgaatcttctctttttcttggtcaatctagctaaaggtttgttaatttcgttgatcttttaaaaaaacttgtttttggcttcactgactttttatatttttttcactttcctatttcactaatttctgccttaatctttgttttttccttccttctgcttgcttcaggcttagtgtgctcttctttttttgttttgcagtgtctgaagattgaagtataggctatttatttaagctgtttttttcttaatgcttacatttagtgcttcaaatttctctctaaacactgcatccccaaaatttggtatgttacgtcttcattcatcttaaggtgctttctaatttcctttttgatttcttcattgattcattggttattttagagtatgtttttgaattttcaatgttagtaaatttcccatatttcttttgttattgatttctaattttattccattgttgccaaacatgttttgtattatttttcatctttgagctttactttatgggctagcattcggtctatcctggagaatgtttgatgtacacttgaaaagaaaagcatagtctacagttgttggctggagttttatataaatgttatatagatatttattatattggtgtttgtacagatgctgatacacatacagtggttcacagagttccaatgttctatttccttgttatttctacctaattattctaccactttgaaagtgggatatagaagtctccagttattactgaattgtctatttctccttccacttctgtcattttttgctttattttgattttctgttgttagggtatatatgtttacaattcttatatcctactgaaggattgacgatcattattaaatgtccttctttatctctggtatcattctttgttttaaactctatcagtataaccactccaactttcttgtgattgctgtttgcatgatctgtctttcccagtcatttactttcaatctattttttatcttgtaatctaaagtgtgtcccctgaagagagcatataaatagatcttgtttttcctccccattctgacaatctctgcctttgattaggttatttaatccattcacacttactaccattgttgatatggctggattcatgtctgccatcttaatttttgttttctataagtctgatgtctttgttgtaaatctattgctttcttttgcatttagtattttcaaatgcagaatttatcttactttaatgatctttttactatctcttcttaagcaaccttagtggtggctctagggcttaccatctacatcttatcagaatcagcttcatatttatactaacataattccagtgagatatagaactgctactcctacataatgcaacttcctttctgaatttttatatttttatacctattacatctataaatgttacaaacacgttactttcctacattattacattatataattttgtatcttttactgaagctcaaagaataatatatataaaaaagggcaatgaatatgtatttatactatcttttataattcaataactatatcagtgccttttgtattataatgtggattcaagttattataatatctggggtcagttgctttcaacctgcacacttgcctttattactcaacgtgagtgagttagcaacaaattttctcagttttggtttatttgggattatgtttattttgctttcatttatgagagacttttgatcaatacagaattcatggttgatttttttttctttcagccctttaaatacagcatctcattgcatactgacctccattgttttaggtgggaagccatctgttagttttctttaaattcacttggaatttatggagtgggggttacttcttgctgtttctaaatttttttccaggtctttttccaggtccttttttccaggacatttttttccaatgtctccaacatttttactatgtgtgtatgtgtggatttcttcacgtttatcctatttggagtttgttagccttactagatatgtatattaatatttttcaataaagctgggtagtttttagcctttttaaaaaatatttctcctgcttcctcctatctttatttcccttctagtactccatcttgcaatatgttaatatttctctgagtagcatttttcttcattgttaaaaattgtttggattatataatctttactgatcaattttcaagtcattaattatttctttgccacttcaatccagggaaattttcacttcagttatttttcaacccttgaatttaaatgtttcctttgaaatagtttctatttttatgtataatgtattgatagcatttatttgctgtgttattgttatcattctcttctttactttaatcatgatttcttacttctgtgtacttataatggctaatttgaaggctttgtctgtttaactcaatatctgcttgcaatcacaggtagtttctgttgcctgttttttctcccttgtgtatgggtcagattttcctttctcttcaggtaccatacttttgtattagaaacttgacactttaggtaaagcattttagctattctgggtactcacattgggacttgtttgcttgtttgttttgtgactgtctggcttatctttgtgaattctagtccaccaccaccaccaaatgccccatttttccctcttgtggtgtgaagtttctaataatgctcctaagggaatacaaccttggctatatgccctgcaatgatagtgactttttcaggacactctttgactatctctttctttgaccatattcaatttcactaattaccagcctcttatgctcttgtttttaacaatgccctggtgcatagattgcttgaccaacagatccaatcaaattcaggattatttgaagagatagttcctgaggtcggtgtttgagatatgttttgaagttaggaggacacttcctagttgcctctattcgtggttcactccagcaaagtagccagcctacagtgcagcctgcatttccaaagaatccaccaatctccccccaattgcctttcatcattaccttcactgtttttgaaagcacccttaggtttgaacttattcacactctatgacaaattaagtcagttcctgtgggaagagatatggagctttctgttttgcagtctgtttcttcccttcgcaaaacctctgacagccttcaaactggcatggggacaatagtacagtctttctgcctgacactctaactttagttgctgagtatgggagactcaagagttttaatagattttcttgactacatatttatttatttattcattacatgatccatgtgtgcctttttaaggaacatttccagagatttgttgcccctaagaccataagaccatgtagagagacttaaacactttcttaaagcggtttttatcagtttcaccaaggagtgggtccacagagctccttatgttgaaagagaaacttttactttttaaaaaatctagctacttgtattaatgaaatgtttgtcctttttttatagcttgaatgtggctaaggccacataagcaaataattcttatatatagatattaacaagagtgatcggaatattgtgatgggttattttgatcaggttaatgatatagacaatcacaggatatatttttaaaaagtgatagagatttaaaaaaaataacaattagtggattaattaagagtatcattttctactttgtctaccacacaaaggcctaaatttagtctttaaatatagtcagtcaaatttatgataataaaatgtgctattattatataaagggaattatttatttactacttaaaaatttagaccatttaattttataattaatttctctaaaatgaatttaaaaatattactgtcctctatgcttggtagaatttctatttatttttgcctccccataagtcaccaatctcctagtttccaaactagttagtaagtttccatttgaaatatctgaaggtcaaattattatttagctatagatatccaaggattgagaaaatgtccaatcacataataaataacctgtcagaatcccaagaaggtataatagaaatgaaataagtaaaaataaatccacacacagagacagaagcctatcagaaattattataaatggttgaatttcagggaaaaatgctattacaaacatataatccctagttactcattttttttcttgattcttagatttaaagccagattccttcattatttctgacctgatatgaaacaccatctggcatgtgcgtgctaagaggattatatgtaagcaaaatagatatgttttttctccttctgactctaagactttttaaaggcgtgtagattatttaggtttgaaatgtgaaaattaaactggtaaagagaaaagacagtttctagtaatatattctttaaaattaaagcaattatacattgctttaacaatgaagtattttaattggcattctgcaatatctcttttaaattttaacatcatgactattttccttgaggattataaattaagattccctagaggaaatgataaagattttcataattatcttatgattcatacacatatcaaactgtatctcatagctcactaaatctatgttggccaaatttttcagataattatcaaatatttatcaatatccagtttcatttaacttataatacatgaaatgaatcaattatataacacatataagattgcaattcatgtttgtggttacttttcaaaatgaagaatttctgctgtttttaacatttactttaaattacataattttaaagctagtagtttacaagtcatgtggttaaaaaagaatctcatttatctatttaatgggggtctcactgtgttgcccaggctgcactcaaacttctgggctcaagcgatcttctcacctccaccttctaagtaactgggactacaggtgcccgcaccgcaccaggcaagaatctcatttttttgtctgtttgttttaagagaaagctgccatccagaaaggatatgtgacttatctcaaggcccacagctatttgatgagaagtccagggttagaatacaggtggtccaagccttggttcattctaccttggacactactgtgtttccttcacaatcctgatgaacttttgttcaaaaaatttcactttggagggtctgagaatatatatagttgcccaaacttcatgcacaccacactgtaaattgaactagattcacactttggaaagtaatcttttcctacattcttactcaaatgactatagtggctaatgtttgaattgcaaaacatttcctaaatatgcaaactaccagataaatctatgagaaacagccaaacaaactagccaatgcaaatgaaaagaatagatcataatgaaagtatccaaaaaggatctgctaaagtcaatctaccaggcatacaagtgatctaaatttctattttatatatggtataactaaaacttatatggctttatcttgacaaaattacacagaaaatagaagaaggaaggagggaggcagaaaggagaaggaggcagcaatcttgtttattggcctagtcctttgtgctggagtatattaaaaatgcaaatactaaaagcatggaacaagggcacataatggcatatatatttcacacatacctatgtgataacatttacccataatttcattaaaacaaaaagcagcaggcaaaatgagagggcacttaagatgtggaattttattaaaattttatctattctcttttatctcttgcatataagatcatatctatgttcagaattctgaatgactatgtatgccacaagaaaatataaaataaaatagtttagcaagatttttgttattgttgtcagctgtgtctgacaagaatatcaattaagatggcatttgttaagcccttgtctatgctgaactagctacagtatagagtagtttaacccatcttatcctataggctcagagaactcaattccagaatcatggagaatttctggctttgacgatgagggttattatatcatcagcttctgtgtctcactaattccagtgatgacaagatttttcatcatttatttttattttatttttacaactggtgcgtgttaggtttgtagaacacagggtagaaacagctggagttagtgttattatttttcactttgaaggaaataagaggctgacaacagtgaaggacaaagacaaagttgttgctggacatgctctggcacataggccacctcccactgcaaccagttctaaattaattatttattgttattttagttgctgtaactttctgaagtgtcctatctattgtgaatgggagtttcaactcattattgttttgtaaaacctaagactctaacttgaagagacactaaatttaatatgagtaatctgaaaacaattttagagctgtttatagtacacacacactcgcacccgcacacacactcacacacacagtacagcgctacactggctgcttcataatgccactcagacaggactacccacaaagcacactggctttgcccaaaactaatggatgtgagcaaaagtgaagctggtagatgattttgaattttgtagcgatcagtaaaatcaatcatgagagaaattaacactaagattttcagggccaaataaatactcaacctctaccattgctctggacatattaaaacactttcaaaaaatgtattcttttctgtctcaaaactcattagttctgtcatcaccaaagaagagtaaagcttcaactacctagcatcagttttttttctgtgtgtgtgtgtgtgtgtgtgttcaaaaataatttgctgtgaatggtgataatgaattaagaatagcatttagaagtactcacagtaaatttgaacatataaatttcattaagaaaatgagcaggctgtgctgaaattatacacaaaaccaatgtatatgtatgagaaaatctattctacaaaagaagggcagaacaaattttgcattagcccaaattaatttacttatatataaaatccagcagatctgattatttctttgttagagaagttttccaattttaaacattctatattgtgtttataatatgtggtcagtattactcatacatacatacactcatatacagtaatgcattgctcaacaacagggatacattctgataagtgtgttgtgagatgattttgtcattgtgagagcatcaaagagtgtacttacacaaatatagatggtatagtttactacaaacctgtatagcatgttactttactgaatactgtaggcaatggtaacttaatggtaattatttgtgtatctaaacataactaaacatagaaaaagtacagtaagaatacggtattataatcatatgggtctagagttgtatatgcagttgtcattgactgaaatgtcattatgcactgcatacgtgaatagatatggatatatatgaacacgtgtatctatatttatgtctgtagcattatttatttgtttctatgaaatttataccactatagaaatgccagaaaattaagctatctggggagaaaattactggggttaatctttagggatattgttttttcaacaattacaaaatacacttatgatcaatgaccatccttcattcccaagaaatctgtctctaagcataaagttgttaaataaaatattttgttaagtgtaacaggataaattatgatatattccgtccatgccaagataaccaaatagttttaactgatagaaaaacatgtaaaaataaatattagacaaattttatatgtattaataacaataatgcaaaagtcaatgtagtttgtacataaatgcaatgtaatgaaattttcctatctttgccaaaaggtaaaactgctttatagtgaaagatttgtggtggaggaggtgcgaaaaagagttggtctttggaaaagtcttgttgcatcctttttttctactgttgttacttcctatgggctcatacttaccttgtactaaacctgaacttaacatttttagggcaaaacaaatatttaacaaaagagtgcctcaaaacaacaaaagtagagttcatgtgcaataaactgaagtactttgtcttcattcttttacttggcaaatacacacaattcaaatttattccatatgatttctctttctagaaaatgtgacttcacataaattgatgaatgctttttttgcctgaaaccatgatgtcaaaataatacttagcatggcctagtcacttagtgtatttttggggtaaatgccattatactgaaggaaaaatttctcttacctgaaaaatggtgtatgttttcaaaagctgttatggtaaaatttcattaattaaagagttattatgtgaggtaaactgtaaagtcaaaaatactccacaaattaaaaaacaggagtagaaatcaatgccatcaaataagatagagcaataactaaactctttcaagtgaaaaacgcatataataagagaattattgtaacattgccacattttattatgactctatagattcaaacatactttaaaaccttagtttaaactttagaataagcttctgagatcaaccgatctttcttactagtcttatctcttttcattctccttgtttactttgctcatttcactttctataaagaaccattctctattcagagtaatctttatacacattactacctctgtctggaaagctaccctctccatatttactactaagtcaaagtacctcagggaagtctttcttcctctcctaccggatgagatgtgttcttaacatgtaagactattataaatattttcacaacaattaaataattactatgttataatttgtgtcttgactactattatgctgtgatcttccaggaggacaagggctaagtccctaagtctctgttgttcattgttggctgacgaattgtattaagcaaggttaaaaattctttcttctttccctttctttctttctttctttctttctttctttctttctttctttctttctttctttctttctttttctttctttctcttggtaaggtctcactgtgttgctcagactggagtaaaatcatagctcactacagccttgaacttctgggcttaagcaatcttctcacctgtgcccctagagtagctgggactataggcctgcatcaccaccatgctcagccaatttttaaaatcttttgtagagacaaggtcttactatgttgcccaggctggtctggaacttgtggcctcaagccatccacctgccttggcctcccccaaaatatgctttttaatgactgtccagttcacgttatattttctgataacattctacaaaaaactatttaataaaaataatttattagcatttgaaagagatatatcagaaaatcatgaaaagatttctgcaggaaaataatttccatattataaaattatgcatattttatgtgtgtatatgtttattattatgcatatgtatgagtgtaattgcacatatgtgtgtgtgaatgtgtgtgtgtacatatatttatatatagtcttttggtatgaaatggatggtaattttctgctatacagaaaaaaaaataaaactcatactgtgttctattccctaatagtgtctgaaggttcactttaatgtgattctgattaaagatggtcatctttattgattttcgaggaaaagtaagttgaattgatgtgaagttttgacatttctaaggaaaaaataccttgtgattgaagtatgtcagtaacagtattcaaatatcccaaagtaatcaagtcttctatgtaatgtttaacttagctaaagcctcattcggtgggtttgagagaagttgatgtgtttattggattttcctcttagtctttctgagaattcttaggaatgctttcaagacccaaagatggttggcccatcccggtttgctaaggaccacttccggttgcttttatcctctcatatccttttgcctccctcttttcctctcctatatgggataaaatgaagtgaagatctaagagtaatataagaggattaaatgaagaattgtaaaaggctaaaggagattagacattcacgctccctagaatccatctgtcttatcttctcagagacccctacatactggcccattttgtactcaatccttcaatattttggtgttttagaatccatatgtctttttaggcaaaaggctgccctgctcgaaattccttgcccacaaaatctagagtaagttagtgaaaaaaaaaaaaaagaatttaatctcttcaggggttaaaggttggcttattattattattattactattattattattatttgttttgaacttaggatgattggccatatgaccatgcatttgctttagggaagaatctcatggcactatatccagaccctggagacaaaagcaagagaatcataagagtgaaccaaatgcatctcaaaatttgtgtgattccatcttaaactacctagcgtatagcatgcactcaggactaactcaaatccctaattcagaaagcaaaaaaactaactttttaaagggcacagtctgattagaaacaccccaaatgtgttactaattagaaaacaatatttagtgtaaagtgttttatcattttactagcttagggtttcattgctctcaaaataatgaagaggtacttgtaagacaaaaaagtgctcactaaagtagcaactcccagaatgatgaatctgtctgttttagtgacaaattctaggctctattctacaagcaaaacttctttacaagctctaatgtgtcaatttccaatctccaacaattttaagttcttgactacatccagagcatcaggaagaatctgctggtcactctgaaatagcattttgtttttgctacacaaagactattcaagcttattattcatgcttgttattttgcctgaatggttgcaaaaagagagtaatttcttgaggtgtcttggcttgagttggaagacagaggggaacacactgaagatccctcaagacaatgcaagcctatgtataagaagggacttgccttaagctatgcacaggcaaagaaagaaaaaagggacatagaaaggaagtggtggggaaacaattttcagacaattccccaccctagtctggtgatccaatgacaaatgggactgtctgaagcaactctgactgaagagcaatgtcaaagtctctctgtctctctttttctttgccaggggaggatgttcgtatttgctactttgtaaagcaatatttcatgccagtgtcctttgttcttgcctataaattgagtcccagaatttcctttttgctatcttgcaagcgtaaagtgggtgtgattggggataatgtcccccactggcagtccacgctccacactaatgactcttcccttagtcagacgtgctgtgaagtgaatcattgaaggaaggttgataaagcaggaatgttttcaaatgatttttctacacacttctataaattgcctaaagatgatcattatcatctgagaatatgaagtatagctgcgtggaggaggggagaaagggcggacaggtagtccaagagggaaattatctgcatcattgagaaccaactgtcaaagcagagaaaccagagtccagggagtgtgtggggggtgcaaccacaggtcgaagaagagaagagccacacacttctcaacccccctcccactccacacctactccccagagagtgagagaaagccggaaataaagcttctgtttgtcactcctcacatcacaattccacttaactaaacaaaggcctggcaaaggcagttttaaccctaaagctcagagtgagaagtgcacctgttttagattcaacaaaatagtcccaaatgcctggaaggcatggtatctttgtggtcccccttgcctggcaagtacaggcccttctgagctacaaacctctggctatgagttctttcttctttgcctccttgggatgaaactgtcagctatggagaaaaagtaaggaaccttgtgatggactttgaaattcaacataatacctaagtagtaaagataaaagaatcctctcctccgtctcacaaacacagttgcatgaacccttgtccgtgctaattgaccaaggaatgaagtataagatagtaactacagatttaaaagaaaaaaaaattcatacactcttctccaaaagtaagtgtaagatttctgaaaattacaaacacatatactacgtgtatatttatggttcttaaactacttgaatgtatcttagcagtaaaatatcccccaataaaatattcctctccttcttgaaaacatgaaccacgcaatgctaagtgaaatatttgttacaaatatttttccagtggtttaaacactccaaatgccaaataaattgcaaggaatgaataatatttttgaaaatagttttatgtgaatgaattgtttatgcaaacatagatttaataatctgaatccaaataacaaaaaatcattccaaaatattttatcaccctatccagtttttactaacctttatgccctcagaaagttactttatttcgatgcttttctattggcagcagtaaaatctcatggaacttagaaaaggtgatgtagggggagtattctccatcttatatcattgcagtattcactttaaagcaatgtagtccttttctgtttctaccccaacatttcataattatatcattttacaagaattgtgtaatttacataaccacctaaattgtcataattgctagaaagtgctgaaaaagcatacggtaggcatttcagattcatttctgctctctgtttgaaactcattttaaatgccttttgcataaaaattcttttggtcaacaaaaaagtaacttggatttaattttgcaggaaccttctcttcttctccctctcagactgacttctcttctttcaggaagcctttctcaggtattagacctgagtactaacagggtcacctggtaaacaaacccctcctcttgatcttacagaagaagctgagaccacagaggttagctgacttgatctgagtaccacaggtcacatctgcggagccaagactagaaatcacttttatttaacttgcatgttttgttcattgtcccgcactgttctacactgcatttagaaagaggaaaaggaaaaatacaagaatggaatggtctctctacagttttctcagcatgccatttctattataattatcttaaccatctgttttgcttggaacaggcaaaagaatttgatattaagaaacaaaattcattctgtacaacagagaagggcttcagaaatgagactttatttcagaatacaagagtggatatcaattttatcagaggtttcatctgtgaagtagaatgccagtatttgaccattactgttttgaaaatcagtggctcatgtagttttgtaaataaaaatgtgcaactcaaagttattgcagcatattgtttataatatttgcttagagtgtaatgtggaaacctgaagtaaagcaccactaaacagttaagggcattggaaaatggcaacttttcccaatacccttaattgtttttctttcttgaattctgcttcaacttctctcctaaaaagctaatctatccttgcatacttaaaagacaatgtattgatgtttagctccttgaaactaatttagctgttatgtgaagctataaaacttagtggcaacatatgtgataggcataaataatggaccacctttctggtatgcttacctagtgcacgtgtgcacatatatggacgcacacactgcaaaaaacacacacatggatgcacaagacatacacgcagatacacaaaaacaatttatgctactaataattcagagttttgaaataaataagaaataagctggttcacttattttcctttctgtcaaaaattactgtaaaatatgtattttattgcaaattaagaaaaaaattgagagtgatgtacctgtcttgcagttacaggcttttcaaattacagatagtatttgaaagaaccaataatacctcaaaatcattattttaaaaaattataattattacaaattaaccaagcttcagaagaggtaaactcccaacatgaaagacagcttatcacttttgaaataagcatggaaggcagaacaattttcatagaaaaatggagagtattcattccaattaataaaaaaaaagctattatttctgccaaaaaaaaggaaaattaatagcaaaggtaggatgaaccagagaccctttcaatattgtcttctagaacataaagttattataataacactaaagaagaaaaaaaacttgaaacaacatatacattgagaaaagaacaatttttctgttcaacgagaatcaaattttttacagctgatcgatgtaatatagttctgtaattttcgtgaaataattttagaactgctgggaaatctcagctgaaggaaacaaagaaaagttcataaaattttctaaaaatcaaagtcgtgaaattttttccccctatgaattatatattagaaacaagtaattcaattccaactttctctttcctgtgatagtgaaaaagcttataaaccaacaacttaacacatgaaagccattttaattctcacaccagcacacatctcacaagaattgaaaataaatagaaaaatatgtggtgaaaacagtcgtgtagacccctaaacattttcagaatttaacattaagcacttttttttttctcgtggtgacttttctttttccctttcctaagttgtaatgtgatgtttatcctccacttaatttcttggcaatgtggtagtggatcaataaatcaatctggcatattaaccctagcaatcattttggaatgtggataaacttctttctgttattgcttaaatttgtgctcttcctgtaaatgaggttcattttataaaccacaggtaaagttccatagtccagcgttacacttgcctagcacatttctacatgaatcatttgtgatatgctactactttgtttaaaatatatacacccacaaatgtaagtatttatatgcatatatattatttatgtataaatgtgaaggtgaaattgactccactgaaacaagcaacatgggctataaatggtatgctcaatgtattcatgtttcattcttcccttcctccattcctccctttctccctctttccttccttctattacttttgacttccttctggtttgtgtattgtcctttattccttcaagagacaggctgtgaaagcgctaatatatgaggaatttattctttaatgtagtgtgttcaatccactaacgtccttgcctaggccaccaaataggcattaatgtgagagcacagtcttgagtaagtatagataatatatattttattataatattttacagttactcaaggtaattttaaaaatgccatttgaattttcattcatatataattcatgcttttattttgaatatgaatcagaaacaggcctgagagcaacaaaatagtttatgtagtagaatcaataatatgattacctaagatatgcaacaagatgctaaaatgcattgttatcttggcaccgaaaaatagatcatcttttttaatttgcctgtttaagataacataaaaaacaagacgtttgttttttatttttcttgataatctttgcagtgtttaaggaatgttaatcattcattcattcaatattaatgtaaacacaaaaagtaatcaataatcttgtccctagtagaggtgataattattaaaggccatttatattactacatatgtcactaaaacttcacaatattatttttgtattaacacattttgaatatgtctattagattggtgtttcctatatatacacccatatgacaaatatctctcgggttggtgaaaggaaaatttctctgaaactcataacccttttatcagaaataagaattaatgaaaactgtttgatatggtttggctctgtgtccccacccaaatttcatgttgaattgtaattcccatgtattgagggagggacctggtggaaggtgattggatcacggggaggatttcccccatgctttctcatgatagtgagttttcataagatctgacggtttaatagtgcttggcagtttcccccttcattctctctctttcttgctctgacatgtgaagactgtgccttgcttcttcttctgccctaactataagtttcctgaggcctccccagccatgtggaatggtgagttaattaactttcttttctttataaattatccagtctcgggtagttctttatagccgtgcaaaaacagactaatacttttgatttttttacttagtttccaggaatttccaggctacattttgggcttaacaagaataacttttcttagagtacattttctgatttaataaaaataaaacagcaatgatcgtagcaaatcattctgaaaatggtacaggacagagggttaaagttgttgtcttctgtagagagaagagaggtggacgtgaagttgaatctaggcagggtagttacaggcaatcctctctatgtgggatgtctgggtggttgaattgctgaatggttacaaatggtggaatttcatattatatctatgagtacctagtaattaatttttagatgcttattgaaatatcatgaatacaaactaaggatgttagcatgctttatatggggtcttacatttttaaaaaataatttttttatttgttgtttttactaggtcaaaaaaggatagaaacatctaaaacaatgattatgttacagtgaagaaggactttgttttgtcagcaatggagcattttccaagggagatagatgaatgcccactcccactgcctaactttgtaactgcttttgctgtttgtttcctctcattcattttgcattcgtgttaggcttgcatctgtttatgttacttgtctattattcatctacaggataactgctcagcagtcgttacttcctttcatatcttttctgcatcttttgtttccatgggttgttttggcaataaaaccaagaaaagggtacaaagcttataaaaaagtgcagttggaacatcatgtttttacagctctaagaacattattgctgatttcaaaaagtttttttaaatgttaaaatgtattcagcaaagtttaaagctcataggtatgataaatttgaaaatttgagaaaatgaaatttaaaaagtgtttccaaaacagctcgctactgtttgatcttcacatggcagtctgccttgtgcaattctctgtttactgtacattttaatacctaagtttcaagcaatgaagtcatagtaattccttacatttgtatagcacttcataattttattgtgtgattactcattcattatgtcctctaatctttctaggtagataattagcatcttcattttaggataggaaaaaagagagtaataactttgttaaatgacatgctaagatcaaaagatcaatggatctctgagcctggaatctacactaacttgatacctggtgtgggtcaggagaatcctcacaatataaagttgctccagacttcctgcaagcctaagtggtaaaataaggtttggggattttagattatgttagcatagttttatgtgtgattttaaatcattattgtgtctccaaacttattaagactctatctatctattatcaagggattgaagtttagctgggaaaggggactaatacgtatctattttaccatattacctttataaatccttaaaggaatatactttaggtcttatttttgacatgaagaaaaaattaaaaataatttgatcctgctaccttaccagccactgcgtatacgttttgtttagaaaataatggaaagaaacatgtgacaaagtggagaagataacaccatagaggcacatatatgttctgtatcttcccttatcaattacatattaccaatatatatatgcccaataagcagaaaacttttctgccaaagagatttcacttttatgtctctgttaaataatttctacattctacgtcccactgttgtaaaagaacaacccagtaatccctcaaagcctaggttccatgtaaaataaattttgtacgatcattatgtagtacttgtgaaaagtcatagaattttaaaaagcatttgatttgcacccaaaacaaccaagaagtgtcaatgtttcaataattgcataattatttttaaagttatcatctttggagtgctaaagctatcattaagtgataaataacaacataattttattttggcctgtgccatcctggactcacctaagaaaccttagttcatacttccagatcattatcagagctgtccctgtgaccatggtgtaagatgactcctaaggaaaaatgaactatgtctctctatctcctcaaccaaaaacatcagaaagtgctcccttaccttttcttccctccccaagagaaagatctttggtgaaaaaacttagtttctgccatgtgggtctccttatttacttatagtggtgagaagctacctttctactctgacatcttgctctctgttgctgtctttcagttgttgagtaatcaactcttaataagctgagtgacagtaaatggttacagtttaggaggattaataaaagttgctattaaaatatatatatttaataagcacagaggtatctgaaaatgtttatatattctccttattgaatttgtagaatctgtttaggtaatcactaagcctttagacagaatctctccaggtttccttcaatagatatgactttaatatcaagtcagctctgtccttttgttgactctcagtcataaatgccagctagaggttggaaactcaagcatcattaagaaatggtctgaaagtgacttaaattgtgttctggcctagattaagcctttcagagcaactataaatgtacggcgctttcatctaacctagccccatgggcatttaatgaaagtaagtgctcattattgttattgttatgaattataatatatactgtatataagacaaaatcacaatagaaaaaacaaccagcagcctaatttacattgagtagtccaaacatacaatttctcccacctaaaatttttaccttggaattttctttcatggctatctgtaattctataaaggtcagcaaaatactgagctgttttgaccaggcaaagaagggttaaacataaatcctaatatactataattaaatatataaatgttatgttcctaaacccaagttatacagcttaatataaaaaacgacatataagtaataacctatagcatacatacgtcaggaaattgtccttaagaaatcagctgactttaagtagcttataaatactaaataaaaatatattgcaaatgaaaagcttttttaagttgaattggaaattttttttgtaactggtttgattttacctgaaagtaggaaagcaaagtaaaatgaacaagtaaaatttatttccctaaaccccagggagtttataaatacatcatgagaacatttatgtagacacaataacagaaaaggagaacattagagatacaatatgcaaattatgggagaaaatattaagaaaaacagttttactaacattataacatgactgaaaattaatgattaaataagaaaatatctcacaataaattatttttagaagcagagacaattaattgggataacaagacaaattgcatcaagatatatacacacacacacatatagatatatacacacacacatatacacacacacacacacacacacacacacacatatatatatacacaaaagtgacctaatttatacatttcaacacatttatattgaaaggtcaatatggagcaaatcaactttatttaatttatatttattaggcagatgatgcctgaagaatgcagaaaccttagccattttgatttgattctttcagtccctgacctgcctacaggctgacataattttccttcacagagaccagtctccagtggttaccaatcttgatcttccagtgtagactgagttctctttgaattactggagcagggtgtatgcgaggttggataaatcagccaaaccgaaaggccctgcagggcaaagaagcagtagggcacctgtccttacattgtcctgaaagtgacctcctgtgtgactttctgtgaggtaagaggtcattctgcctctactttggcttagcttatgtcactcacagtaaaggtcacaaatcctgacagctttcggtgcttgagactcagattactgcgtgtctgagaaggagcggagagctgtgagacctgcttctcttaggaatctaggtcagaattcattcagtaatgccacccaggcccttcaaagcaatatcttacattgtagaaatgctttgagcaaatcctgacggttgttcataaattatattacaacctgaagggagaaaaagttattctgtcccttttttgactccagcttcttataagataagtcataaaatttaattggtgtcctcagagcaaggtcatagttcttaaattcacctatacccttcataacctccaagtcaataataataactgaagataatgttagtgccactaaatttgatgaaagtgtcggcagcagttaatgtacaagaaacccatccaaatatatgaaggctgttttttttttttttaaagtatgtgacgctttctgagtgtctctgaaatactgtaaatgtttggaatttggactttatataaataggaagcatatgcacatttgttaacagaggtgacagtatgaagattggagattggaaaagggtaagatagagggagagaataatcttttaagaaagcaagttcagacattaaatgtaaataaatggaaaagtctatgaggaaatgctgtaagcctatttttaggtaatttacctttcctatacaaaaagagaggtaggaaaagaaaaaaaaatagaaaaggggagactgaagtgaacacttgcttattgctttgaggttgtataaatgttgccaaaactatgcccaatgcctacttaagtgtgggaaacagagttgacacttaaagaattgtgcagtggtgactctggagtctagaagcctgttgctagtgtgaatggaactgaactcatttcctttaagggaaaggccaaagacagtgagtaagtgataaaaacttgtggtgagaatcaagcaatgcggagacattaaaaaattcctagaaccatatagatgctaacatattagattttgataatgaataactaattcaaatatcctgattctttttaaaaatcaaagtaatgtgttgcatccacctaagacactattagaaatataggagctatacttttataccttggcatggcatttcactttccaaagcaaatatgtgagactgtctctttttaaatgtttcattcagggataaaatatgatgtttggattatctccttaacccactgcatccaataaataaaaatctctcctcttaatattacctctattctctcagtaagactgatgataattcaatcttctttgactgtaatctctctttccaattcatctacaatattgtcagatcttgcttcaaaatgaccccagctttgttttttctatttctacagccattgtcgtaacttgaaactaaattgggatccatgataactgatttattgtaccatctttgctatttgatgttggtcaaatcacctaacttgagtaaaatgaaggagtggaagacctctaaatctaaatctaaatttctcttattgatattttccttctatgaaatacagtgttatgagagattctgagagagagagacagagagagagagagagggagagagagagagatcaatttaccttccaggtgcttattatcacataaggggaataaggcggcttctgacagagtgattagggaagacataaaaaggagatcgaaagtggactaggccttgaataaagtgcagaatattaacaagtcagaggaaagggcagtaagattaaaccaccgttgctcttgtcaaatgttttctcaaaatttattctttcataagagcctttagctcaatgacactgttatagactgaatgcttgcgttcttcccaaattcatctgttaaacctgatcctcaacgtgatattagaagagggtgctggccgggcgcggtggctcacgcctgtaatcccagcactttgggaggctgaggtgggcggatcacaaggtcaggagatcaagatcatcctggctaacacggtgaaaccccgtctctactaaaagtacaaaaagaaaaaaaaagaaaaacagcagggcgtggtggcatgtgcctgtaatctcagctactggggaggctgaggcaggggaatcgcttgaatctgggaggcgcgggttgcagtgagctgagatcacgccactgcaatccagcctgggtgacagagtgagactctgtctcaaaaaaaaaaaaaaaaaaaaaaaaggggtgcctttgggagttgattaggtcatgagggtagagccctcatgagggtgactggtccctttccagagagtttccttggccctctcacatgtgagggcacagagaaaagacagctctcttctctatgaaaagtggtccctcactagacaccaaatatattggactttctagcctccagaactgtgagaagtaaatttctgttatctgtaagccacccagtctatactatttttgttataacagcccaaatagactaagacagtaatgaagttcaggcaactcttcttaccccatggctctcattacttctgttcttcatatcacatatgcgggagagtcatgtatgcagtactttttgaatggaaggaaaattgagattcatgaagatgtcatgagtaaatctccccaaatctgaaactaatttagcctccagatttactgtatattagggaaatgtgcatatgtacacatacacacacacacacacacgcacaaaacacacactgtgctaaactttaagaataataagagaaaagactactggctaaaaataaatgtcctactgaaaagtgtactaaaatcccatatttaattatgattatttaacagtgatatcaggtaaggatgatgtacatttgaatgtaattgattaaacaaaaatacagaaagcatttttaattaaatataccctattgggaaaagtactcaaaaactaaaagaatggagctgaataagccaggtaagcatcggaaaagggatatcacagaggtagattctagccaagaggtatggagcctgtctccaagcagcctccaacattcaaatattgtgggttccttggcaagactaatggtataatgggtaagagtgcttcaggctattttaattaaaggacaagtttaccaagaaaaattataataattttttttcctccatttaacatgatttctgccaggcgagacggctgacgcctgtaatcctagcactttgggaggccgaggtgagtggatcacctgaggtgaggagtgcgagatcagcctggccaacatggtgaaaccccgtctctactaaaaatacaaaaattagctgggcatggtggtgtgcgcctgtagtcccagctactcgagaggttgaggcaggagaattgcttgaacccatgaggtggaggttgcagtgagccaagatcatgccactacacgccagcctgggcaaaaagtgagatcctgtctcaaaaaacaaaaacaaaaacaaaagaacagaaaacatgctttcatgacgagaatgtgctggctagattggactgaaaatagaattatttgacagttatttcaagttgcacataggaattggcattctggttacaaattagctttctatatggaaaggagccttaataggggacatttctgtactggtttgtctgcaatgttcatgaaagcttcatttagcctaggtttctctatatattactgcttgaatgggttttctttatcagtatattatataaaataaaatctacatatattggctaataacttttgagtggtgattgtttgacagatgttgcttgacatgcttcacatctaatctgtaacaggactttatgttatctgttttaaaatgaatgtaattttatagccaaagggactgaggaatagaaatgttaagtactttgcctaatatcacacagctggtaagtgaaggagcccaaattcaaaagaagataatctagcttctgaacccacattcttaacccctgtggcaaacggcttgtcagattgggctgacaatacttaaatccatcttccgtgctgagaataccatatatgatttgctataaactaagtaacaaattataaagaatatactctgtaagtttggaaatcatactcaattttgttgttgttgttggctaagaaactttgggtaactttagcaaatgtggctcagagattagtcccctgatttatttatcacccctccagctttattgaggtataaatattgtatatattggaggtgtacaacatgatgttttgatgtacatgcaaattgtgaaatgattaccacaatctaattaacatatcatctcacattgttaccttttgtgtgtgtgtgtgttgcaagatctattctcagcaaatttgaagtttacaaaacactattattaactatactgctgtatattattaatgacactgcaatacatactttatattagatcttcagaatatattcatcctgcaaaactaaagctttgtaccctttttaaaacataatatcctaatttccccaactgctagtcactggcaatgatctttctatttcctatttctagaagtctgctgttgttgttttttaagattgcacatataagtgagatcatgcagtatttgtctttctgtgtctagcttattaacttagcacaatgtcctctaggtacatgtgtattgtcacaaatgacaaaatttccttctttttaaggctgaaaaatattccactgtgtgtgtatatgtgtgttaatgtgtgcatgtagcacatttctttatctatccatgaacacaaatactaaggttggtttcatattttggctattctgaataatgcggcaatgaacatgagagtacagatatttcttcaacacattgagctcattttcttatatgtacccagcatttagattgctggatcataggcagttctgtttttaattttgtgagaaacttccatacatttttccataatggctgtgccaatttacattcccaggagcagggtacaagtgttcccctttctccatatcttctccaacatttatctttagtctttttgatcatagccattctaaaaggtgtgaggtgatatctcattgtgattttgatttgcattttcctgataataagtgatgttgagcatttcttcgcatatcttttggccatttgtatgtctccttttgcaaaatgtctattcaggtctttgcaaattttttaatctggttattttttttcttgctacttagttgttaggttccttatatatttttactattaactctttatcagacgcataatttacaaatattttcttccattttgtaggttgtctctttatgcctttgattatttcttttgctgtgcagagatttttagtttgatgcaatatcacttgtctatttttgtttttgtcgcccgtacttttgggattatagccaaaaaacaaatcattgcatagactaatgacgagtagcttttcctgatgttttcttctagcagtttctagttaaaggttttatgtttaaaattttaatccattttaggttgattttttttatatgttgtgaaataggagttcgattctattcttcaggatgtggatgtccaggtttcccaacaccatttgttgaggagactatgatttcctgattatgtgttcttggcacctatgtgaaagatcaattgaccacaaatgagtggatttatttctgggctattttgtttcattggttgacatgtctgtttttatgccagtactatactgttttgattactatacctttgtagtatattttgaaatcaagtagtgtgatacatcaatgcctcaatattctacttgtacaagattgctttggctatttggggtcttttgttgttccatataagttttaggattgtgttttctatttctgtgaaaaatgccattggaattttggtaggaattacattgaatctgtagatagctttgtatgtagtatggacattttaacaatattaattcttacgattcaagaacatggatatttttccatttattcatgtcttcttgaatttcttttatcactgctttgtagttttcagtgtataaatattttaccacttttgactttgttcctaaatattttattttttgatgctattttaaatggaattgttttttaaaattctttttctgtagttccttttcagtttatagaagtgcaactaacttttgtgtgttcattatgtatactgcaatactattcaattcatttttaattctaacagtttttggtatagtctggagttttctgtatataagattatgtcgtctgcaaagataccattttacttctttcttttcaatgtgaatgacttttattttgttcttagctaattgctctgattaggagttcctatatgtaccatattgaaaacaagtgttgagagagagcagtcttgactcattcctgattttaggagaaaagctttcaacttttcactgttgagtgtgttggctttgggtctctcttgtatggcgtttattacgttaatgaatgtacattccttctatacctaatttggtgagcgtctttattacaaaaatatgttaattctttttcacatgttttttcagcatctatttaggggatcacatggtttttgtacatcattctggaaatgtggtatatcacacttattgatttgtgtatgatgaagcatccttacatccttggaataaatcccacttaatcatagtgtatgacccttttaatgtgctgctgaatttggtttgctagtatattgtggagtttttgcatctatgttcatcaggaatatgggcctctaattttcttttcttgtagtgtttttatctggctttgttgtcagtgtaatcctggccttgcaaaattagtcgggaggtattccttcttcttcttccattttttgaagagtttaggaagcactggcattctttttaaatgtttagtagaattcaccagtgaagccatcagttcctagacttttctttgttgggaggttttgattactgattcaatctccttactcattattggtctgttcgaattttctattactttatcatttagttttggtagagtgtgtgttcctagaaatttaaccattttttcaaggttatctaatttgtcaacatataattgttcattatagcctcttatgatcctttgaatttctgtggtaacagttgtactgtctttgctttcatttctggttttaattggatcttctcttttttatcctagtctaattaaaggtttgtaattttttttatctttccaaaacaccaactcataatttcatcactttttaaaatcattttctcatgtttatttcatttatttttgctctgacatttattatttccctccttctgctaattttgggtttaatttgctcctcattttttagcttcttgaagtagaacatcaggttgtttattcaaaatctttttcctttcttttctttttctattttattttgttgagagagtcttgttacattacccaggctggagtgcagtcgtgcaatcatgggtcactacagcctcaacctcctgcattcaatggatcctcctgcctcagcctcccaagtagctgggactacaggtgtgggctaccacacttggctatatatatatatattttttttttttttttggtagaaatgcggtttcaccatgttgcctaggctggtcttgaattcctgggctcaagcaatctgcctgccttagcctcccaaagtgctgggattacagacatgagccaccatgcctggtttcttttcttaatgtaaggatttattaaatttccatcttagaactgcttttgccgtatcacatgggtttcagtaggttttgtttccatttttatttgtctcaatatattctttaatttacattttaattttggcttttatccaatggttgttcaggagtatgttgtttagtttcctcatatttttaattttccaatattcttcctgttattgacttctagtttcatgccatttcggtcagaaaatatatctaatattatgtcaatcttcttaaatgtgttaaaatgtgtgaactaacatatatattctggagaatattctgtgtgcccttgaacagaatgtgcattctgctgtgttggatggaatgttctttatatgtttcttgtgttcatttggtcagtagtgttgtagaagcccactgtttccttattgattttctgtctgtgtgaagataatggggtattgaagtcccctaccgttattgcattgtggtttatttctcctttcagttcagtaaatatttgctttatatatttaggtgtgccaatatttggtgcgtatatgcatacagtttttatatcctcttgatgaattgactccattatcataatgtaataaccttctttgtctattgtgacaggtttggacttaaaatctatttcatcttatgtaagcagagccaccctgctcttttttattattatttgcaggaaatatctcttgatttctgtaaactttcaatctatgtgtgtccttcaagctaaagtgagtctcttttaggaggtgtatagctggatactgtatttttatccattcagcccctctaggtcttttgactggaaactttaatctactcaaatttaatgtaattgttactaggacaggacttcccactgttattttgttgttttctgactgctttgcatttctttctttctttttttcctctgactgtattacttctgaattgatggctttttgtgctgctatactgtgattcatttctcttttgtgtatctactacagattttctttttggttatctggggatgatttaaaatatcttataattagaatagtcttttttaaagctgataactttgactatagataataattctacacttttacttctcccacattttatgttattgatgtcactatttacattttttatattatgtatccattcacaaattactgtagctatgggtttttaaagttttgtttgtctattaacttttagaccagattaaaaataatttatatactatcactacagtattagagtctgctgaatttgatgatatttttacctttatagggagttttattttttactttcgtatgcttttatgttaattagccttcttttgtttcaacttaagaactctagcttttcttttaagttaggtctgatagtgatcaatttcctagctttcgtttgtctggggaagtatttttcctttattactgaagaacagccttgttaggtattatacttctagttggtctgctttcttttatcttttgtttttatctcatttgatatgtcacatctcctttcctggcctgcaaggtttctgttgaaaaatgcactgaatgtcttacagagatttcctttgtgtaacaattcactcttctcttgtcactttcacaattaattgtctttgacttttgaaaacttgattataatgtatctccatgaagatctttatgtttaatctatttggattatttgggcttcatggattgggatgttcattttcctctccaggttgggaagttttctgtcattatttctttaaataagctttttgccctttctcttgctctactcattctgaatcttgtataatgcatatttggctttcttgatggtgtcccataagtcctgtaggcttctttcaggttttttattcttcttacccagatcaagtctgctgttgaaattttacccagatcaagtctgctgttgaacccttgtggctcattgagtttctttaagatgaatatttaaaattcttttgtcaggcagcttgtagttaccaatttccttagggttggttactggtgctttactttgatactttgatactatcatgttttcctgattattcgtgattttatggctttgcttgatgtctgcttatttaaagaaatggcagctctttcagtcctcatagactactcaggaagggaaaactcttcacaagtcagcctatccagagattctggatgaggttcaggggcaggctggatgttagaatactccaacaggctggcttggtgcctgggtcagtgggtaaacattgctggcacctgggcccacagggctcaaccaggcgccaggctccacagaaacaggccttgtccctaggccttgtctcaaggcctgaagccttggaccgtggggcaggtatgcctctggaatgggcttagaacttaggtccatggggtttaactggagcttgggtacacaggagcaagtctggggccagagtccactggcattggcatggttctgtggttgacagaaagtggagtactcgtttcactcttctttcccatgtggaggatatctctctccatgttgtgctatatgggcttggacaaactagtgttgcgtgtaaggggaaaatgttctttctgccctctttaatgtatgtttgttctcttatttctgtgttccactcaggtgctataatctgtcatccagattccttagctcttgtgaagatatctttgcatgtaaatgattgtttaaattcatttttttttttttagagggggagtctcgctgtgtcacccaggctggagtgcagtggtgcaatcttggctcactgcaacctccgcctcccgggttcaagcgattctcctgtctcagcctcccaagtagctgcgactacaagtgtgtgccaccatgctgcactgatttttgtatttttagtagagacggggtttcaccatattggccaggctggtctcgaactcctgacctcgtgatccgcccgcctcagcctcctaaatgctgggattataggcatgagccaccaaactcggccacttaaattgatttgtatgtgagggcaagagtgctgccaactcctattctgccgtcttgctgtcacttgaggagtcccctgatttccctatatgtgatctcctctacatctccagctgtctggcccaggctattagcactatattgtctaacaattcgttaagggccctattgcctaatcttaataattgaatattaacatctgaaataactacagcttcctatccctctatccttattgctattatgtctgaaatctctctggcattaagtttatcttaccctcagggggattagatttttgaatactgcgatgtaaatgaaattttaaaatacattcaattaaaatattgttatacttgaagttgaaaactaaaatgacctctttactttttattatcctctcagaaatatgcatctcctctgtgttagacttctgtcagactgcatctatggggcttctcttgtatgtgtccatttgtctcccaaatatacagtatgtgcctttggtttaggtactacttgccagtatcagttatgactaggttaataagatcatattaaaatgaatgatagtttatgctcagaaaacaaagtatgcctaggttataaaggttatgtgttatttataactgtccaatgcaactaataaacatttccctgacattaagctgtttagactcaatattatgtgggtctcacttttgctgatacaaacttgtgaagacgaagagaaagaaggagtgagaggtacaaaagaagaagtaggaggggactatattctatagatgaaaattttcgatctagaggaacaagtagcttttctgaggctacagaaccaagagaaaggaccaagatttgagttgaaagcattgtacctgccttatactctcttgctacatccggaagagatttcagattatttttatcatgctttcttcacatcctcaatccaacctcaatgaaagtattcagccatttgttgagggtgcaggaagatatacacagctagtgaattactggacaaaatgaatctatttctctgatcttgatatcacatgatagaacatagaatttatcctcattaatgaggaagggtgctatttaaaatggaccacagaatatagaatcagatgattgcatttgagtttcaactcagatatacactagataaaatgttagttacatcacccagcaaccctgaatcttactcagtttaaccatatgcatgttaattagcattgatctattttaaactgttgtaatatatattggaaagtacttctctatatattttatcaaccctacatatacatacatagagtactttatatatttcaattattatttctagccacttctagttacctaaaaatctttctttctgtgcaaaattgtgtctctgtttgttttcctccatagcaaatgcagcagtgtgtgatcaagtatattctaaaagtaaaataagaaataaaaaatagaacccatctgagatttttcctctttaccccatcttcagcccttccataataccttgtaaggaattttcttaccatgagtattcacaaattcggattcattccctagagttaacaatgtccctagcactgggtagtgtaaacaactgggtttttcttttaaacgtggcaaggcaccagtagaagttggaggaagtcccacattcaattcattatagtaacgatataaaaaattcacaaaattttaaagtaaataataagttatgaaaaaaagacaaatgggcacgacaatgtgaagaagtctgaatctgttgtcagaacaaagcaactttcttaaaactgttctccattgcctgggtaagaagtatttgtaatcaaccagcttgaaaactcctcttgaaagaagatgtaaacttgaaacaaaaatgaaaacattcccatttaagccttggaaaaaataaaataatttagttagaggtgttttagtgattaaatattttaatattaatcaccctcctattgctactacacataatgcaatcagcagagtcaatatgtgtatactcttatgatgataaagatcaagacatagaattcaattaaagacatttcactctacttgcagcatctcccttggcccctaattaagtgggaagaaagaaaaaaagaataagaattcttgaaatcttttcagagcactgtgaaacacgaagcacatccagagattacttggtcacctgtatgttgttgcaaaagtaagaataaataacaaggttaaaataatgcccttgctaaagactttcacgtgtaaaaaataatataatgcatacctactcctagatcctgaacttaatgttaattctctctattgattcattcaccagagtttgtaaaaaagcccttcatctttattacactgtcttctcatctcttttttttttttctcctcttctccgtgcagctaagcttttagtatggttatttgcacttttttcttcactttctcaccttccatttcactgttctgtaaactgcaatcaggctttgagcatgtgctccaaccccaacaaacctgtcgcagcaaagatcactgaggtcctattaagtgtgagacacagtgcacatatttctgtcctatattcttgacctttctgaagctcatgaaataattctatgtgccagaaacccttatttctagctttttaaggtagtgttctcttatgattctcctcattctttattaatcattctgtctaaatactggccaagttttgtctatttcattagactttgaaagaactagcttgtttgttttatttgcttatctattgaatctttgctttttactgaatcagtttttacttttatctctcatattatcttcctcttccacatactctgcattactgccattttcctaaatttctgagttgatctcttagctcatttatttttatgctttcttctttcctgggacttctttcttagtactttcttcttttctagtacttgtattatagtcatattgatttctcagctcattaatttttaatcttttttgtagtacttttataattttccctttaaataccacttgaaagcctctcttaaagttaatctacagtattttatttttatttccattctaaaataaatattttatttatttatttcattttgatagtttagaatttccaaatgtatgaatacttgaagtgctattttttgtattttataaaaaatattttaagtgggaaaatgaaatgatctgttttacatgttttaaaagattactcaggttgttatgatagttaatggaatatagccagagtggatattttgaaaataaattggaggttattgcatagtttgagagattaggatactcagtaaaggcagaagagatgtagacagattcaaatatgcattgaaggtataatggacaaaataaatagtagcatcaagaataacattaaagagaaaagtgaggaaagggtgagcaagggccagggccaataagcttctccttggtttttctatatgtatctcttctaattaaattatgagaataactcagctgggcacggtggtttacatctgtaatcctggtactttgggaggttgaggtgggagaattgctggagcccagaagtttgagaccagcatgggcatcatagtgagatcctatctctaaaaacaaacaaaatcaccaggaatggtggcatactcttgaagttctagctattggggtggctgaggtgggaggattaattgaacacaggaattcaaggttacagtgagctatgatcttgccaatggactctagcctgggtgacagattttttattctgtcatttattagaataaaataaaaaaatttattctgttactagaatagaattttattctaatttttttaaaaaattagaataactcatattagttctaggctttctgttacctgaacacgaaatgcatttacgatttctaccctcaacaaaacacagacatttttattagcttggaaaacagactgtaagtggtgtcaatacaaaagaatgccattctttatttggaagagtctctgagtagcataaccaaataaaccaacggactatgatgtgtgatatggtttggctgtgtccccactcaaatctcatcttgaattgtagttcccataatccccatgtatcctgggaggcacatggtgggaggtaattgaatcatagaggctgttacccccatgctgttctcgtgatagtgagttctcatgagatctgatggcttcatactgggctttttcccctttgcttggcagttctctttcctgcacccctgtgaagaggtgtcttccatcatgattataattttcctgaggcctccacagccacgtggaactatgagtctattaaaccttttatttacttatttttttgagatggagtttggctcttgttgcccaggctggagtgcaatggcacgatttcagctgactgcaacctccgcctcccgggttcaagcaattctcctgtctcagcctcccaagtagctgggattacaggtgcccaccaccatgctcggctaatttttgtattttttaacagagatggggtttcaccatgttggctaggctggtcctgaactcctgacctcaggtaatccacttgcctcggcctcccaaagtgctgggattgcaggcgtgagccaatcaatgtgtctggcctaaaccctttttctttataagttacccagtctcaggtatttcttcatagcagtgtgagaatggactaataaaatgagtaaaagttgacatatttaacagaaaaatttcttctaactgtgaaagggattaatataagttttattcaacattcacatttttgtagaacagtacgactttgtgataccatgtattcaagtatggttgaatttaatttttaaaggattaccagaataagaagactgtgtgttaagaatagaggtaatcatgcttggagaaggtattttggatgagaagaatatagattagttttgtttgtacattataactttttaaagttaagagccagtaaatagtctggattaaacactttttagatttgttgactaggagaataattaaagacatgttttcaaagactacagatgaaatttataaacagctgaaattagggggaaatgcaacaggatattctctgccactttgtcctatagcttccttgcataatccaagaacatttaatcagttcaaatttgcctgaatggaagagaacaagaattgctagagggtgaaaggaatgggagggaacaaccccagagacagcaaatgcagctgcagctctccaatggcaacaagtgttatggaaatacgcataagcacaatcaagtctatgtacagcaggaacttggtctttggtgcaaaaaggaacagacttttcacagttgatttaatttgtctatgttataaatggaatagtaatcatataaaggaataaaaaagaatccatagccctagggtacgtgtgttgcttcaactgtgcctatccctcaaaaacatgtaattcttcctaggaaaatctgcagcttttgaattattattggggggcactttttttcaaaacaggaaaattttgactcttaaagcctgatttaagtcctgctctaatttgtaatgtagatttcagatggctttgtctatgaaatttgttcaatagattcaaagcaaccattctatacagtgtaactttccttgttgaacatggtttaaaaaaaagccttgaacactcatctctgtctctcctagtatagagaacagattcacaaatgggcattgactgtctctgtcctacttaatgagtttcttcatagaaaggcaaaaggtgaatacaacacaaagacgatagtgcaattatgtgtagaaattgttgacataaaaaagcctattttatatatttatgagcaaaaattatgtaaaaatgcaatactggcaaattaacaaggtctattaagttaacctcaattaaatctttcgtgttcattcaaaatatagtaaattctcatctagtaaagtttctctctctctctctctctctctctctctatatatatatatatatatatggttttgttttgttataagacggagtcttgctctgtcacgcaggctggagtgcggtggcgtgatctcggctcactgcaacttctgcatcccggcttcaagtcattctcctgcctcagcctcccatgtagctgggattataggcgtgagccaccacatccggctaatttttgtatttttagtagagacgggttttgccatgttggccaggatggtcttgaactcctggcctcaggtgatccacccacctcagcctcccaaggtgctgagattacaggcgtgagccaccgtgcccagccaaagtcaatgtatttcaaatgttcattgtcattgcgtttgccttgtaactatagatcacgggtggtgcccagtgggtagctatggggttctcttttctggttcgtaataggaatgtctgacattgtcattgaaacattaaaattataggaatgttttattgtttgctaccatttctctttttacctctgatccaatattaaatggtgttcctcaatttcacaagcatgttatgtaaaataaatacatttcaaattgttgagcacttttatcttctgggtttgaaattattcatgtcctgactttgaaactttattgcagattaaaaacaaattaaaacacatatacatccctacatatgtgtacacacacacacacacacatgaacacacacacacacacacacacacacacagttgaatttgcttaggaaagaaatccatcaaaataaataattcatgttgggatggactgaaatctagtcttttaggaggtgccaacagatggtttacatttatagaatgcacacttgctgacttccaaacagaaatgaaaattcataaagtatatcattaggactccttataagcagcattatgattatggtatgaatttggattttcccaggtgaagagttttccatcataattttactaagaaaaagtgaaacaaattactttccagttactatcttgtgttagcatgtttgaaatcaaaccctgctgctgatcatccagcagcacatgccaataaactcagacctcaataaggctgttgttctcatgatgatcatcattttataagaagtcttgggcatttttaatcctttaaataataggcattattgcaactaataaaataaggcagtttctttagctttcacttcctattacatcagttaggttaggaactttctatcggtataattaggggtgagacctcagcttattaaagttcaggcaacaaggcacttttagttaattttagcaacccttttggtttaagtagagctacttaataccgtgggataatagtaacattttatttttagtaaatgttgctgctcaccaaaatgttaacatttatatcaggtaaggttataattaaaacttgttttacatctacaaaaagctaattcattgctcatgaagattttgtctacacagtacaaagtaaagtggattatgattggttatacatttaacgaaatcaaagagtcatgaaaatcacttaaaaccaaaacacgcctgagattttattcactaagtgtgtctagtagctcacttgatcaaattagctgaataaatgacaaaccctatccagaatggtagtatttacaatatggagaatataagaaaacataaaaaaattaattgggcaattgctagattttcttaatgatattttaaccggtctaaattatgcaggcaattgttttcagtctctttttcaacatgttgggttgcccactaccaaaataatttagacaaatattacggtgggaaaaatctgtcatttcagtgaaaaaaaaaaagccaaactataaatgttttgtatcatagaaataaaataactagtgttttaggctgaatttgttgtttttaaatcaatgattttaataatgtataggtggcctcttcatatttttatgcagaaatacctaagtgttggcatagatcattccaagcaaatacaatattctccgtctgtaaactttagatatcatatactgtacagtgaaggatgagtgaggaacagaacttttagacacatttattcaacaaaaacacctaaagttgatatttttgcctttccagtgattgacttgatatcctcaattaggggaaaaactagatattatatttggattcaattaatccataatccattcaatatatagtctatacatgactaaatataaaataagattgagcagcactttcttgcttaaaatggatataggaaagaaacaaaaacatagtttatatagatataatttgtgacgttttaacagaggtaaaataatctggtgatatttttgaattttatatggtagaattcaatattttaatctgtcagcctgattcttttacgactagacacaatattccaaaagcttacattccatatttttcttggaaagcaattggcattaaatgtcattaagaacacaaagcagaaataaattcttccatgtacaactcctcaattaaataccttaacagcaagtcatgataatacgattatgcatagtgaaatgtgctatacgcactgcagaagactttgaatgaatcctgggttgtgtggtgaataatcaagaagatgtatttatcctatcttgtcttaggttaggagaaagtataagtaaggcagaggggtcctctggaatataggagcttccaagataatgacgtatcagttgaatttgcagcctaaaaaaggaaacccagtagtccaatggtcttgggtagaaagagtttagcataattgagcccacgtagaatttacgttgtagaatggatggtactgtggtttgaatgtttatgtcccctcaaaattcatatgttaaatgtgatagcattaagaggtggtgcctttaggaggtaattaggtcatgagggtaggacttccataaaagagattaatttttttataagagacacccaggggaccttgcttgccccttctactttgtgaggacacaatgaaaagaagctgtgtctgagtgagagtgagagcacaggtcctcttcagacattgaatctgcctgggccttgttctcagactttccagcctccagaactgtgagaaataaattatgctgtttaaaagccacccagtatgtgatattttgttacagcagcctaaacaaactgacacagatgggacccaaatgtagttactgttcctagaagaatagcttggaagatttctgagctcagagccaggcatctttctcagggctattgcaaaggccagtccaagaggatgaaggggcaagatagggagtgcatgtggaatgataaactcagaattagggccaaaccagctccaactaatcagaccactttaaagtagaatcagactgcagcttagaacactaactgggccagcagcagtaaactgaacaagggtcattgcccagggaaccaagaaaatcagaagacgttttattaaacaaatcattcccaccaagaggtagcttgggccacaattctcccattacacatcaaggaagattccttccttccttggaaggaatctgaggactaagatgggtagttaacatcctgaagggctgcacattctatcttagaaatactatgcattatgtaaagggattcattaagaattggaataaacatgttttaaagtaggtaggactatatcttgtttttcttccccactactcagcaaatggaggtaaattcaactagattaattattgataacataaaccgttttctatgtgcccgagtaaactgtgagtttgcaaccctacaacagcaggtagtattactacgattgtcatcacctttttcattgtattgtcttacagtttcctttcaggctagtatttctaatacactatagctatagctctctttaaaatattttggtggatacataatgatgagatgaacctttgctttttaaaacctatttatctccctaagctcatctattgcaattttgccccaacccacaactcattttccagccaacttttagattgctattcctgaagtatgccattttctcttttgcctctgggtttctgtacatgacatgctctccttacatgctatgcatggctaaatcctgcatatctgttaggaatcagttcagatattaccttttccaaaaatctccctaatttatggtggccaccttcagaagagcaacattctttcttgctcttgaggactcctcagaaccaaggttgagaaatgatcatttttgagaacattgtagattcataaagttaaaggcaagatcttcctaatctgagaactccactgtcctaagaattgctacttgaggtttctttatcccttaggcaaatcattttttattgtatttgtctctttggctaaaggaatcctttatgttatatgccacttcacacactggaggtttacactgaaacatgagagttaagtctccaagtaatgctgattatttattcttaatgtatagcaaggcttctgtatgagcagagtcctggcatttagaaaaaaatcttttgcggaaatatcaagatttttgtaatagggagagcctctgtggtttgaagtttgtagagggagtgcagttctatttttgaaatgtatccaggacttccaacaggtagagtcacagagctccatgtgatcaaatcagattcatcatgaattgccagtagtaagatgagggacttaatggtatgaaatagacattggtagatgacagtggattgactgttatatgttctgttctttattgtatgatgacatatccaggtgaagcagagaaacaggaaaagataattcacagctcttcttaggattaatgcatttttatcagaaatttatctgaaatagccaaaccacacgctttcaggttggccctgatttctatattaaataggccctaaagacaaatgaaaacaaccgcttctggggacctcagtagcctgattgtgacacacataggcatgcctctgttgctttgtttttttaggcagaggtcctaagagaatattgttaagtcctgaccataattaaatatctcacccacagtagaggctccactcatgagtactagagattattaatgaacagggcctaaaccttaagaaagtcaagcaacttctatttttgcaatttttagatctatgagttgccatataagaagtctggctgttctacacagtgccttttagagaagtcatgtggagaatgatagtccctgagacaacacagaaagaaagagaggtcaaggtgtgcaagcatcccagtataggtggcagctatgtagatgagacatcttggatatttcagcccatttgtgcacccagataaccacagccacagccaacatcactagaagcagaaaagctgccaaatttggcccaataaatgcacaaaatcatgagaaaaatgggggttgttgttttaaactactaaaatgtgtgaagggttgtcatacagtaataaataactgaaacaaagactttaccagaagtagggctttgctgtaacataaataaaaaatatatggcatttgctttgtgatggacactggcagaatctgtaaggactttaagtagactgtcagtaaaagctggagggacttcttttttcaggtttctgtccccgccccacccaaatttatgcaacagcatcttaatcttcctgtctccaatccggagatcatttttttttttttcacctaaaaacaagtctaaaacattcagagacactcactaaacactaaacaatatttttcagtttcatacagagggcttcagggtttggctcgggcttacttctctgatcctactggttagcatacactttctcaatttggactgctgtcttttctcttgcattcttttttttttttttttttttgcttagtagtctcattcagatattacccatcttaacattaactagccatgcttttctgctactctcccgtactgtgctaattgctccagctagcacatttccccctaatcctgtgacagtttcatattatcttctttctattgtgtcttctacatcccttccttggccaggctaattcccacatgcccttctggtacttcttttggaaaacctttacccacttctctaagaccgagttagatgacttcttcatatattccatagtatctcatccttgctctaataattacatttttttaagctatggtataactacctgttcatatctgcctttcccttagattctcagaatattgaaggcaagaactgtgtctgtttttcaatataccctcatggttgacaacagtatctggcacataggaggttctttatcaatatattttaaatgaatgaattaaaaatgaatagatgattgggccaagtacttgtgtacttttttccaaataccatgcttattctggcaaagtaaacatatataaaacaatttccaaattggggtgtttatgtgaattttagtttgtttcttatctttactgcaagggggttatatagtaagaacagtggcgaaagagggtagcctattttgtttttgaagcatcctcttgcccctgccccagactaagtcggtaaatgctactgagtgcatgttagtgctacataaaaggcaaccttttctgtggcggcctgttccctgtgctcgttcaattgttatttttataaggcaaatagctatcagtgtgtagagaagccatcaagctcttatagctggttttaaaatactgtttttagtttgtatgccttcaaattgcgcctaaataacacagttatttttgactgattgattctaagaattttgctattacagccaaactatgacattttgcatcatatatttttagcatttttaaagaatgaaatgcatttctattttttaaaatgattttttcattttgagtttgagccaaatatctcaaaaatccacagctcctagaactcaacagaaaatttgcaaggccaaataaaatatatgtggcttactgctgcagctgtatgttttaaagaaagctaatatattgactaattcttagaagagcatccataaattgctgtctctgaaaaatgtttatagttataaaggctagagatgatgtcatttttgctgttacaggtaaagaggcatctgtgtttttgaccttttaagtatttctattgagattctaaataccaacgtaccaaaatacacctaccattatttatccaacaacactcaaaataaaatgacaacattttgtcattccactctatcaatttatgtctctttaaccctttgattgctttaatggttcagttgcttttaatacacaaaggaatatacaattgtttaactaaatagacaatactgtttattttaatataaccttataaggtgatcattctgtaaccaatttctttgatattaatgatcatcactatgttaaaatacgttaatacttaagcagactgatgtacataactgtaacaggttttttgttttaatttctttgtcatctaaacattaccttatattttaaagccaatttgttttgtaatatagataatgaacaagttggtttccccctagagatgtctatgatacgtgaaagatgtttgtgaatgaatacatgtctttgtgtgtattctatggtgtgacagattaaaaatgccacaagttttttgatgttttttctatcaagtcttagaagattctatgactgctttgaccaaaagaaaaaaacagaagacaaatgccaatttctgggccagatcttaggagagtggcggcctccacctcctatctcaacacttggtcttggagccctgagaaactgtgtaagaaattcaactagctattcagctacaaaaatcatgtgaagaggccctgaatctacatgaagaagaaggtggacctaggtgaactcagcctttcagacctgtgctaagatgccaagtgatcttgtcatgccacgtagagcagaaagatgactagcccaattgctggcccagaaaaccatgagttgtaataagtgcttattttttttttctttttttttttattatttattttttttgagacggagtctggctctgttgcccaggctggagtgcagtggtgccatctcggctcactgcaagctccacctcctgggttcatgacattctcctgcctcagcctcccgagtagctgggactacaggcatgtgccaccatgcccagctaattttttgtattttttagcagagacggggttttaccgtgttagccaggatggtctcgatctcctgacctcgtgatccacccacctcggcctcccaaagtgctgggattacaggcgtgagccaccgttcccggcctattgttttaagtcactaaatttcaagggatttgttatataaatatagataactagaacatagggtaaatggcatgaatatctgaggtgacaccccattttatgattctttttcatcaaactattttagaacaattctactaactaggttacaacaagataaatatccaaataccataaaattactcacaagggtacaaagaaatattgaaactattaagtctataattccatggttaatgaaaaaatcaggattttgccagccaagtattatccagtttctatattcgttttggagatgagtcaagtctgctagcttactatctagctcactgatctaaccactatatagaactacatgacctctagatttaaaaacctttatcttaaacattaaaatcacacacacccatagtcactgtaccacacacacacacacacaccacacacacacactgcctctcttcaaatatttctctcacatcaccagattataagacattttataaggatgctgtgagattcacccaccacccacaggcagctgctctgaagaggaattaatctacaacagcaataaataaataaataaaacatggaatgaaaaacaacatacgtattttagtatccagatatacctatataaatacatggagatacttcaagcatatgcaaggttattgatttagaattcagcaggaagaggtacccaaagagttctcagaataacaatgtaaaagcacatgagaaattcttctttcatttgtttttttctaagatttaaaaatgagattagtgcaatttaagaaatgaataaaagaaatatgttagaagatgtagattctttggggattcctagcattcagtttcggggaaattttgcctttcctttaaggaagcaggtatatcttatgttggcttagcaatttaatctatttaactcctacaaagcataacttatttagaacatatactggacattttatgtatcacttctgattaagagttattaaaaataatgtgaatagcaaaacattaattttggctttgatagtgtctctgtaatatgtaagagcagtgtattggttatctattgtgaataataagttacctttttgtttagcagctcaaaacaacacacatttattagctcacagtttctgtgggtcaaggattcagggccaggtgactctgactgagtctgtcatgatgattcaggtaagccatcaccaagaagctgaaggtttaacttgggctgatctgattccatgatggctcatttgcgtggctgttggctggaggcctcagtccctcagaggctatcggcagaaagccttagctccttgccatgctgacttttctgtggagctgcttgatctccttatgacatggcagctggctttacccagagtgcacagttaggaagaaaggaggaagctgcagtgatttttacgacctagtttctgcaatcacacactaacacttgtgctttattctgttcattagcagtgagccactgcgtccaccccacactccaggagagggaaattaagctccaccacttaatggaagcagcatcaaagaatctctggacaaattttagaaccaccacaagtaggtttaaagacttgccaagaatcaacttaaatggtctgtttggttctgaattagaggtgacagtgtaactagtgaacattttgctgctatgagccacggttagtatatattttgaaggctatattcttacatttatctgaattcactatttccctgactccacctctgagtcttacaagaatcaaatatatcttctcagaatgcaaccttatattctggcagagcgggaccattataggtcaagacgatagctagatcaggagaaatagtgcaaggctgaaaacaaccagaatggaattgcagttcatggatttagaaacttcctatttcaattcaatctgtatatcttctttattttatttgttagggaaattttattttcactcctgaggaatattgtaatatgattttagtccaaaataaatcttaaaatcaactacacagagaagactttataacacagtttctttaaatatgtggcaaatattcaattatctgtattaaaagcctgtaacacttcataaaattaagacaaggaattaataagtaggtaccttggcaagattaaaatgtactgacctttctcaattgagggtcattgattcctgtgccattcactaagtttattataaggctttttttgcaaaaaaaaaaaaaaaaaaaaaaaaaaagagagagattcctgaatgcacttcacgataagggagttttatatataatgtgcatgtaagatggtagtagaaacagaaaagtaaaattgtcaaaagtgatgcagttctagccttaggttactcagtttctctctcataggctatgctctccgtttctcgaggcatctccatttttagtgcacatatgctgcgttctcttctttctcctaaccaatttcctctgcttactcatagtttctgctctgtcacaatgttagctggcatatgaaccttcttagcctctcttgcctctctttataccttgttgttagcttctaagtcactggtcagcctatggtctgtagtgtgtaatgtgggtcagggtccctcttatcctatcaaccaatcagctctagatggggtagacaggggcacggggtttacaaagcacttccttttcaggaagggctgtggtcacattcattcctttcaaatgtcagttattggtagtacaggcaatctgagtctttgtccatgtggtgcaatgataaataaataggtgcataagttaaaaactatattttggttctcttttctaattgatgatcttaagaaaacatatacataagaaatattttctcatctgtcaaacagaaactcatttgctcatttactaaatagatgtcctgaaggcctattgcctgtgaagccctgtgctggaatttgcgggtcttgaaagttgcttaaggagatttcctgccttcgaaagctttctgtaggggggtggggtagaagggttaggtattcaagcaaacaagtaaaatatgatgtagaaagtgatttttcaagaagagagaaaacttaaacatatggttactggagtccagattaaaactaagtaaatcacagataataatatcttctttcccatcttacagaactactaacgtgttaactgttacaatacaggtacaagcctagaaggatgattttggggagaacagagttctacagaaatacaagctgtcttatgagtaaataataacagaaatcgtttacagggcaatttttttaaactgacttgaatcacatatttttataagactcatatctttttcaataaaatgtggccaaatttaagttcactttcccttgtattttaacagaaatctgaacttccattcaaagagagataacatgagaagcagaatatatagtggtccaaactgtgttgctcactatttttatgatcatgtacgtgtctttgaacatccaaggcctcagtcttccttaaaaatatgagatgattagaccaaagcatcttaaaggtccctgtggccctgtgattctattgagcctgagccaattagtcaaacagttacctgtcattacacaggctgtggtgtacacatacattttagcaccaaacacaatttaataacagggcacagaggccgcaaagcctcctgattctgttccattactaatttatcaggggctgaaagcaaccaaacttaggatcccaggcagacaatggagcctttgaggggcaagggaagcatcatttaaaaggaaagcattaccattctaaaataatggcaaagcacatgaactgagtgctctgaaagagagcactacaaaaaaggtattctcagcttaaatgccccaaacacaaaagcttttagttgggacttagacgggaaaaagaaaatagctcccaataaattggttttaccagtatccttttgtgtgtgctggtgccaagggggcgagggtacaggcaaagcgtgattttccaaaacctagctgaattatgtttcttctttagaacaaaacccaacattttgctaatgaggataaagacagtaaaactgatattcctgtgctattactaacttgggtattgaaagatcattcacacaataattgtaccatgttagcactatatttgcatatcttctattgtctcctttccttgatattttgatttaaaaccagtagataaccatacagtaccatatatgcatatacaacttaataatctgatgtgcaaggcaaaatgagattaaaaactgaacacttcatgctaaccaactgttatttatatgctatttttcataaacaatgcaagatgacagtgtatttatttgaagaactaggtaagttaatggtgtgtcaatttaagacaatataaaacatgtaaaatcttttagcatccccagtcaggtaggcaaggtgtttgttcatagattcttggtactaacactctttttgaaaaattctacacaaatgccaggcatcattattagcaatacatatacgtaaaattataggtttgaagaaaaatctcatatgataaaaaagaaatgcattttataaatctttataggtggcataaactataaaaaattgaagatttagttcagaaaaacctattttccaaccatttttctattgagatttatatctttgaagaagctatgcacataatgacttcaagattcattgcacagtagttatctttatctgccatactgttagcacctccttaactgtatctatggtcactctactttttttgcttaaagcagatgtcctacatgactgaaaacattttctcatagacccattagtgtctatgagacatacataaaaaagtgaatcccgtaagaactaggagatgatcttaatgcatattgttggtttttaactatttagcaatttcacttatcttgcagaaatggctgttgccctaccatccttaagtgaaagataagtttcaattgcaaattctttctgaataatgagtttgaaaggaaaaaaaagatataaaatgtgtaggtttgcatgttgagactagagaatctatttgggggaatacatggaatagttgagtgaaaggatgcacctaataatatctgatatacccggaccaggaaatgaagacaatgtgaccaaatgtgtttgttacactattagttctgaattcattagaaagatcacagtggggtctagcatggtgactcatgcctgtaattccagcactttgggaggtggaggcaggtggatggcttgagttcaggagtttgaaaccagcgtgggcaatatggtgaaaccccaactctacaaaaaatacaaaaaattagctgggcatggtggggcaatcccgtagtcccagctactcaggaggctgaggtgggaggattgcttaagcccaggaggtggaggttgtagtgagccatgatcgtaccactgcactgcagcttgggtgacagagctagaccctatcttataaaaaataaaaaatacataaaaagaaagaaagaaaagaaaggtctgaaacaggatacatgataatatgtttggcaatctcatttcagatgtaacagtaaagatatgaaatgatgtacatatgtagtttatggattcagggtcattgttctatagtcagagccaagatatttatatcaagtactgtgggctttctgatttattacattgttgtattgacacaaggcagaagtgctagttttgagaataatttgggatattagttgaatggtaaattttcacgtgataaggttcagaaaatagattttaactgaatgacaactctacatacaaatactggctgtatctccactggctaagctcatttttcttttgaaaaggtgtcttctaaaactatacagacatgataccactcagttgttactagtaagtagctttaagttcattctttgtgtaatttacttttttaaaatttagttcatattgaggtgagtatgtatatatgtgtgcaaaaaagatgtctgaatatcagtaatttctcattgtactaacagataatcaagatgacaatacctaagtttatttacaaactttacttcaggaattactcttttgaggattttaaattattagaaacatatttgtatttcattgttttgtgggagattattctagacctcatgacaaatgtccctttttgatacacttgaggggctttggctaataggagttcataagttgctttgctcaactgcaagacggttccaggatttacagtagcaggtgattgccagtttggtcaatgaatggctgttagctcctgaatagctcctcaaaagaatgtgacagccccatgatccacatgttcctctgctcttggcactgtactcaggagattccttgaaggtgatacgcagtgatagtttcagtgtttggaaacagcctccaaattttattttattttttctctcggcaacgactaatcctaccttaatccacctggctggagttttcttactaaaatgcagacctcctcaagtcactttctactaaactcttcaatgaatcctagttaccccaaactcaaaattgttggcatggcataaaaggccctccctgcttgcttttatattatctttatcacttgatacctttccgcattaacatcagacttatagtttctcactctgtattgtttctaactttatgtgtgtcttagtttgtgctgctattaaaaaatgtcatagactgaatgacataacaataaaatattcatctcttacagtttagaaggctgggaagtccaagatcaaggtgacagtgaatttggtatctggtatttggtatctggtgagggctctcttgttggtttgcgtacactttcttcttgttgtgttctcaaatggcagaaagagggagagggctctggtctgctttttttttcttataaaggcactaatcccgtcatagaggctccaccttcattacctcatctacacttcattacctctaaaaggcctcacctctaaatcctatcacattgaggattagaaggtcaaatatgcattttttggggggtgcacttcagtccatagcagtgtgtgtgtgtgtgtgtgtgtgtgtgtgtgtttgtgtgtgcgtgttataaatgtgatttcttctgtttgaaatggccttctctgttgtcctagatgaaagtattttccttctttaaaatacagattaaacatcactttctctgaagcatctctctgtcacctctgggcagaaataattcacagtttttatgttaccattgccttgaatatacttaagttctatgtttattctcatgacattatagatttgttttgctttgtattgttttgtttttaaatgtgcatatcttctcatcttaaggcagttaccatatttcatacatctttatagtcccaactcctaatacaggccctggtatagggttgacacacaataaaaagtttttgtatgaatatttcttgaaataatattggattatgagcattcttttcaccaagaatgaaacacaaagtccttggtcacaatttgacatgagcctacttcttcaactaatccaggcttacatttaaatctttccacattttttttccttctaatagcttttcatgcagacagaggaaagcaacatttaacaagcacttaattgcaacatgtgggaatgagtcaaatagtggtcatgtgtggaacttttaatagcgccaattcacatagggtctctgctcgctagaaaggccatgcttcctctgcctcagatatttgacagaagacaagcaacagctgaaacaaatactgtctttaaacaaatcaactagcaattcttaatagtggtaggtttaacaattacataatgtcagtgatgtcccaccagtaacagattagaagaattccaagtttggaaacatctctaaaactaattcataattgccatgatatgatgatgaggccaaattttggcacaatgcaaattttaaataacagaataagctgtcatttagtcctgactttgtacagtaggtgagcgtttaattaattcttatctaattcatagagtaaagaaattactctttactaacataaagacagatttctgaaatcctcttcttgcttttagttgctagcctcacatactatagtgatagacctattcgtatacagggaatatttgggggcttttaatattcaaaaattagatggtacaaagttcatatcactatgaggcaaatcactgaagctttattctcaacttagcacagttccatgtaatctgctctgctaagaattcagcctcagtatttggtaacagaaaaatttccaatgataccacacagctctccattccctaaaaaaaggcaagtaaatctatgcatcattctcattgcagaactatatattttcttacattgtatcgacaccacgcaagccaacatcttttaatagtttaatatttcttgctattgtacttctttcaaaaagtattttctcaaccaataaagacatgataaaatatgaattaaatcaattacagtatgtctacatgatagaatactgtaatgccattgccatcatatttttaaaaacatttccgacataaaggaaatacccagagtacataagagaaaatttttgttctgcaatattatatatacatcactattctacatttttgtagactatacatcatatgcatgttagaaaaattactggaatatatatagtaaattattagagcaatcatgcctaaattgcattactatgaatggtttctaattttttggtgcttttaagtattataaaaatagtagttattgatatttagcaaatatgtgagctactttgctaagatattttatatggattatctcacttaacacaataaccacatgatgtagatactatcatgacctttaatttacagataaaggaagaaaacatttatatttttaaaattattattattgctttataattttacatcttttaatattctttttaaagaaaaattataattgtatacgtatatatgggtacaatgtgatgatttgacatatgtctacaatgtggaatgattaaatcaagctagttaacatatcttttttgtggtgagatgtttgaaatttgcttattttaaaatataagatatattattattgactatagtcactctactgtgcaatagatctcaaaattcatttctaaaaaatatctaattgaaattttataccctttgaccaacaactcgttattcctttcctatacttccatgagttcaacttttaaattttcttagtttattttattttttttgagacagagtctcactctgttgcctgggctagagtgcagtgatgtgatctcggctcactgcaacctccacctcccaggttcaagcgattcttgcacctcagcctcccaagtagctggaattacaggtgcatgccaccatgcccaggtaatttttttttctttttttgtagagacagtctttgccatattggccaggctggtctcgaacgcctggccacaagccatccacccaccttggcctcccaaagtgctgggattacaggcgtgaatcactgtgcctggcaagagttcaacttttttagattccacatacatgtgaaataatgcagtatttgtctttctttgtctggcttatttcacttatcataatgtcttccagcttcattcatgttgttactaatgtcagcgtttccctctttaaggctgaatagtattttattgtatacatttacaacattttctttatccattcatctgttgaacatttaggctgattccatatcttaaccactgtgtatagtgctacaatgaacatgaggatgcagatatccttttgacatattgatttcagttttcaatttctttggatatatacccgaggtaggattgctggatcatatagtagttctatttttatttttttgaggaatctctataccatttttccataaaggctgcactaattttcatttcccaccaacagtatacatgggttccgttttctccacatccacactaacctttgttatctttcatcttttttataaacaccattttaacagacatgaggtatctcacagtggtcttaatttgcatttccctaatgataggtaatgctgagaatgttctttgtgaatttgttggtcatttgtatgtcttcttttcagaaatgtctacagattcagtgcaattcctatgaaaatcccaatgccattttggaaacagaaaaaacactctttaaattctcatggacccacaaaagaccctgaataaccacatcaatcttgagtaaaaagaacaaaactggggcatcacatgccctgagttaaaaaatattatgaagcaattgctatcaaaaatagcatagcactggcataaaaacaggcatacagaccaatggaatgggatagaaaaactagaaataaacccatatatttatggtcaattgattttaggcaaagatgccaaaaacacacaatggggaaaggacagtatctttaatacatggtattgggaaacccggatatccacgtgcagaggaatgaaacttgatccctatctcataccatgttcaaaaaccaactcaaatggactaaacacttaaacacaagacctaaaactatacgactactagaataaaacatggggaaaatgttcatgacattggtctggcaatgatttttggggatatgacccccaaagcacagtcaacaaaaagtagacaaatgggattgcatcaaactaaaaatgttctgcatgggaaatgaaataacagagggaaaggacagcctacacaatggaagaaaatacctgcaaattatacatctgatagggagttaataagcaaaataataataatgagaataataatataaggaacacaaacaactcaataggaagaaaataaataacccaattaacagtgggtaaaatgtttattattttaagaaatgaattggaaaggaggagccaagacggccgaataggaacagctcaggtctacagctcccagcctgagcaacgcagaagacgggggatttctgcatttccatctgagatacggggttcatctcactagggagtgccagacagtgggcgcaggtcagtgggtgcacgcaccgtgagcgagccgaagcagggcgaggcattgcctcactcaggaagcgcaaggggtcagggagttccctttcctaatcaaagaaaggggtgatggacggcacctggaaaatcgggtcactcccacccgaatactgcgcttttccgatgggcttaaaaaatggcgcaccacgagattatatcccgcacgtggctcggagggtcctacccccacggagtctcgctgattgctagcacagcagtctgagatcaaactgcaaggcggcagccaggcggggggaggggcgcccaccattgcccaggcttgattaggtaaacaaagcaactgggaagctccaactgggtggagcccaccacagctcaaggaggcctgcctgcctctgtaggctccacctctgggggcagggcacagacaaacaaaaagacagcagtaacctctgcagacttaaatgtccctgtctgacagctttggagagagcggtggttctcccagtacgcagctggagatgaaattctgggttgaaaattcttttctttaagaatgttgaatattggcccccactctcttctggcttgtagggtttctgctgagagatccgctgttagtctgatgggcttccctttgagggtaacccgacctcaaaggcagactgcctcctcaagtgggtccctcacccctgacccccgagcagcctaactgggaggcaccctccagcaggggcacactgacacctcacactgcagggtactccaacagacctgcagctgagggtactgtctgtcagaaggaaaactaacaaacagaaaggacatccacaacaaaaacccatctgtacatcaccatcatcaaacaccaaaagtagataaaaccacaaagatggggaaaaaaacagaacagaaaaactggaaactctaaaaatcagagcgactctcctcctccaaaggaacgcagctcctcaccagtaacggaacaaagctggacggagaatgactttgacaagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaggaatgcagaagcctcaggagctgatgcgatcaactggaagaaagggtatcagcaatggaagatgaaatgaatgaaatgaagcgagaaggaaagtttagagagaaaagaataaaaagaaacgagcaaagcctccaagaaatatgggactatgtgaaaagaccaaatctacgtctgattggtgtacctgaaagtgatggggagaatggaaccgagttggaaaacactctgcaggatgttatccaggagaatttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttcccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagggctaaacatggaaaggaacaaccagtaccagccactgcaaaatcatgccaaaatagaaagaccatcgagactaggaagaaactgcatcaactaacgagcaaaatcaccagctaacatcataatgacagcatcaaattcacacataacactattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggagaacaaaaacaggcaggggttgcaatcctagtctctgataaaacagactttaaaccaacaaagatcaaaagagacaaaaaagaccattacataatggtaaagggatcaattcaacaagaagagctaactatcctaaatatatatgcacccaatacaggagcacccagattcataaagcgagtcctgagtgacctacaaagagacttagactcccacacattaataatgggagactttaacaccccactgtcaacattagacagatcaatgagacagaaagtcaacaaggatacccaggaattgaactcagctctgcaccaagcggacctaatagacatctacagaagtctccaccccaaatcaacagaatatacatttttttcagcaccacaccacacctattccaaaattgaccacatacttggaagtaaagctctcctcagctaatgtaaaagaacagaaattataacaaactatctctcagaccacagtgcaatcaaactagaactcaggattaagaatctcactcaaaaccgctcaactacatggaaactaaacaacctgctcctgaatgactgttgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacagcctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctcactcatttgatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggcaggttcaatatacgcaaatcaataaatgtaatccagcatataaacagagccaaagacaaaaaccacatgattatctcaatagatgcagaaaaggcctttgacaaaattcaacaacctttcatgctaaaaacgctcaataaattaggtattgatgggacatatttcaaaataataagagctatctatgacagacccacagccaatatcatactgaatgggcaaaaactggaagcattccctttgaaaactggcacaagacagggatgccctctctcaccactcctattcaacatagtgttggaagttctggccagggcaattagtcaggagaaggaaataaggggtattcaattaggaaaagaggaagttaaattgtccctgtttgcagatgacatgattatatatctagaaaaacccactgtctcagcccaaaatctccttaagctgataagcaacttcagcaaagtctcagcatacaaaatcaatgtgcaaaaatcacaagcattcctatacaccaaccacagacaaacagagagccaaatcatgagtgaactcccattcacaattgctttaaagagaataaaatacctaggaatccaacttacaagggatgtgaaggacctcttcaaggagaactacaaaccactgctcaaggaactaaaagaggatacacacaaatggaagaacattccatgctcatgggtaggaagaatcaatattgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctggcttcaaactatactacaaggctacagtaaccaaaacagcatggtactggtaccaaaacagagatatagatcaatggaaaagaacagagccctgagaaataacgctgcatatctacaactatctgatgtttgacaaacctgacaaaaacaagcaatggggaaaggattccctatttaataaatggtgctgggaaaactggctagccatatgcagaaagctgaaactggatcccttccttacaccttatacaaaaatcaattcaagatggattaaagacttaaacgttagacctaaaaccataaaaaccatagaagaaaacctaggcattaccattcaggacataggcatgggcaaggacttcatgtctaaaacaccaaaagcaatggcaacaaaagacaaaattgacaaatggggtctaattaaattaaagagcttctgcacagcaaaagaaactaccatcagagtgaacaggcaacctacaaaatgggagaaaatttttgcaacctgctcatctgacaaagggctaatatccagaatctacaatgaactcaaacaaatttacaagaaaaaaacaacctcatcaaaaagtgggcgaaggacatgaacagacacttctcaaaagaagacacttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggtgattcctcagggatctagaactagaaataccatttgacccagccatcctattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacatcatggaatactatgcagccataaaaaatgatgagttcatgtcctttgtagggacatggatgaaattggaaaccatcattctcagtaaactatcacaagaacaaaaaaccaaacactgcataatctcactcataggtgggaattgaacaatgagattgcatggacacaggaaggggaacatcacactctggggactgttttggggtggggggaggggggagggatagcattgggagatatacctaatgctagatgacgagttagtgggtgaagcacaccagcatggcacatgtatatgtatgtaactaacctgcacaatgtgcacatgtaccctaaaacttaaagtataataataaaaaaataaaaaaataataaaaaaaagaaatgtattggaaaattatactgctaaaccttacttagtgagtgatattttctcactctgcatccttagagaccattatttctttacattgaatcaaaaataacatgatttactcctatttcctaatatatgcatctcattgatttgaccatataggtatactctgccctagcagggctcctaaaatatactgccattaggtgggtgctacaaagttgaaaaagacgtgcaacttactagcttgtgcagaggcaagtcactgattgagtctgccacaattactgctctaatagaggggctacaaattactattggagcaaagaggtgggaggatgtagtaagtaaatgtctcatacagaaatgcccttttcactggtgtttcagctgctcatcctgttcatctttctcaaggcattacaagtgcagaagtctgagtgaagacaaaaaagcctaaaattaaatatacactgatttagcaaaagccaataaaatattattttcagctgaaagtctcacagactacttcatggatgaagtatcagttgggctgggctcactgaaggttgtactaaactgcacctgataattcacattgtatattaattggacactaatatgtgccaaaggatagatatgaaatgctttttatatttgaaaacaattatgaaatatatttttggaaggtacatctatgtatgtaggaagatgttatataaatgatttagagaaacaaagaacacagttatgagacaaatccatatttagcatatttgagaaatccttggccttaaaatccctaatggcagtcagcatttttggagtaggttcaaatacttaaatatcacatcttctttgtgcttaaaaaaatacaaagaaaaccctgtgtttggatctaccttttctctattactagaaattgtatgcatcaatagatcagtataggtttttgttgtagttgttttctaactccctttagaaggtgacagaaattaaaggctggagatctccttgcctattgactcacaaagtttgcaatgtcagaaatcattatttataattaatgccagtgtacaaccaagcattctcctcaaccagcggctgtctgtaaccataaagaaattttagggaagccctacatgaaatctatcttatagatttcacacaacacctgtgagtcagccttgcccagggctatgtcatttcacttcctatccgtctgaaaaatgtgcctcactgagagggcataatactttggaagggcagagtatttataactgaagacacgccatatagcttcacatgttagcatggtgacgatatcaattttttggcatctaaactttgaatagtgaaagaatacagagaatgtattacttgggtactaaagtctgctctaaaggatgtaagataaatcaagatttggaattggatgttagaatctcttatggttaactatcgctattttaaaatgggaaatatgtctgaattaggaattgggtaaatagtcacataatggaaaagtttgcttgtgaacttatatctgactttgttacttatactcagtacttttctttgccctaaattctcatttttgcagtcctttaaatatgctataaaatacatgtttttcaagtctttctggataggaaactttcctaaatttatggaacattaaatgtctggataatttctgagattccagactgtgtttcaataactgtagttataaatacataagcatattataacttaacatattttggttattattagaattataaaatatgtgccaacaacctaagatggttttagaaaaatgtttcaatggacaaaaaggcatgaacaatatgacattttttcacctgcaaccaacacattcgccacttacattacctttcctattggtcacatcttcctatataaggtgatatatatacacatattaacttttacaacaaaacgtgttatttttggtgtatgtgggggtgggggaaaagcaggcccatgtgatctctaccatttctttcagcattaaaattctgtgactgtgatgtaaactacagtatttttgtccattagaaaagcagatttgtgaacttattattacagaattattaatcagaccctaaagactctagaattccaacataacagaataaaatttaggttttgagcatgttgaatatatctgattttaaaaattgaaactagagggtttaagattttattgatccctctaccatctgtccttttaaaacattttaatgggttctcgggttctacatttcagtgtatctcttctgttaagattagctttatctcaatgaaatcgggtttgtgatgctactttttcttatatctagaatttttaatagaaaatttctaggaatttctaagttgttctaaatgattttcatcatggttggcatttggtaaatgcacaatgaagatttgttgaattaatatgaacttattttcctatagttgtcttttacttatttctaccgcacggtctacatgactgataatgaaactgtgtcactataaatacaagagtagtatctgtggttaatgtgatattagaccctcaacaggaatacacagacaactgatagacttcaatcaaagctttaaagttaagcatgttcttaaactaggtgaggagtcatgaagatggaaaatagaaaagtatctctgaacacatgggtcctgaaatggagctttccagaagttggtgtccaattaccatttaatatttcatgaacatgtttagatctaagacattttaacaattttaattaatagaaggacagcctgccctcacagaagtcattgtgaagtttatctaaaaggtgagatttttaaacataattattcccttgatactgcctcatttccacattagtcctgttggaatacactggaccatataatggagaggaatgacagaaccagccaaggctatgatgcttcaggaatagtgcaaggtttctctgcaaatagcttcttgagatgcttatggttcttatattgttaaaattagaactagaagcaatggcaagtagtatcttattggagccagaaagaccatgttttcttgtatataagaaattatactttgaactacctgaactgatcaggcagaatttcagggtttctagaattcttgataatctgtttttttttttttaattttttttttttgttaaaagaaaaaaaaaaaaaaagaaacaaactaccctgagttttttttttttttttttactgatatagctctatactgctgcaacctgggagaaaaggatcacagtgtttatttttaaataaattttagtgtcatttctgtgttatatttcatatactgaattcaaattcctcaatttaaaaagaactcactcaggtattgattgcaaagatatatttctagtagttatgcctaattgacaattgctgtcatttacttctggccaacttaagagtcccaggaataaagtgcttctttcacttttaatcattcattactctctccttttcctcccttgcaaagtttttcctgattttctttgttttccccttggccatccaccttacaccccttattcctactctttgccttcatcattttgtccttgtagagtagctcaagtcagcctttgattgttagtcagactccatgggcaattccctcaatgttttcattgtttacatgaaagcatccaaatgtatagcaaatagaccagctggaaacctccccacagacagacgcatccaaacaggaggttccttgacgtgttgtggtgggtcagtctggttctgctatcagaaagaacagcccacacccatatgcactgttgctcttgagtggaaggcttgtgatagcatccacatggactgggcctcagccaaaacttagcctttagcacatacagcaatacagaatgatgtgacaacgacagagttttggaatactgtttgtagcatgctgttctttggcatactttttcagaatgtaagaacagatttctcctaattttcccaagacatattgtttattatagaatgaggctttaaaaatgactatagatttgaaggcaattgatcgacttaatattaaactcaatatttagtgtacatatcttggaaatttattttgaaatgttgcattggtgactcgtgcttgaaaaaaaccacctaattttaaatatttctccagggtgtgaaaagggcaacattagtaatgagacaaatagagtgatccttgactctaattagagaaatacagtgaaaatttatcaataaaagtaaaatgcttaaaacctaaagcaaatatatttaaagacatttcacaaatataatattggcagtttctgaacaataataacatatttgctgagtatacattcatgttatacactacactaaaatcttgtttaaaaaataagcataacatttacacattctatttagaagatgatgtatattgtctaataacacacattaaatcagtacatatttttgtcatcagtgatttgaaagaataatgtgttataaatttctacctaattcatagcactatgccataataaagaagaataatactattaaaaaataaccatcttggtttcattttttaaaagtccctttctttacttatcactattgttttaaaataaataaggcaaacataaatcagacatggaccaaaaaaaaaaaaaaaaaaacacaaaaccctaatgaaagcaattctatgggggtaaatgtggtttgagaaacatgtccttagcctattctaaacaaacaccttggtaaaggcaaacggaactttgcaaatcaaatatcatcattagtaagaggaaaaaacagtagcatatttctgcctttcatgcttgttacttcaggtggttaacctgaactacaaactcattacttgacactcaagatgtaggcaaaatcaaatgctatattccaacccaaaatatatgtagcaagtctacagatttgtcatacaacatgggcaacatgcaaccaccagtttaaagggttgcaaccaacttcttgtctatgttcacagacaaactgcaggaacctgacctcaaagcccaaccaggctctggaggaaaagctgtgtgcctcattccaagcaacttcagagtttcaatggatttaagacctagaaagagatctggaaaacaaaagagtaaaaataacatttcttatccctcttgatgaaagacatataattgaattccagagaatgactgattgaaatttttatttgttttttttccaatttgcttatctagtgtagacttcacttatagcctgaaagcctataaattatgagagagagagatacaataccactcacaaaaagctaggttatcctgcacacaaagaaccccaatgtgtttgtggtttacaaccatggagttttatttttcactgatgctcacgtccatcaaagctgagttgtcaattggcttcatctttccttccctcagactcaggctgcctcggtaccctctacctgattattgttggtggttgtgatgtggaaggaaatgacataccaaccacatgttagctcttaaagcttcttcccagaggagacactaactactcttcacatgctattaggtgaagagtctcatgccatgatgaatgtcaacaggtcatacaagcaaagataactgtctcctgtcaagaaaacatctctgtggacaataatatagtttaccacaggtagcaacaggcaccatatattctgagagttaggtagaggaatggcctgctattacggacttaagtagagaatgttggccaggcatggtggcacacgcctgtagtcccagcacttgggaggttgaggtgggtgtatcacctgagctcaggagttcgagacaagcctggccaacctggtgaaaccccatctctactaaaaatacaaaaattagccaggtgtggtggcacacgcctgtaatcccagctacttgggaggctgaggcaggagaatcacttgatcccaagaggcagaggttgcagtgagccgaggtcatgctactgcactccagcctatgcaacaaaagcaaaactccgtctcaaaaaaaaaaaaaaaaaaaaagagaatgttagactgatagatacttggatgagctatgacgtaagtaaggccaagtacaatggccatgaacagcagatccatggtgctaccattaaagtattagggaggaattggcaaagtatcatgctatctaaaaacaggcagatgctattcaaagttaagtatagggagatgaaatattaagcaacttcctttcttgcaaattcaagggatttcttcatttttgacccagatataggaaagaattttatttatgctttaagtagccatgagactgcactgcttgaagtaaaatgaggtctaaaatatcttctcagattttggctctttccttggtaatcccaaaattggtttcgttcagaaatcagtgaattctcctatctttattatagggaatctacagtttttgaggttctgaggacctgatctctaatagaagcttgaactctttctgacatttttgttttgatgggaaaatttttcaatgtaatcacttttacaggacccagacaaaagtcccaaatttaaaattttattctcagaaaatttttatagatttttacagtgaataccaggaatgcatccaacagaattattcaatgaaagcagaaaataccaccattatgagtgagatatcatgaaccctatgcggcaaagatcttgttgccctgaacattttgcttctttaatcatcagctctagttgtcattttagacaacaaggcaaacattggcatagagaagcaggaggtaatatcaggagtttcagatggggtaacttctggaagctgttagtagcttctactgtttacctccttttcaatttttttttcacaaaaaaggcacaatatctgaaggacacatgcttccttttaaagtgtgaatgttatttttagcactggtatggaaagcagcagaaaatacaacaatttatttgctctgttcatgaaaagtgattttatttttgggtttaaagaaataattgtgaatgtcttttgggaaaatacaaattttaaggtttaaattcaagtgtccctttctgtaagaacttttctcatttacgcgttttcatctatggtggatatgacatgattatttatgtcatcttttctccttcctacggggtcttctcttgcaaaatggcgctgcatggtcagcactgactcagaatgtggaacaaggtgaggctgcctttctcacagtattttatgtgtattcaagctgtgaaaagtgtcacagcaatactcccattctgtgtcagctgaactgtatctgctcatattcacatctcggattgactacaattcaaacctggttatttgtttctttatcaattgtcacaaaataaaaggcatattttagcagtgtttttgagcccccaaataggaaactaatttttatagaaatctataccattccgtctttgggagtatcaatccttaaaccagcaggtgagaccacattttattaaatggctcattctaattcagatcctggggtggtcttacttatggatgaattgtgctgctaccccaagaaaaccatttaacctatctgcacttacagagtgcctctgtgtacctgctgctgtctgatttgaagccatgaaatgagaggcttctgtttttgaaatcagtttttcagaggtgctggctttgacagtggctactctttattaaagaaagaacaagacaaataaacagaggtttgaccactacctgtttcatattggccatttctacatgatgcaaaatgccaggtcataaatgagtcattcagtattctgggcttctctggatggccaattcagagactgaggaaactaaaattactgcctgtaaatcattcttaggatgagagagagaaagagggaaaagaaagattcactggatacatattgacatatcctttgagtacatgtataaaaattatattctttatattttacttacagatattgctatttgttaaatatgaacatggtcagtttaatacatgcattatgttaacaaaatttcaattattgaataatttgggaataaagtttcttttataaattcactcacataaaagcaggaaagctctgcagaaatcatgtcaagaagaacagtttacctgaatttgcaggtgcatgataaaaatatcccagtgcccagcttctatttgtacctgcctagatgaaggtaaacaaatgcaactaagatcttccaatgacttctgttttctattgcattgctgggttattctttgtcttctttctttacaaaataggaactaacatacctgtgtctgatttattctccatatgttatgccatttattgttatttaaaaaaaaccacaatgtaaaatgtactcaataaagaaacttgtaagacagaaagaaataaataaaaaacacataaatcatctgtcatgtcatcaccaaaaataactaatggtaacatatggtttgcccttccggtaatttttctgtgtctgtgcctcatctcttccttggctgccttctcttttctatccgcattctttttctaggtgatatcctctaggcatgcctataatccatccttcacaggctagatggagtttacttttaaaaactctccagtttgaaaccctccaatggcttcctgctgcacttggaatacatttcaaagtccttatgttcttcttgctgagtcttttacaaccttcctctctgactttgtacagtctgattttcttgccctcctcatttttgtttgctttctattgctgaaataaattgctactaatttagtggcttaaagcaacacagatttcttatctttttgttctggagttcaaaagtcaacaagaggtctctctcggctaaaatcaaagtgttggcaagctccatttctttctggaggctcaatggaataatccattcctttgccttttccagcttctagtaaccatctgtattgcatggctcatggcccccttcaaaggcagcaatgtttggctcagtgtcaccctgtcatctgtctggtcctccttctgagtgtcttccacttataaagacccttaggattatattgggcccacccagatattccaggataatcttttggttagccaccttatccatctgcaacctcaattctcccttactatgtaacataatgtattcatagattctgaagattaggatgcagtcatctttggagaggggccatattctatcacattctgaagcattccttagagagtcaaagatgactatccactatccctaacttcaccaagcatggagaccctgcattggcccagtgatagccactatgatataaagattaccatacttggccaaatgaataaattgagaagtcagaactgttggaatattgcaaacagtataaggtgagagaaacattcggaggaagtgcaagtttattcagctaaagtttatagggctaataaaaatacttgtttcattgtcctgacatcagtttattgtaattaaccaaatatagactttagctttcttttctttttatagaacttcctcaaaaacagttaatacattttgttgcaacctattatctgaccactcaaagattattgaatatattatatgggatggccctggggatatagttttgaatgagactagaactgcctttcaagtgactcactagtttaatgagataatcagataagtgaccatttaaaatacagactacataggatttagcctgggttttggagagtcttgttggagttcaaaagaggctaagcagaaagagtgacctaatgcagtctaaattagaaaggttcccgaaatttttccaaatggagatgaaccaacaattgaggaagggcatccatcaacaggtatcaaacttcttcctttgttgtatttttccttcccctagaagcagctttatgaaaggctcttacttctctcacctcatcactgtttccccagcatgtagactggtttctggcacatagtaggttctctatcgatatctactgaatatgagaataatatatgtatacaaaatatgcaattttactttatagaaaggaaatcatacaaaatggcctatttggtaacatgtttgcttttagttagcaatatgtaaccatcattgtctgataaccattttgacagaaattcaatctcaaataaatgtttattcaatcagagctttctatgttagatttctttatttataattatggaagaataaacattgtttcctttagttcttaaaggagcttcgggggccaaaagtgtgtttgaattataattctccaaagcctaaaatctgcatttgtttaacaagagtctattcaaagtcctttgtactttaaatctttccttatatctgtttcctgcctgagcttggagctatggatcctggagactcacctattttttttttaatagataggttttctgtgatagtttattttcaatacaactatctcaaaattttgagcatactcttgctttccagtaaataaatatgccaaccttcaaacctccatccacctggttccaagactttttaaaaaattattattattatgttctaagttctcggatacatgtgcagaacatgcaggtttgctacataggtatacatgtgccatggtggtttgctgcacccattaacccatcatctacattaagtatttcttctgatgctatccctaccctagccccccaacccagacaggccccagtgtgtgtgatattcccctccctgtgaccatatgttcttattgttcaactcctacttatgagtgagaacatgcagtgtttggttttctattcctgtgttagtttactgagaatgatggtttccagcttcattcatgtccctgcaaaggtcatgaactcatttttttttttttttcagacaagaatctctgtcaccaggcttgagtgcagaggcacaatctcggcacactgcaacctccacctcccaggttcaagcaattatcctgcctcagactcctgagtagctgggactacaggtgtgtgccaccatgcccagctaatttttgtatttttaatagagacggggtttcaccatgttggccaggatggtctcaatctcctgaccttgtggcccacccacctcagcctcccaaagtgctggtattacaggcgtgagccaccatgcccagccaaactcattcttttttatggctgcatagtattccatggtatatttgtgccacattatctttatccaatctatcattgatgggcatttgggttggttccaaatctttgctattgtgaatagtgctgcaataaacatatgtgtgcatctgtctttatagtagaacgatttataatcctttgggtatatagccactaatgggattgctgggtcaaattgtatttctggctctagatccctgaggaattgccaaacatgagaaagcaggaaaaatctaaaatggacaccctaacttcacaattaaaagaactacagaagcaagagcaaacaaattcaaaagctagcagaagacaagaagtaactaagatcagagcagaactgaaggagatagagacacaaaaaacctttaaaaaaatcagtgaatccagggactgtttttttttttttttttttttttaaagattaacaagatagaccactagccaggctaataaagaagaaaagagagaagagtcaaatagacacaatagaaaatgataaaggggatatcattactgatcccacagaaatacaaactaccatcggaaaatactataaacacatctacgcaaataaactagaaaaactagaagaaatggataaattcctggacacatacaccctcccaagactaaaccaggaagaagtcgaatccctgaatagatcaataacaagttctgaaattgagacagtaattaataacctacaaaccaaaaaaagcccaggaccagacagattcacagctgaattctaccagaggtacaaagagatctggtaccattccttctgaagctattcctaacaatagcaaaagagggactcctccctagctcattttgtgaggccatcatcatcctgataccaaaacctggcagagacacaacaaaaaggaaaatttcaggccagtatctctgatgaatatggatgccaaaattctcagtaaaatactggcaaaccaaatccagcagcacttcaaaaagcgtattcaccacagtcaagtcagttgcatccctgggatgcaaggctggttcaacatacacaaatcaataaacgtaaaccatcacataaacagaaccaatgacaaaaaccacatgattatctcaatagatgcagaaaaggccttcaataaaattcaactccacttcatgctaaagacactcaataaagtagatattgatgaaacgtatctcaaaataataagagctgtttatgataaacccacagccaatatcatactgaatgggcaaaatctggaagcattctctttgaaaactggtgcaagacaaggatgccctctctcaccactcctagtcaacatagtattggaagctctggccagggcaatcaggcaagaggaagaaataaagggtattcagataggaagagaggaaatcaaattgtctctggctgcagacgacatgattgtttatttagaaaaccccatcatctcagccccaaatctccttaagctgaaaaacaacttcagcaaagtctcaggatacaaaatcaatgtgcaaaaatcacaagctttcctatacaccaataatagacaaacagagagccaaatcatgagttaactcccattcacaattgctacaaagggaataaaatacctaggaatacaacttacaagggatttgaaggaactcttcaaggagaactgcaaacaactgctcaaggaaagaagaaagaatacaaacaaatggaaaaacattccatgctcatggataggaagaatcaatattgtgaaaatggccatactgcccaaagtaatttatggattcagtgtgattcccaccaagctaccattgactttcttcacataattagaaaaaactacttcaaatttcatatagaaccaaaaaagagcctgtatagccaagacagtccttagcaaaaagaacaaagctggaggcatcacgctacctgacttcaaactatactacaaggctacattaaccaaaacagcatggtactggtaccaaaacagatatatagaccaatggaacagaacagaggcctcagaaataacaccacatatctataaccatctgatgtttgacaaacctgacaaaaacaagcaatggggaaaggatttcctatttaatatatgatgttgggaaaactggctaaccatacgcagaaaactgaaactggaccccttctttacacattatacaaaaactaactcaagatggattaaagcattatatgtaagacctaaagccataaaacccaggcaataccactcagggcataggcatgggcaaagactgcatgactaaaacaccaaaagcaatggcaacaaaagccaaaattaacaaatgggatctaattaaactaaagagcttctgcacagcaaaagaaactaccatcagagtaaacaggcaacctacagaatggcagaaaacttttgcaatctatccatctgacaaagggctaatatccagcatctacaaagaacttaaacaaatttacaagaaagaaacagacaactccatcaaaaagtgggtgaaggatatgaacagacaattctcaaaagaagacatttatgcaaccagcaaacatatgaaaaaaagctcatcatcactggtcattagagaaatgcaactcaaaaaccacaatgagataccatctcataccagttagaatggtgtcattaaaaagtcagaaaacaacagatgctgaagaggatgtcgagaaataggaatgcctttacactgttggtgggagtgtaaatttgttccaatactttaatgttattttatataatagtaaccaatcctcataactctattccaaatctatcaaattatagtgaggcatggcagtagaaggagagtattggaggaaaggtaagtagaagcagatagaaaaagaggcatttcataatcatttcaggttgtctataatgtatagttttcagaggaaaagtaaacataaaaatgcctagatagaaaagcctgtttaatatgtagaattacatttctgtaacaagaatcccttccccaatgtatcacaatcttctagaacagcttttgataaattttaaagactcaatatcaaatgaatggatagataaattacagaatatattagtgagaggttttgaagaaaaggcagttttgttgcaatacagaaagctaaattaacttaacactacaaagatgcttcatgcagaccaacaagaacaatagttaacagttgaaaacctgtttctgtgttttagccgcccctcacccacaatgtatacccatagtgataacattttcttaataaaaaactgaatcacatcatttgactgaatgaaaaggaaagggtatgaggggaagaggttttggaagaaagggaaagaagccacagtgcatcaactcatgaggaatgctttcacacctgccgcttccctcccactttgttacacatccctgtaaggcgtgcccttcactcctcatttctgagaagcactagccagtgagctatattaatcaaggtattatttctctgaaagttattcagcaaaaaaaaacctttaaagtaaagcaaaacacaaaaaaaatacaaaaaagcaaaaaccttgtatgtagcaccatataaaaatattttaaaatggcatgatcctctataacacgggatagatggccactatatttgtatagcaactacttccagacatacacggaagaatatgttatcatactttaatgatttctgaaagatatctaccaaaaaatagtataaaatactataaaagagctcccgtgtagtttccaaagtccaccaatattttcaaatcctacgttacataaagagtttctttaaaaattgactcgaggaatgtttcctattttagatgtcactatgattttaaatgttaacatacaatagcaaagtgcacctcatttttcctatttcatttttttccctcatcaatctgactttgtttttgtagggagtgctctaggtgaggcatgaacttacagccttggcatcataaataccgtgtactaatcaactgtgcaactggaacaaccagacttttcttaaatggttaatgatatgactcatacattgatacatacaatgatattgttaaaatcacccagtgtatcacttactctacatttaaaagccctgtgtgaaaatgactgcttatttttattagtaattaatcattataaagccatttaatggagttatgtattcttataaatctctgaatacctgcagtcaaatttaaatattctcttagttttatatttcctctctacattagatctttttgttggttttttaaagacatgccacttttgatcttaatattaagcatattgatttacttaaggacatgaagaatccagttttaacaagtgtatcgttcacaaaaatgtctcctatatggctgtactctttttccatttcctggttttgaatagtcttatttctgtcatcaacaatgaactttaaggtacctcatttcaactagagcaaatggctgttgaattcaatgactcactcagcatagaaattcattagacattggtttatcagtcaaagatgacatttgttttgagccagatgggttttcttgaggaaatcctctaactggatgcagattagattggattttagctttcctacactattaaacatcactgtttcatatggcacacacagcctgtaatatatttgtatatatttgacaggattttaatagccatggttttaataataaaagattacactttttctgaagtttatctgtttgcagtctttgatattttatgggttttaaaacatgcatcatcttataaatatatttccaaagcctaaaatcttgggatatatttttaaattaaaatgttaaacaataacaccaaagaagaaaatctcatttgactaggctacatagtaacagtgggatagaatagttgatccacagtgcaacttttcttgggcattggtgtctctatcttttctattttctatatcctacacaccctaacaattggcaagtcatgagatttctacttagaagaaaaaccattctattttcacaaataccatacccagtcaagacatcttcatgtactgcagagacaacagcaatactgatctaatttgcattccatcttcaaatcttactgtttaaattaatcctcataagagcagtcagtaatcttttaaaaagatagattagggaatgttacttattgtaataagaacttggtaatttgggccaatcctaccaatgtggacaacttgtgctgctgtatacatatacatctccagatgcatctttgtgtatatatacatgaataggtgtgtacacacacacacatacacacacatttgaaggcttagaagactaataagagagtaaaaaaatggtgttaccatctggctaaagatggagatctggagaggtgggctactcttgccttatgggttttcactcatttcaggagggttggttgatcaagtgtacagtgcttttgtcagactcatgggactgagtccagggtctaccaaagtatggggcttggcaaatgtccctggtcttgggttgggaccccaaatggcagtgctttagcaataaaagaaaatcagaatcaggcactctcacaaggaccacagctttgctttgattctctccatctctgtaatcctacagagcaaggacgatgaacaaaccaaagccaaagccaacaaaaagcaaattccacaaacatagcatggaataaatgtacctagacacaaaagaatagatactaagttattttatttatttcaacacacaatatataatgtttaggaatgtattcttaggtgttaaggtcatatgaaaaatcaagaaagtatttataataaaaggcaagataatggttcctctggtgtacagaggagagagaacataagaaaatcttctgtgttactgccaatcttcctctattttggagtgatgtgtacacatatgatcactttgtgataaatcagcaagtgtatattttattttgaaatttgtgtacctgtgtgctgtatttatactaagaatgttaaattgtaagttagatcatattactctgtattgaaaatattccagttacctgtgattgtctacctccctgttctcatctggaaacagcctgcccccggccccattgctcgttttactctaggtacatggaattccttgctcttgttcaaaaggacaaaaatcttgcccattttagtctttggacttgaactttcttctcttcctgcaatacacttttattgacttgatccataattgtttcccaatccttcagccccctattaattgtagccttcttagagacgtatttcttgaccagtcattctaaattgacaactgaaaacccaacaaatgctccatatcgccttgtttatttccttcatattggaaagcagatgatgacatttgatttgtaattaatatatcttttatccaaggtaaaatatttgctgtaatgtaagatctatgatgggaggtatacttttggtttttattctcagcactaaatgaatcataggccaacgaaaattattttgagaaaagactttgtgcaattcctaaaaattagtctattataccatgggtggtaggagaagcttaggatctcatcatataatttggttatcctagctatgctgctaagcaaaacaaatatttatttagcccagatatgtagaattatcttagacaaattttcatatgtgtccagtgccagttttcaaaatgacgtctttttatggcaacacctaagtgaagtatttctttcagggacattatacacaaaggaaagtaaatgttttagttcaggtggtaatgacaaagttttcgtaatgatacaagttatttgtaatgctaaagttattgcgtttcatttttacttgaggaattacatatgccattttagaaactttacttggatgtgtatgactgtatttcccgccgtagttagtttttaagaaagaatgtttcacctaaagccatattcacctttccagagtaaaaaatcaatatttagccttaaattaataaactatgtttttgttattattggtccttttgatactgtatctctttccatttcattaaaattaaataacttacctgccatatttattatctgaatactaatttattttcccatttaatttttttctttactctttggtgtttctttgctcagaccaaacctagtcttgatctagttgcactgtgctttctttgaagttcaaatgcatctaatgaatcatggcagtactctctatcaccttacaggcatcaaagtaaatcagccagaacagggatagaaattccaaaggtccctgccacctgtgctgcaacattcactccaagtaaacacttagtcatctctttagttgtgaacagtgatgtggcccaggagcctttcaccgaaggtggcccagcacttgctgctgagttttcatgcactttgcttgcatttatcgccaccatgaaaattacccaaggattgaaaagtctatcaagtatagaggagagaaagctaacaggttcacagatgcagataatttagtgttttaatgaaaccctggattagataatgcacttctctcttttatttaattttttaatgttacctgtctgctattatacaccatttgttcttatagaacacacacacacacacacacacacacacacacacacacacactctctctctctcacccctacctcaagcaaaggaggttgcaacactttttctcaaaaataacaaatcaacctgtaattcttcacactaacggtaaggtttatgtgtttgcttcaagttaaaattactacctttcagatggattatctttttatttttattttttattttttttgagatccacctaggctgtcagagttccacatttggcatcattacacccagttaatgtaagacagcttatttttatattgcggtgttttatagatttttttattgcaccattaagagcattttgttttctgcaatattcccagattttcttgtcataatacacaacatcccacagtcccactttgtgccaaatctcatagcattcacttacatctacttttctgcctcagaaggctaggtaatgagctgagcttcagaaaaagaaattgctggtttagtttttttgcattacagcccaaacagattgttttcttttcgataactagccaatgctcagttcacagatatttcccctggtaggtaagcattgccgatttagtgtccagtagcatgtttacagttcataaatgtcatctgattttcaatttttaacctgagaaatacaatgtttctttcaatattctgtaaattttaatggaaattttgtggaatttctcagttgttcagtgaagcaaaaatttgttcagcatgcctgttttaatcctaatgaaaactattaaggagtttatattcttgatattgactatttttgacaatatagtattacaaaaccatttcgacagaagcagttttagctttggagtttacacagattattactgtattatctatgactttcattcactcaaagtacatacatatctcataaagacaccatttgagattgccaccatttaaaaaattaataaataatagttgttcacatttatgaggtacatatgatattttcacatatgcatacaatgtgtaatgatccaatcagggtaattgggatatctgtcacctcaaacatttattgttcctttgtgtggggaacattaaaaatcttctctcctagtgattttgaaatatatgataaattattgttaactctagtcaccctactgtgctattgaacactagaacgtattccttctaactgtatttttgtacccattaaccaacctctttttgaccccttctctctgatatacttctcagcctttggtaaacaccatgctacttactacctccatgagatcaatttttttgcttctacatgtgagtgggaacatgtgatatacgtctttccgtgccttcttgcttcatttttgataatattaaataaaggtctaacacctagtggtcaagtttgaggttgacatggaggagaataagacagtcatatttaggctgaaatgattttaaagacaatgaactctctaatgtacatggatatacatttgggattcctattcagggctggaattcaaagcattctaaacatgttaacaacagcatttatttatagttctagtggcttgcgatccatcaaatggcacaattgctactggcctcagggttgacggtcttcctggcagtggtcccacagattgcaccagtgtaatttcaaggccttgatttgccaatgatcttatcattgtaatgatccctatattctctttagctttctcattttataagactgacattagaaagcaggttcatattaacatcatagcttgaccaggtcttaacagacaggatgactaaactaccagtctacttgaatttgttttttcagaggtctatatttaagcttttttccaaaagattaatgttggttagcatgagaatagaagacagtgaaagcagatgaactttcaaggaataaaaagaattcatgagacctaggttaattctagaactttgaagattagatttattcatctagttggtctgaaatctaagtgattttttttctttttttcctcagagataatattcccaaataagatttttaagttcattctaaagcagctaaaattcttgagtagctatctacttatttggactaatttaattttatcccagtgatattaaatatatacacagatacacatatacttaaatatatgaattaatattttcaataaagcaacattttagaagttaaatagactggaatcaatcagcttaataatgcataacaccgaaagaaagtaagaaaggaacaaaataaaaaaacattaggggaaaagcaggtaagttaggagagggatacatgattctacatttccttgttaaggaggagctaattgatttcacaagagccagctggggttttaaatgctcactctttttttctggtcaatattaataacaataaaatcaatgcctaatatgatattagccattaaatggttattccacgttcatatttgggctttcacaaagtcactgaagttttttttctttttttctgagaatctgtggatagtccagtcggtacagtagataattgaaataaagtgttccctgcatcctttggctctgcgcttcagaactgggccatgggttttcttttaagaggcgtaatgttgtgctggaaaccacatcagctttgacaattgagttcttattttcacttcactatacaccaactttatgagccctcatggtgcttaaagtttattaggaaagaaagaaacaaaagcttcaggggccaataattagctaatttcattgtgatttcatgctacgatgcttttggctcttcaaatgtgtcctcttgccccaccaggaacctggaataacatgagcattcctcttccccttagcttacctaatttgttcctgttcttcaggtctcagtttaatatcatgtattctcttacttccctaatcttttcaacagatttggtgcccttagtgtgcctttatcatcagtactttctcattatagcacttatcatactttattataattaccaacttaattttcttttccaccttatttctatttgaatctaccacatttcttggcatataatactagcacaataatattagtagacaatggataaataattgagggttacatttaattgtgtctggactatagtaagaatccaatgcctaataactgtgatcactatctcaaactatacctctttctaatttctaaaacaaaagaattttaatagtatagaaaatgctgatagtcatttaatattttccgacttcaattaattaaagtctttcatagaaaaggatgtggtgttataagctttcatccaagacatttaattcaagttttaacatatttctaatgtatgactaagcatattaattgaatagcgttaaataacagtaaaggttaaagattagaggatgttctaaatgaaagatgagcagttcgctgctgtatatgcatataggcaaagaacagctgggacttctcttaggataaagaaatatgctcaaaactgtacaaataaaatgcagatctttaccacatattgtattgaatgtcaatttacaaatggactaatctgtggagaaatataacatttgtagttaatatgaataaaagtaatgttagacaatttaaagcaggtaatttgtttcacttatacattgctaagtatatagtgtgattttccctgaacacagaattatatcacatagagtttttctttttcttttagaatcataatgtcttagtcaaaatctcatataagctctagctttttctgtcattcaaatattcccacattgactcccttaaattatgtggaagtttccttctccccagctcacatgtgtcaatgaatttatctaaagatcttactggcttaggacttcaagaacaaatatcagtaagaacctttttaaataaaaagttttgaaataacacattttcctgattttaaaagtaatgcaaactaatttcagaaaatctgagaaaattaaaataatgtaaaaattatattatcctgttttagagataattgcttttctttttatgtacttcaagaatgtatatattttaaaagaaaatcataaagataacccgtatagttttatagcaggatttcctcatgtaatttcatgtcataaacattttcaaatgatattaaaattatttaacctcagatttttaatggctatgccatgagtaatttaataatacccctaaatttggacattttcattatttatccttatgcaatgaagatatttgtatataatttgttttctgtacttagcaatttgtaataggtgttttctataatgattatgaaattaaaacacatacacctctaataggatatttctactatttagatactattaaatggtataaaaacatgtttaaaagaatattcaaattacaaatgaaatttttcttttatcagaaatatctttgccaaattttataatagagaaagtaatattgaggcataattatcttctttaatattatatgagtgaatggggatatgcaattagttacaagaccacaaacattaaacaacagaaagttatcagctaaacctaaaaacaagtgtgaatttgtcaatatgaaggtagataaaagggaaatgtgtgggctatattgaggacctgaaagagggactaggcactattaaacctgatgggaagcttaagtgaagaaagcccttagagattatgccaggatagaatgaggtctcctttgtaaaataagtgaaacaatgggacacatttttttcagttccacaagtaggtttctaacaatctcgatgttcttttgttacagcctttgagttaaatagtctgagtttcttcagcttcgaaaatgttaaaataggctgtgcatggtggctcacgcctgtaatcccagcactttggaaggctgaggaaggaggatcgcttgagcccaggagttccagaccagcctcggcaacatggtaaggcctcatcttacaaaaaatacaaaaaatttagccagtgtcatggtgcttgcctgtagtcccagctacttgagaggctgaggtgggagaattgcttgatcccaggaggtccaggttgcagtgagccattattgtgccactgcactccagtctgggtgacagagtgagaccctgtctcaaaagaaaaaaaaagtaaaatactgttttgtttgcaatcagagccctgtctgtctttgtcaccatgtatcagcagtggttagcacatagtagatctccaatacatttatgtgaatggttctatgtaaaagcaaacaccacactgattaatcactaattaaaagcaaaaagcaaaaagcaaaagccaaaagtcctcttatacaagattctgcagccaaagagcaaggacagcagaggaccaggctcagaatctaatcataaaagcagcagatttcaaagaattctggtttattccatgatcagaaccctgatagttgttataatgatacatgaatatctggagcaatgcaatttaaaagtttgaacttctagatttctagattttctctgggcctgcagaagttgttcacttcctcttttcacaagatagtatcttctacccacttgaagtcatacagaggctgacaaagggtagatttcttataggataattcttgttcttcagggattactctcatcactccctctgacaaccagacaaatactgaatgtcaaataccagcacaactgggacaaagatgctatgggatttctaagagagaagaagggctatcattgaagttactgaaggatctgcaggtgcaggaagagtacacagagtatgtagcctaaggggctctgacaaagggtgaaagaatatacatttggatacagtagctaatggatatggaagcactctactatgatattaagatttaaaatcctggcacataccctagatgatgttaacagctgctaggatggtacctggaaaatttatggctcacattgagtgaggtagaaattccagaactgccacggaagatgaaggaagaagggaacaaaggactcagtgtattgagcatgcctgagaaaatatatatggaaagctagaaatcccgcaagataaatataatccaaaggatggaccactggacactccatttaccaaaatataaagagtgtgttgtggagaaggacatcagtattgttgagaagctcagtggtaactgtcttctgaaggccagctggtaggagatcacattacagaacagggattcttgaataaaaatgggaacgatagaatctctaaataatagataccaagaggtgatatttcattgacagaagaaacatagatgtagatttcgcaatgagaaggaagacaggagtggcaaacatggagtctaaaatttagaaaacagtagaataataaatagagtatggagttcctataggcaagacagatggacagctaccaaggattttgattaatttatacaaccaaaaccaatcaagaatggataatcaggaggttaaggccaggcacccttcttcttcctccacaactctctatcttttgcccagtttctagacctgcattgattctcagacttttaattgaagatgactgataaagtagataacagatctttcagggaaagaacctaataataccaggaacatatgaagttgtaattttcccagtccttttccaacaggacctgagactctttactcaagtgactatgtactaggtaagaggaacatccagaacttctgaggtttgcttgattcagaatccaaactcaaattaggccaggtacggtggctgacgcctgtaatcccagcactttggggaaggtgggaggatgctttgagaccaagagtttgagactagcctggggaacacagtgagacctcgtctccacaaaaatacaaaaattagccagatgtggtggtgtgcgcctgcagttccagctacttaggaggttaaggtgggaggatcacttaagcccaggaggttgaggctacaatgagccaaggtcacgccactgcactccagcctggggaacagagcaagaccctatctccaaacagaatgaaacaaaacaaaaatactgaaattcatcctttgatatccaaactgattccatactcctaatagaatgaaggcatatgggagccagatagtaagtagagttttggctggcatttggctcacggtgtaatcactgggtccacagaccaaccagatggtgttttccaagatcttccaaggtattactggattatacatccttggtagttggcagatcccccacactggttttttgttctatatgtaacagccatcaactgtcgcttcacccacaactttattcatttttcatcatttttttttttagacaaggtttcactctgtctcccaggttggagtacaatgacatgttcatggcccactgcagcctccacctccctgggctcaggtgatcctcccacctcagtctcctgaatagctgggatgaccggtgcatgccaccatgcctggcgaacttcttttgtgttttttgtagagacagagttttgccacattgcccaggctggtttcaaactcccgggctcaagtgatgtgcccaccttggccttctaaagttgtagaattaaagtcatgagcctccatgcctggtcatttttttaatctttattgattttcctaacatttatattgtcagaaacaattttttacaatgtttccgtatttttggtgtaatatcaaaatacttctatagtaaatcatttgggttaagccattttcttcttaaagaaggcgggggaggtggtctctggaatattcctatttatgacactagtctagcaactataaaaatatggatagataatggtatatgacagtggataactgtaaacttatccagacagtaacaccaattgctgttgctgcaccagctatgttattttttttttctgaagcagattaacacagccttcagtgtgagatataaagccatcaaaatgaaaatgcatttatttccagccatttcaaaaagaaaaatcagaatcagtttagatccacatggaacaaaaagaatacacttatagagttttaacttgagttctgttaactctcttgacccctattataatgcagtatagagacctgaaacattgacacagtatgtggaacgccacactggtccattatatcagcagttctgcaaatgtggtctttgaatcttgaaggtccctgaaacactttcaagagattaatgaggtcaaaattatttttatacgcattgtgttaacatttgcactgatgaagcaaaacaatgttgtataaaattgctggatctttagcatgaaacaagtagcacctaactatacttgttattaatgccttgttcgttgctatgaattacagtttttaaacaaagctttaaaatgtccttgatgaagcagtaaaaattttattaaatatttactcttgagtacaattttttagtattgtttgtggtgaaatggggaatatgcataaagcaattgtgctgcataacaaactgtgatacttgtttaaagaaaaacacttgtgtgattgagaacaaaatcagccactttgttcatggaacaccttcaaaggtactgatggtaaaattatggttattcagacttgggtatcttggggtagttggcagatattttcttaaaaatggaaggagtttttcagtttgatggaaaacaactgacagtatttgttcccaatgataaaattcaatgttccaagtgaaaattaggaatttagaaactttttgtatttactagtcttagcttgaaatcaacaagtatgatttttgatattgtataataatctgtgtcaatatttgaaagcctgcataacagaactgatattattttcaaatgattaattcatggtattaaaaatcactcatagttaagaaatccattcaaagttcaagacatacctgtagattttaatgcaaaagagtacaaaaaattgattgatgtttctatatttcacattgcaagtaacctttaagaaactactacttgttgaattttgatataatgccaaagaataatatccaaaagtatttgaacagattattaacatatcactctttttcccaactacatatctgtgtgaggcttgattttcttcatagacttcaattaaaacaacatattgcggggaggagccaagatggccgaataggaacagctccggtctacagctcccagcctgagcgacgcagaagacgggtgatttctgcaattccatctgaggtaccgggttcatctcactagggagcgccagacagtgggcgcaggtcagtgggtgtgcgcacagtgcgcgagccgaagcagggcgaggcattgcctcactcgggaagcgcaaggggtcagggagttccctttcctaatcaaagaaaggggtgacggacggcacctggaaaatcgggaaaatcgggtcactcccacccgaatactgcgcttttccgacgggcttaaaaaacagcgcaccacgagattatatccgcacctggctcggagggtcctacgcccacggagtctcgctgattgctagcacagcagtctgagatcaaactgcaaggcggcagcgaggctgggggaggggcgcccgccattgcccaggcttgcttaggtaaacaaagcagcctggaagctccaactgggtggagcccaccacagctcaaggaggcctgcctgcctctgtaggctccacctctgggggcagggcacagacaaacaaaaagacagcagtaacctctgcagacttaaatgcccctgtctgacagctttgaagagagcagtggttctcccagtgcgcagccagagatctgagaacgggcagactgcctcctcaagtgggtccctcacccctgacccccgagcagtttaactgcgaggcaccctccagcaggggcacactgacacctcacactgcagggtactccaacagacctgcagctgagggtcctgtctgttagaaggaaaactaacaaacagaaaggacatccacaccaaaaactcatctgtacatcaccatcatcaaagaccaaaagtagataaaaccacaaagatggggaaaaaacagaacagaaaaactggaaactctaaaaatcagagcgcctctcctcctccaaaggaacgcagctcctcaccagcaacggaacaaagctggacagagaatgactttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaaggctcaggagccgatgtgatcaactggaagaaagggtatcagcaatggaagatgaaatgaatgaaatgaagggagaaggaaagtttagagaaaaaagaataaaaagaaatgagcaaagcctccaagaactacgggactatgtgaaaagaccaaatctacgtctgactggtgtacctgaaagtgatggggagaatggaaccaagttggaaaacactctgcaggatattatccaggagaatttccccaatctagcaaggcaggccaacgttcagattcaggaaatacagagaacgccacaaagatactcctcgagaagagcaactccaagacacataattgtcagattcaccaaagatgaaatgaaggaaaaaatgttaagggcagccagagagaaaggtcgggttcccctcaaagggaagcccatcagactaacagcggatctctcggcagaaaccctacaagccagaagagagtgggggccaatattcaacattcttaaagaaaagaattttcaacccagaatttcatatgcagccaaactaagcttcaaaagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccgtcgagactaggaagaaactgcatcaactaacgagcaaaatcaccagctaacatcataatgacagcatcaaattcacacataacactattaactttaaatgtaaatggactaaatgctccaattaaaagacacagactggcaaattggataaagagtcaagacccatcagtgtgctgtattcaggaaacccatctcacgtgcagagacacacatgggctcaaaataaaaggatggaggaagatctaccaagcaaatggaaaacaaaaaaaggcaggggttgcaatcctagtctctgataaaacagacttgaaaccaacaaagatcaaaagacacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgggacagaaagtcaacaaggatacccaggaattgaactcagctctgcaccaagcggacctaatagacatctacagaagtctccaccccaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagaactcaggattaagaatttcactcaaaaccgctcaactacatggaaactgaacaacctgctcctgaatgactgttgggtacataacgaaatgaaggcagaaataaagatgttctttgaaaccaacgagaacaaagacacaacataccagaatctctgggatgcattcaaagcagtgtgtagagggaaatttatagcactaaatacccacaagagaaagcaggaaagatccaaaactgacaccctaacatcacaattaaaagaactagaaaagcaagagcaaacacattccaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaattggtaccattccttctgaaactattccaatcaatagaaaaagagggaatcctccctaactcatttgatgaggccagcatcattctgatatcaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatggaaggcaggttcaatatatgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaggggtattcaattaggaaaagaggaagtcaaattgtccccgtttgcagacgacatgattgtatatctagaaaaccccactgtctcagcccaaaatctccttaagctgataagcaacttcagcaaagtctcaggatacaaaatcaatgtgcaaaaatcacaagcattcctatacaccaaccacagacaaacagagagccaaatcatgagtgaactcccattcacaattgcttcaaagagaataaaagacctaggaatccaacttacaagggatgtgaaggacctcttcaaggacaactacaaaccactgctcaaggaaataaaagaggatacacacaaatggaagaacattccatgctcatgggtaggaagaatcaatattgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaactctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctatagaatgggagaaaattttcgcaacctactcatctgacaaagggctaatatccagaatttacaatgaactcaaacaaatttacaagaaaaaaacaaacaaccccatcgaaaagtgggcgaaggacatcaacagacacttctcaaaagaagacatttatgcagccaaaagacacatgaaaaaatgctcaccatcactggccatcagagaaatgctaatcaaaaccacaatgagataccatctcacaccagttagaatggcaatcattaaaaagtcaggaaacaacaggtgctggagaggatgtggagaaataggaacacttttacactgttggtgggactgtaaactagttcacccattgtggaagtcagtgtggcgattcctcagggatctagaactagaaataccatttgacccagccatcccattactgggtatatacccaaaggactataaatcatgctgctaataaagcacatgcacacgtatgtttattgcggcattattcacaatagcaaagacttggaaccaacccaaatgtcccacaatgatagactggattaagaaaatgtggcacatatacaccatggaatactatgcagccataaaaaatgatgcgttcatgtcctttgtagggacttggatgaaattggaaaccatcattctcagtaaactgtcgcaagaacaaaaaaccaaacactgcatatgctcactcataggtgggaattgaacaatgagatcacatggacacaggaaggggaacatcacactctggggactgttgtggggtgaggggaggggggagggatagcattaggagatatacctaatgctagatgacgagttagtgggtgcagcacaccagcgtggcacatgtatacgtatgtaactaacctgcacaatgtgcacatgtaccctaaaacttaaagtataataataaaaaaaaatattgcaataaatggaatgtagaagcagatatgagaatccagctgtcttctattagaccagacattacagagatttataaaaagcaatacagtgccactcttcttactaaatttttgttttttaaatatagttatttaaaaatatatttatagtaacatgtaataggtttattaagacttttaaatgaatacatattttaataatttctcagccttaatgttttatatggtaacaatagatgtacctcacataagcaaaagttctttaggattttcaataatttttaagagtatgaagggatcctgagactaaaagtttgagaaccagtgtactctttggctaattgggctagatgagcaataaatgatatgtaggctgtagatcttataagataatgacttgccagggtgtgaaagataaatcctctaaagagtcaattcatctttgtattatgcatccagtggtctatagtatgtcaggacatgttctccaaaataaaagataaagtattgtattttatacttacagcactaagaaaaagtgcaatgttggtaccttgtccccattcctataagttcatccacaagcatcttctttggaacactttgttaagatctacaggtccatttgtattctcaccttgggctactctctatacaaaggataactgggcaggctcccagagctctgctcattgggaatttctcctttccactaccccaaaagcagcactgctggaatagcagcccttttttagaagcacactaacaaagcaagataaactattcaagaactctcattaaagcttttccttctctgacatttggtcctaagagtcataggtgggagctgagggggaggcgggggtccagcagtggtgggaacaacagacactcatgcagctttcctcgctctctggccctacatgtctgatccaggtgttctatctacttctatcttacaatgaattctgagcttatgacttggttggtctaacaaaactcagcatatggtgggccctgtgatttcattatggtcacttgctatggtcagatgatccatatttatagagtccaagtagcacgtccagagcttgttctcagttgacatatagttttctgctgccaatgccatagccttgctccacagccttagactacattgtgattctcttattgaagtgtgtcatcaactccacaaagcatcttttccacatatatatatgtaccgcatatgcggtacatatatgtactatatagtacatatatatatgtgtacatatatagtacatatatatagtacatatatgtggtacatatatatatatagtcctgtagggtctgtcctataacttaagttacagggctgcttgcatttcagattgacctataatagaatcattttatggtctgcatctgacacaaagctataagcctctgttattagataaagtagttagagccatactcacaagtgcaggtcatactgcctaccaactttgccctttctgtttgcataaccttattaaataaacctaatgatgacatgataggaaaaataattcatgaccattctcatgaacatagatgcaaaattttaaatgtaatattaataaataaaatccagtgttgtataacaagataatacaacattccaagttagatttatttaaggaatacacggttgctttaaaatttaaaaattcagcagccaggaaaggtggctcatgccagtaatcacagcactttgggaggatgaggcgggcggatgacttgagcccaggagtttgagaccattctggaaaacatggcaaatccctgtccctacaaaaaatacaaaacttagccagacatgatggcacatgccagtggtcccagccgcttgggaagctgaggtgggagaatctcttgagcccaggaggcagaggctgcagtaagccagtatcacatcactgcacttcagcctgggcaacagagtgataccctgtctcagaaaaaaaattaagcaatgtaattctccacattcacaggataaagaataaaaagtatgattctctcaatagatgaaaaacaataattttataaaaatcaacatgtatttataacaaaacatagtaaatttgaaataaagaagaaatctttaacctgaaaaggtgtatccataaaagtatacaaggaacattagagaaatggtgaactattgaaatctcccccacagcctccaatatcaagaacaagacaccaacgtccattttcaccccatgtattcagccttgcactggagactttaaacagagaaataagaaaaaaaaaaaaaaaagaaaaggattaagggtaaaaaaagaaggaatgaaccatcatcatttattgatggcatgatatttatttaaagtccaacagtctatagatacagtattagaattgataagtgattttagaaagctgtgtattttggtacaacaaaaacaattagagagtaaaagttagaaaatatattttttagaatagcactgttaaacaccaaatatctaggcataagacagctacatagaaagttataaaccattataagaaactaaaatgaaaaaaatggaaagctataccatgttcaccatttagaagactcagactgtaaaaatgccaattgtccctaaactgatcaatgtaattttattcaaaatccctgtggtatttatttatttatttattttagaggggagacattaacaaactgattaacaaaacattaattaggaaactgtagtactggcgtaaggactgatgaatcgacccatagggtagaacaggtgtcagcaaactgtggctttgtgccagatctggcctgctgcctgtttttgttggagcagagccatgcccatttatttaggtattgtttttggctgtttctgtggtacagtggcagggatgagtaggtatgacagagagtatatgacccaaagcttaaaatatctactatctgacactacagaaaaagccttctgacccctactgtggaatacagtgttcagaaataaataaactcataaacagaaacttgggattaagattatgttaccactgagtagtgggtgtaggagtcttttcaataaatactgctgggtcagttggataatgatatgaaaaaagaaattattcttgatctaaatttaaaccatgcacaaaaatcaattccatcttaatgttaaagttaagccaataaagcttctcaaaaataatatagcagatgttcaaaattatttttaaaaactacagataaaaagcaataagaaaaaagtaataaatggatacattggactttaataaaattaagacattctgatgtttaagactttgtaaactataggcaaggcacacagtgaaagaatatatttgcaacccatagagaacaaaagattctagttccttcaaatataaattatatataataccagttaaaaaataggcaaaagacttgggcagatatttcacaaaagaaaatgtccaaatgatctggtcacataaaatgatgtttcacatcattagtcatcattaaaatgcatatttacagaacaataaattaggatgcctaaattaaaaagactcatcattcaaagtgttggagaagatgtagagcagtgatagcccttgtgcactgctgatcatagcgcaaatcagtacaatcacttttagtagcgtctactatagctgaacatgcacataccttatgacccagcaatttttattactcaatttatacccagaaaaatatataatcttcaatgataatgttcatagaagtacaattagtaatagcttcccactggaaaaagctgcgtactcataaaattaatactataaaataatgaaaatatggaatttaaaaggccagatgcaaatcaatatatgccatataattctactataaaatataaaaaccagaaacatttattcatggtgaaaaaggtcagcatattgagtagggcaagtgaactaggggtttctgtggtgttggccgtgttctatttattgatcagagagagtggttacataggtgtattgactatcaaaattcattgacggtacatataagacatgtacacttttctgcacatatgttgtagtttatgacagcgttcagtttcattaaaaggataacacatagagagggagtagggaatcggaggagatggggtgatattttagacagggaatcagagaaagcttctcttaagagagcatattttaacaatgacctgttttcagtgacctgaaagaagcaagtgagaagccatgcgaagccatggaaagtcatattaagatctgagataagaatattccaggcagagagaatatcaatgcaaaggctttgagatgatgtcatgcttgatgtgtttgatgagtatccgaaagcctacttgggcttgagtagagtgagaagagttgtcataaattagattggctgacacatattaaactattgagtgaatgacttatatgaagattcacatttctggtcttggcatgattatttcttgttatctgtccattaaatatacatgaaacattgtaaaatggttttcaaaaaacctgtctattagccttagaaaacaacagatttaataccagggtaatcactttacttagttcaagaactgaattccatttcactaaattttcaaagtctagagaaaatgttttgtccatcctacacaattcctaatgaaggaaaaagacagaaaccagcagttaatcaagacattagttaagttgagggaaaaatatgttgataaaagcataatctcttcatttactgatcatttatgggaaaagagctatacgcaaattttatatatgcatatgaaagttttggcgggcacagtggctcatgcctgtaatcccagcactttgggaggtcaaggccgacagatcacttgaggtcaggagtttaagaccagtctggccaacatggtgaaattgtctctactaaaaatacaaaaattagctaggcatggtggcatgcgcctataatcctggctacttgggaggctgaggcaggagaattgcttgaccccaggaggcagagtttgtactgagccaagattgcaccaccgcactccagcctgggtgacagagtgagactctgtctcaaaaaaaaaaaaaaaagaaagaatgtcagatttaagacccgacaccagcagcaatggaaaccgaacaatagaaaatcattctttcaaggacttatttctcttaaagatataattacctaggattgtccatgaagaatgagcaatgtcatttgcggtgatggaagctcattaccaggtggcaaaaaaacaataattatactttctacattttataagaacctagacatactacattttaaccctgtgatgttttcctttttaatttaaaaatagcagcatcagcaatcaccaccaagaataaaacaataacacacgcgagaacaagatacatattcaaagtcctgagacctcacagtttccctgagagttgcaagtgtcctgcaatgagacaatggacgcttctgcctagaaagagttgctgcagaagcaggagacactaaactttaaacaaaatcatagaactctttcaacctttcttctcgtattgagtctacgttaaagtgccataaatcttgttgacagttactgccacatctattggcacacagtcagcatctgtttgaaaagagttttgcagcataggtagggcccattacctgttctctgtcttctcttagtatttattttcaccccagcaggcagcacctcacaatgtcattaatttcttagtcagcctgtactttcccttacagccacttagagagtgctcttataaacagctctgtgcatcaccagaaatgcattgcacctctagaaggaaatcagaaatttaagagcagcaggtacaacgtgaactggttgctgaggtgatgtggtctctgttgctagatcagtggggggtcatcatggtgatttggttatatggttccgagggaatcagtgctgttggccaacacaatcttaagaaagtgagcgatggtagatgtgcaactgaagggaaagcagcaagaaaatacgatattccacgattcaccatgaagaagaaagcaacaaatgagtagacaagacagcaagaaattacctgcataaagaaggcattctaatcatcccaatacctgaaaagagtgaactgtactctagtcaactttcgttgggataaatattctaataggaattgcccctttcttcagaaaggatgattaaaaaacatcatcaatcaaagctggaccagaaaagcaatcagaacctaattcttcattagaacaggtttaaagatgtccagtcatgaggactctactactttaatcataatatggtttttttacaaaaattaaaaatttccataaactaaaatatggatcacatttatttttattcttctgtggggccaggactcatttctagaagggctactggtccacggttagaaaatggccccttcacctctgtggtaaatgtgggctatatgtttggatgtgcttcaaatattctagatgggtagctttgtgcatattttaaattttatagaaaaataatacaatcttacatttctatttaatcattgtttaaaatgtattgagctgtaaaaatcacacaaggaggtagaaaagtcagaaatgtttatgtctacttatataggttatgagacagacctggcaaagataattaggtcacagatttcttttttttttttttttaaccatacaacttattgtattcatgtgcttatagtctaggaaactaaaaactaaaacctgtgtgtaagaaactcagtagccttcaatgtctatgtcaaaagtctcccctattagcagctgctaagtggaaaagaaagctgaaggaaagcagcctgggtaagttgagaattctaataaaccaattggtatgatactaatttgctctttttttttccttgcccatggaatatgataactcatttttatcatgcacctttgggaagattgaaaaccaaaaaaatgaaagaaaagtcagtacagtattagaactaatgtcttcccacccaagctactgtgttctggtgcatgagtcaggtggagcggtgctacaaggtcaaccaagagagtgggttgttcaactactgtggcaggaatcaccatagaatggacattctcacctggaggaggacttgtaatgaaatctgaagaaaacattattctcaagagataatatgtagtggaaggaaagaaaattaagacagagaagaaggaattcccttctcctgtctatacattttcaacctcctttcctttgcgggaatggcataatgatttgtttcttagagaaccttgttttgttgtttcctatcagcttcctctgcaaaacaaaaacacccctgaacccgccttcctcttgaagtaatactttggttccctgattttctgattagggctttcaaaataatttgtgttcaagtatgtttttattccaggcttcattttgatatctacatgtccattattagcctgtccccattaaccaattaagtacacatgcaaacacacacatgcacacacacatacactctctattacaacacatatacacaagacatatctgagtactcactagtaaatactcatgtgtactaaagtctaccacaggggtttcaaatgtcagttgtgttttttagtttaattcaacttttatacctatagtaattcatttatttcatttttgattattttaaatgttttggataacagaatggctcttgaattgcaacggaagttaaatttcagtatctaccataaacagcacattcatttcattcctcaagaatgaaaacacctgttatagttcctttttgattgctgacttttaaatgaacatttggatgaaaagtaatgtttacaaagataacatatataaaatattcagaagacaaacagcagaaatgagaaacaaaaaaaagcaaacagaaatttaaaatagtttgtcttaacaaaacaattacaataaagaatttattaaaaacctttggaagaaactgtttccagtaatttaaaaataaacagaaaatatattaacaaataattgaaaataatatctaactgcacaaatgtataaaatatctaactcaaaatagcactgttaatatgtcagtatattttagttaacatacttttaaaatgagacacacagattacttcattgcatatctctgagagctcctcaaatcctacacacattttaaattgttaaatttgatacaattactgtctttttaaaatcaaaagagcattttcctacttttagactgagtaaaagatgcattgactccttgcttcccactagactcactagacattctgatactgcactcgtggtgagctggccagagtgaggttgtgaaaaaaagacaacaataccgaggacatttgggcaaaaaagtatttatcaccaagtataaaaatttttgtaaagccatcactgattaatacattatttcatttttgctcaattacttactagagaaatgtataagtagcattttcagttccttgcaagagaccatggttagcttatttcatggcaaaaacatgttaaaatatgaaatgacttctcaaacctattttatatggaagtcacatttttgtgcacatgactttttaattttgaaaagacgttttatcacaaattccatgaaactttctttcagtaaatctaaaaatggaatgttctatgatactagttgactttccatctcttactattcttctaacaggatactctgaaaatttgaatatcatagacttagtaagaaaatatgttttatgtagctttttgggttaagaagcattagtaggaaaacaagtcagtgtgctaagggctttaattatccgaagagacatacatttatatattcggtaaaataaaattatttaatgttcttcgttattcaatatttttgaaaatattgttatgtttgtgttttattcacagaaattcagttttacaaatagcagctgattttttattaaaccagagccaaattactaatttcagtattaatagttagctttgacatgtttaaaaagggtagaaagtacgtaatagacctgtcttcaactctgaaatgaacagctgctcagggaaatggaattgttcaaagatacattttctttctgccaatctgtgaaatataatataattattctcttttaatgaatctctcaacgaggagcaatctttcagagcttgagcaggtaaaatataatgataatgggaacagctttgtaaataaaaggatgaaatgagattgttattttgtgccatattatgggataattaaaataacagtgcagcattcagcaggtatttgaactttctaaaaaatgctccccagggctcttttaaattagtcatgtttatccatgtagatttgtaatcttactgcaaatgtctgtcaccttataatattcagacctcaatacttaatctgattaatatctgatactgtacaacagctaacaaaccttgccgaaagcagacattaaaataataacctgagttgacaaactcgaatttattaaaagaagaacaatagaactattttcattaagccaggagaatgattactctcagtgtggtgggactcatgaactacatgagattctatgtatttccacaaaacagagtggccgcacacttccaaggagctactattcacatgataattagctctatataataaaagagtatattcatggaaactaaactcatggcaatggaactccaatggctagttgctttgtttaattcaaattcatacagctcaaatacaagtagatgatgagatctgatttttcaagaaacaagttcctttgcagttcactggaccctcctagcacccttcttagaaaaagtgtgcaagcagaatcaagtgctagagtgtggccattatatcacatccattaaagttattagaaaacaaaatataaataaagaaggtaaaataaaagtctgatatctcttctggtataactttaaattgctagtgagatatcatttcacgaaatggtacaattgaagttttattctcaattaggttgtagtttttctcagttattattctctatctggaggaacaaggaaaatggtttttaatatcaataaataagtaactgtgacttctgtttcatactttctgtagctgatttcatgtctttttaatagttctttcatgcttataattttttaaaatcctccccaactgattgtcagatatcctgatgatagaaagaaattattgtaatttcctggggagctatctaccaccttagcttcaaatcattaccctcaaagggcaagatcgctatcaggctttatatttaggaaatttgtatggatagcctcatatctggaaactttatgtgtctactattagaaggtatactctacatgtgttatttaatcacttgagcgttatattatcaggcaatatttatttagtttggaaatctgttttatatgtctaccactgggtacgttaaattgacttaaagttaagatgcagctttactctaggtaggtgatctgccactattttcaatagacagaggactggacaactgtgccacagaaacaaataagatgataattttaccactgatatcagatatcaaggtctacagaacatacccattaaagcatttgtattttctaatcttctctgcaattgcaaaaatcaatagctagaaatatagaagggttttagaatagcatgtagaattttgaaaataaacaatgtattcttcctcagaagtcatataagattaacaatctgagccttaattaaaaatcctgagtaaacacattcatttcctttttcccttgcaactattaaattgatcaataaaccatatatttttcaaaatgcgactggtactaaaaactcatttttcttgtttccctacattcattaggtgatagagagttgctcattattctgccatccctgtgtacctttttggattttgcccattttcctaatttcaatttcttttcaggaatgaacaaattgatgatcaatggtgatgatttcatttatatattagaaaataccacttttctgtttaaatgattacttacctgttatattcaatttaaaatggctttgcagtcttaccaattctaccataaaaagttatagcattatacttcttgtcagattttgtttttaaaattatactgcacaccagattttttaaattttactgttgaacaaggggaaaggtggcaataatgatggtcatgaaaaggtaatttgtataccttcagaagacatatgagaatattctaaatattgtcatctagtggctcagttcctccaaaatattattcatatttctagtttgtgctttttaaatttctaggagctaccagtgtctgcagtttctacagtactatgacaaatagaaatttcattaatgcttctcgataatgcatgtgcttttataggatagccaaacaaaggataagagtacctggtcttatatattgaaaatttttttatttttacattttagaaatatgccttatattctctaactttttattactttttacaaacttcaaaattataacttaaaaaaaatcttagtgccatcacattaagatacccaggtatatgatgtaatcttaaatttaacagcaattttgatatttagtcttattaagcatatgctattatttgcattaccattgctaaaaaatttcaaaggaggcagtttaaaaacatagttgggagacatctacttaaaggttactagatagcaaatgtttggatctatctattttcaaccaatgaaaatatcatggtattagtgtatgcatatatttttgtgaaatgcaacatctcaaacgccatactatttttcaacagttttaacaaccaggtgtaataatgctgcatgaaatccttttcttgtttccaaatttaattgatttaatcactgaaattaaatgcttggaaattcttctgcttgccggtgtttgaacgccaaatacatcatctacagttctaaaatgaatattgcatttatatttagacaacttaaaacactgctttctaaattaccctaaataacccatagaaatgtctagaaaaattcataatagtggatgacaaatgtccattgccatcaaccttcaaataagaataacttttacaaggtatacaaagtgtacaattatctgggaaatataatgtaaagcacacatagattaatcttacttcttccagcactcaccaccagtgagctcttccaaaactcatctttaaagatgaagacatgggagctagaaatcatatttatcttcagaggcaaaagaaatttaagttttgccaagctttcacagacgtcagctcatttattctctttgatcaatttggtttgtattgctttgttttgcttttcttcataatttctgggagttaaaaaattaatagtaataaagtcacttgagtagagatactccttgacagccaatcagatacacagtctctcccaacagtgcatagagagatcaaatagggtgagatgaggatatgtttggtgcaaagtatatggaaaagcttattctgggggaaataatacatagtaaattttatccaagatgatgaagaataaaaacaatgtttacagtaaagtatttccacatggggctacttatctgagtttgtttgtttgttttttgtttttttggcctgaatttttccatgaaagatagtagctagcattaactaggcatttgctacgtactggcccctattctaagcttctaatctgggcttttctcattctcacagtcaccatatgaggaaggcgccattctttgtgcccattttagagataaggagattaaagtacaaggacatgaagttacttgcccaaagttgtccagataagcagcagagttggggtttgagccagctggaatctggtgcctgcaccaagaaccacgaacactatgccgccttcgtggaatgtgtaggagtgattaagcttaagtatttccacatggggctatgcaaacactatcaaggtggtgaaaactgcagcagctgagtgtagttttctaaactttagtctttctggcttcaccttcacaattttggcaacatctaagtatcttctaaattatcacttaggtaggatgttttactctatttttacttgaattaatttttaaaagaaaattttgattaacattataaatgatagtaaaaaattcagcatttcttaccacaaagagaagacaactgtaatagtaaatataaaaccattaaacttttaaaacattcatccatgtacccactaacccatctcattttccatcagtggagtccttgctgggttttgggaaattctgcccgaagaaaagagtatcattgttaaatgtgaatgaaatcactgaaaactgtctggacaatataatatgttaattagtttttaaataaacttttgcatgatgggtacctggacagttgtatccatatgcagggtagacagtcacctattaatgaggtttcaagcagaaagtccagctgctcccttagcttctggcaaatgtttgaaactccataatttgaatataattactttcgctcagtggttatcaaactttttaaagcagtcaacaacttcattttaaacaaagcaacattttataaaccagtaagtaaaagagaaaattgaaattttatttgtgcaaatccattttagaagttctaattgctaacactctcaacacaatcaatcagtgagaggccgggggcagtggctcacacctgtaatctcagcactttgggaggccgaggatggtgaatgatgcggtcaggagatagagaccatcctggctaacacggtgaaatacccctctactaaaaatacaaaaacaaaattagccggacatggtggcgggtgcctgcagtcccagctactctggaggctgaggcaggagaatggcgtgaacccgggaggtggagcttgcagtgagccgagatcccaccactgcaatccagcctgggcaacagagtgagactccgtcttaaaaaaaaaaaaaaaaaaaaaatcaatctgtgagaataatggatctattttgaggaagacaattgcaatgcgatagtatcttatttttcatagatttctgcattttgttttggttttgtggtattggcaatatcctgatacagacatatatatataatcaaatagtatgaatgtgttgcttctcagccatgttgaaccattctgtctccactaccaaaaactggaatagacttggatcttcaaagctaaatcaattagagtaactaaaatggttcatattccttgagaggtcctcactcttggttaaaaaatacctttcaaaagtgtctttttaacagaatttttcactttcaacaaaacaaattcatgacataatgatacttgctgtatcattgaattgaattgaattgcaaagcttcaattagtcaaatatattttattctgtgtacatacctgaaaagctccaatttcattgctggctgcttacacgcagttgtgagcatgtttaaaatcttctctgataaaagtgtgcttgatatataagccagtacaaaattattattaatatttgggggagttaattaactgatacaatttctttatgaggaaaaatacatcttatggtggtctgcattttcatttaggtatcatcactttgttttcatgtccactgattgccatatgttgtttggtgcttgtgccatgcaaaagtacctgaatttgctggccttttaattgcatgtggttcccatgcactgtggtggtatttgcacaatattgtggcccatttgcacaatatttctcatgagatatgcaaagacatatttttaaatgtccattgcagatctatagactttccagtcaatgccacagttatttatttctttatatgtatatacatatgtgtgtgtgtgtgtgtgtgtgtgtgtgtgtgtgcgcgcgcgtgtatgtgggtatgtataactatctatatatgcatctacctatatagaaagaaaaaagaggaggaagagaaggaggagaagttgtttttgtctggtaacacaagttaatgatttgagaactgttaatatgacaaatatatttttattatagtttttttattgtccgcaaatctggcaatgaattttttttttttacatttattacagaactgcagaggaattgcagttataactcaatggaacacagtttgaaaaataacattttagctgaaggtctttatatcttttaaaatgcaaaaacctctactttcatctgcaatcagtcatttgtacattaatgtgaatgaatttattagacatctttctgagtttaattcagaagagggggaggaaaagatgaactcagctactgaaagacatgggaaaggtcgaatattaacgctaggagaactgaagactaatttggcctagtttacagttttgcttcaagactatgccatctatatataatacatttatttgtatttataaacacatatgcacacaaagaaaatgtctactgcattagttgagtgtgagtgtgattatgtttcagaattgcatccaactattttagaatattttgctggaataatgtaattacatgaattactcacaattttgtcaactctaaagtaagtcaacagtaaaatttccaaccaatgaacttattgaagatattctgattttattatgtgagtgtcttcaaagattgcaagcaaataaattatgcagaagtcccagattatgtacagcttaatataaataaggacttaatgctccaaacctgatctcatacctttggactatgatatttctttaaattaaaataaaagagtaaactttaaattaaaataaaagggtaaacttaaaacaaattaaatccttttattaaataaaataattacctttattacatgaatttagttacatgtgtcccccattttctccccctccaaaagaaactatctaaagtttatgaaagcaagtatctatttcaacagtgtaaaaatttagttgaaacttctgataattttttacagaggcatatgagaaacagtgttagttaatattttaagaaagaacaagaagaaaattacgttaagtttttcatttcatttcatgtattttctaacagtgaaagttattaatttgactgtaggttaaaaacgtgttggactagagccatattggccatattcattctaaagtcagtgcttataatgattttgtgtgaatttgaaatatatataaatttgaaatactcacatttaatactattgctgctttgttgtgtttttgttttgttttgttttgttttttttaagagacagagtccttgctccattgtccaggctgaggtgcagtggcgcaatcatagctcactgtagtcttgaactcctgaggtcaagggattgtccctcctcagccttctgagtagttgggactgtaggcctgtgccacccaccaggtgctattcccacttcctcctttcccagtatgttgcctaggctgggcttgaactccctgcttcaagtgatcctcctgccttggcctcccaaagtgtgaggattgcatgtgtgagccaccatgcctgccctattgctgtttttatgtcaagaaattgaaaacaaaatcaagtaatagaaatattactatttaggaaagggataaatgtaactatctcagtagtaaattttgtttttggctattaagtataacattgaagaattagcagaataaatatgaaatcaaaacttagaagcattttgagatacttttggtattctgttgcaaagtatctcaaagtgaaaacaatagtgaaatcatcactaaaaagaaaagactaatatataacaggtttttaaaaaatattcagctcaaaaggtcattcttggttctgagattatatttatcctgaaataatactaaatcaaaactataagctagtcagttaagtcagggaacagaattgagcctaacatacttctgtttttgctcatagaatgacctttgaaacctctctgagctctgctgttttttaactatttcccatctgtgtacagagaaaaatgtattactaagtcacaaggcctatatattcccacttcctcatttcccagaatttatgggaaattggttctaatagttccacagtagaaagcaagaagacagaaaggaaagagagcgcttttccaacagttacaggcactgacagcctatgacaatatttgagtctggtttgtttgtagtttcttccaaatgtgtgttcctgaaaaaaaatcatacgaaggagggtgagtgagcccaggtaaatgacatgtatgcagcagctccagagcgagtgtacagacatgtgtttgggtggagcacagtgctgtatctaagagatgttcaacaacccagtgggtgaatgtagttggcagctgagccattgagaatcaatttgtataagtatcgggaatgtgtagatgcaaaagacatatcaagtattgagatgtagtgaccaaacagaaaacttaacctggaaattattttgtatatattatttagtgaaaatatttttaaggaaggaagcaaggagtacatacgtagtacctaataatacaggctatacaattacaaaagggttttttaagcttggttttagtatggtccttaagctaattgcaatacttagaatttttcactaccctttttagaaatctactaattttacatttaaatgaatatttaaatacaaatataaattaatttcaataacttctagaaactaataattatatttattttcctcctctaattcatatagcacgaacctcattttttctatatatttctccttcaaaatattattttcctccatattttcatacagttatattttgagtatgtaattttttaattgatttgttataaacatgcttgtactaatacaattctccaagattacttacacattttaagggcatcaaaaccacctgtcattggcaggttgtgataagcatttctttcaagagaatacctaacactttctccatcaatcttttccactttcatggtaccaaattttatataaaagaagtcactgcttgttactgaaacttgaaccaggtactcaaagacaccaaaacataaagctattgcccaccaccataaagcccaccaaccatcttctcactttattctatttcattttttagtaatttatttatattagtccattaacactgaaatctcttcatattttgtccttgctacactgagctgagacaacatgttttgatttctcaatgtcatcagtagtattaggtaaattctagaaggtaaaaatgatattatagaattacatacataaactattgggacatgattagttatcagaatatcacattgatatctctagtttataaaatctctaagaattaggtatcatgtcccaatgagaactatattacaatagagttgaaaattctgacccatagttagtctagtctactttttttaggtctttgctttctgtttcccaggtctcctacttgttgttactaactttctggaaaaattcagcagacaaccaaaatttatcatgggatatttaaacattctgttatatatggtacttagaacaacagctctgtaaaatagcttcaatctcatagcctgaccaaagcagaaaaagaacaaaatctcttataacacaaccttagaaaagccttaactacgtccttattccagcaactcaaatgtcctatttaagacaatcacgtttcagaagagcttaatatacaatatcttctattttattatccatgaaataccccaaatgtattttattttctgtgggaagagctatatacgaagaagaataacgaaaaatgtagccaatttatacttgagttagaatctattgtgatataagttaatcacacatgggtatcccataatatgaaaaatacaactgtaaaaatatataaattattatagtgcaacggaagactctttacttttaaagaagcctttgaaaacaggttaacaagcaatttaacaactaattgttagaaaactgaccttgacttgcaaacttcaactctttggcatctgtgacggtggtccttttgtcagacccttttttctctattcgtcgatggcttcgtcttttcttagactctccccaaagattggatcctccatgcatgcttggtatattcaaaatagcaattccttccagagagatgtttattaaatctatctgtactccatcacactgatcggtaaaaagaaagaaacagaaacggaatattttatctttatttccctgatttcttgtttttcatttcctcatcttttaataagtgcgttgaaatccataatgttgtcatttccaaacaagcctttcaagaacacttaaacacttaccctgagtcaatataaaagataaagcagcccctaacattaaccagttatctctagaagtccttaaaaatgatcaaattaaatcaccagtatatctttgtttgtagaaaacctttgggagagactcgttagcatctgcatatatatttaaccagctgcaaatttccaatgtgttacaaaaaggttaattctggaaactatggtcaaattttaggaagaaattgtgatgattgcccctgtttagaacacactgcaaggtactattgggggaaagtacagaaagcagattgatgcctcatggtctcacacctttggggcagagaaagaagtagcttaaaagacttttgctaaaaaaaaaaaaagtaaaattcaaagcagagattctaagagatttcaatcacactgaatttaccaagggtggtttcttggactagatgaagtcctaaggagatgtcaaaggccatgagaggcacagttgtccaaatgaatatggagggccgggtagattgattgagggaaatagtagcagtcaaaagaccttcaatccagcatgactttatagctgctgcaaaaatggttaaaaaaaaaccaaggttaatcagcccaatttttcttattttcctggtgacaaaacaccctggtgattatgaaaaatataaaattcactaacaaacaatgttttgttatattcagagtggtcacttcttagttttttgaattttccattcatttccactactggacatatgtggacagtgacaagactattctgtatttttaaaattactatttatttattcatttgccttgacttctttaaaatgctagttattattatacattctagaaattattatcccattttcaattataagtgaatatgaaaagagatataagcgctttgtttttaaaagaactttgtgagggatatgcatttcctaaattgaaatatatttacagtggcgttgtttcatttgccatgtcttagtacagaaaaaattattgacactaacttcatcatttctcatggcagtcatgatttttgaactcagaagacacagtgttccatgaaaatgatgaaaaacaaacaaaacaaaacaaaaaaaagccctctctttttccacattcgcctcatcatactgaagctaggattgcatcttgttcactgaaaaataaaaactgtgaaataaagaaacacatcttgagactacttggcaggggtagaaacaaattctagagaaagtgccaagttttcatttaatttgtttcaatgagggcgaaaccaagatctggatgatgcttttttttttttttttttttttccagaaagcagtgcttttttcctccttttctggtactaaattaagatgatttctttttactaaagaattctggtcatgtgtatactcacttaccgctatatattctagataaacagatattaatttcataattaaaagtaatcttgtgtaaataccctgcaggcctcaatgaatcaaacacatactgtgtgtcaggcctcccactgtcttcaagtggaatgtactggctggataattagatagtacatattttttaaccttatttgcatgcatattatatcttttgcacactgacaagcagcagtaacaacaaaagtcagattaccacagggaattcccacaaagaagtcttcattccttataatttgcagcctaaattaaaataatttgatctttgacaaggatgaaatgtcaagcagaagggggtcctctacaagccacggcctgtggcttctgaaatctgcctaatttatgtcagtcacttcttaatacatatttaagtattacacgaaaaagatgataaatatgcaatctgacacctttggtatttccctgctgttaatttataaaggtctggcttcccccaaactgactaaaatcatttaaataacagaagaatcatgaaataagctggagtcagggcctggcttccattttcactcaatattgaacacagcaggtagtacactaagacaattatttgactaggccttagaaccccactgtgacaagttactttcagaattagtgaaggaggattcctttgttcatctgcagaaaaggagagcatgttgcaaagaggcttcttttttttttaaaaaaaagaattgaaccagctgagttacatgtgacaattgaaaaacatgagtgtatgctattattcatgttttcactcttcagagttttgtcatgtgtagttttagggaaacagagtaagtagctctctgagaagtgaaaaaaaattctcaaacagtcgcaaagaacaaggactgatgaagaacattgatgttcctttgagagcaggacaatgtacttaaataaattgctatttattaatgatttgtttccacttgttcttgaccctaggctaccttcctctgtttgctttaacgttatgttcattagtctggaaaatttcagtgctggttctgatggagaccagtaattgtagcacaccagttgagtgcatgaaagtaaaagctgaggtgaaggctatgaaatataaacaagttatagtactgtgtcagataatattttcattccctttgagatttatgacttttaaaaaggtagctacagaggaaaagaatataaaagcttaaaagctaacagcctcagttagtcaataaatcctgaatatttttattaggtagaaaaaaggtcgttaacatatagtactatgggagctatttatagagtgcaaggctgtgatgccattgtctgctcttttcagttttaaaatagaggatcttattccagagacaaatataattaaaagaaaagaagacggtttcaatttttctgccaatgtgttttaaccttcataaataaatgagtcctgggtcacaccgtacagaggtgttaaaaacaagctttatatgtgactttagtgtttcagatccacttaacatgtcagttgataggactattcaaaacatgtgaagaactttggagagctctaagtgtggatggtaaatgtgatgagatacaattaatgataaactgtaatttttttccatagtaggtctgattctatgtctatatcagataagaattatttctatttttactcaatgaaacgtaaaacattactttataggtaatttcagtattaggacacatggggcagagactatgcttgggaactctggctattgcctctaagaactctgttttccaggttactgagcaataagaatattgtcttttgaatcctgctaatttattttgtgtttttgatgctagtcatgccattcattaattcttgagatcatttaggtttctaggggtatttaatcattacaataaatcagtactttgggatggaaattcttggctttaaaatttaccatctttcccagtatccctgtcaaccaaaagactgaaatatctatagaataggctttcttattctctcattaactttgcctggtactctgagcaaactgaacattcatgaactctgtatcttcaattccaaatgctgacctgagtttcttaggcacacatttcacccctccaaatactttaatataaacattggttttaaaatattttcttgtaattttaaagaatttatttttatcttttgtaataaagttagaagataaatgaatatctttaaaaaattctacttcgtgtatcattaaatctttacatgtatgtgtaaatacatatatttttcaatcaatttgctcattagatttaaacattgtggcagcaacataattcttatttctcttaaattactgaagaaaatgtttatctctgcaatggagatataacagtatcataaggttttgataaagactaaatcaaataatatatgtgcattgtttagcatcacctgtgagacagttaataataggtaaatcttaactattattccatgatattcatatcaacccaaatatttgccctcttttgaaggtgctcactatgtgaaagagaaatattaaataaaaagacacacaaaagatagtttgattttgaaaaagctgccaataaaacatgtatctattgctggaggttctgtttttactgaagtagtttattctgttatatatttttcaaaccatagtaggtataattttaggacaaataggaagcaacaacaaacagaatcaaattttcgaatttctgtttttgttatatttaattataaaataaccttgagggtagaaaggcatattctgctaatatgatagacaggattcattaaaaagtgagcagagaagcagattttgcctagctatccacacacacacacacacacacacacacacacacacacacacaacaagatatgcaaaaatacaagggggcatgcacacagtgctggctgtgatttataaatattattttaatagctcccaaaataagccagggatgcagagctagaaggtcaggctgagagagtaagcagaaacagcactccaagaaacataacttagttctagtagcccagatttcttggagaacattctaaatagtttttctgtcagatctcaagctctgtggatcaaaaccacttaattttatcattatttagcatattacaaatcaccgttttcaaatatattttcattcaaaatcttttgctgtaaacacaacacttttcttaaagattttttttttgtactttgtgacacatagaatcttattttatagatcaacagcttttaaatctgtgctcaagggtaggataaagtaaagggaggtgcaggaggattcaggatctccacctacattcaaccaaagccatacttctaatttttctaaaacttttcagcttctgctgcaaattgtatttgagcataatttttgaggataagaaatattcaaaatctagtatataaagcagtttttttaaaaaaataatgattctaagagtaaaggggtatgtatatgttttattgaatatatatgcacataaatatgtatatgtatataacaatacatatgacacatatataaccatatatactatatatttaactatatatgtagttatatatgtcatatattattatatataatatatataactaaatatataactaaatgtagttacagatgtcatatattattatatacaataatatataactaaatatataactgtagtacatatacaattattatatagatatacatgcatatagttatatatgtgttatatatatcattttatatacagttatttgtgtgcatatatcatacatatacacagatatatcatcctaaatagtaataacagaaagtccacgttgaacccaaatccttcacctctgtaattatgttcctttcaaaggttatgatctgatcctgttatgaagggttttttcccattccatgaccatcaattctaatacttaattatatttaccaatcatgatgagataaaagtgctaaaaggttacactgagagtagtatcattttttggtattattaataacagcaaattagaaatttaggataatgaagaacttagccaggccattgtgtggtccataactacttctgtttaccaaacttattacctgaatataaggaactaatgatttaggtatcagtagcaaatttttgcatttatttttaaaatgaaaagtgttgaagccaatgtttcttaattcatatcaactagtcattaagtgttcatgtttcataattctgttcctctggttttgtctttatcatttgtcaaaatataacttttcttttttctttaacccctaaaaatctctcaatataacgaagtcattttcttttataatatttctccaaaattttgagtcctacagtgtcttttttttttacagacctatttgctccaagtctttttaaaatgtgtcttttcttgctatctttgctctctttcttggcatttccactttctataaatgtaatggggaaatggcaaccttgggaactgagaaaacctagttaatgaatgggaatggaatggaaaagtatactttttaacctttattcataaaagtaagtacaattttagcaaagtgtgttttaaaggttacaagatattgagacccgaaaataatattttttatgtattctgcaacttttttcttcccaactacttttatcttacctttctatctgcactatgcccagtaacaactgcatcaatttccaaagttgtgttccacttctcattcttttatactataataaaataacccatatctacacttaactttagtatgtcagatagtgctgtattccaaatgagtgaaaggaatgacaatttaaaatcttgagtaagtctctgtggattgctaatatatatttcattccatgggctccaatgcaaatatactaacaacaaagctcaagccatttcatcatattacaaaagagaattcatttttttcttacttctatttctacagattcatgtagcttcttgcaggtggctgagaaagtttcagatgtgccaaactcaaaataccaaaatttgttcttcattctgaaaaagaaaaggaagaagcaccttaggcaattatcaataacagagggatcttttaaaaaatggtctaactctgtcttgtgttataatagaaaaggtctgaggacatgtgacatctaaaatgtaatagatggtcatataattttcaaagcttaaatgtgggtgccaaactgtatgatggccttgagggaattataagaatgtgttgatctagcagactcaagtacacctttagttttttgtgggttcatcacattttaaaaaacggttttaatgctcatgattcttagcttgttcttaggcaaaaagtgaagaatgtacaatagtgggaaattatgatacagcataaagttttttagttctttcaagaattaactaataatatagaataaaataactaagaaagtaataacaatattatatcaataaaagttgcaaagaaatataattaaaataatttcagtatttaatcttaaagtaaaagactcaaaatttattttcttctatgacttgatatttttggctttttgtaccaggtaattaaatttattatcacttaatgtaactttacaaaggtcaaatagatttttatattatctagtattggatttgaaattttattcttgtgaaaaaaatgcagtatttgattatgcataattctaatagtgatcatgccctcaattagaagacaatacatgtaagtgacagacattttcacacatagaaatgaaacaaagaagtttttgttatggtattcgagtatgtctctcatatcaaattaaagtattctgtttgacttataaatattgatatctgcttcttacattagaatgtaaaacattttgacaattaaaaagacatttggcaaaggccttactacttaattcaagcctattattggtttggaaaatgacattaaacctaatagagtgcttattattatgctatgttaaatccaatagagtgcttattattatgcagagttctctgatataaaattataaaatacaaagcaatgttatattatctatctaaacatagtcaataatgtttaggctctcacaaggttttatttgcttaaaaaattcacaatcccttcatgaatcagtcatattcaggccagtaatctgaaggtcagtataagtttcataggattctagcaccatgaatctttattcttttccagagaatatttgacttagtttatggcctgatttcatatatgtgagcagatataaacagatgatagtgaagtaggttagaggtaaacatttaatgacaagatttgtgggcctgtatctacagatgtgtctatattaaattaatgtaaatgtctattttatagaatggttaggcttttataaatttacacactgaagtcatgtaaaattaaaatattttgctattgagatttatcattctgatgaaaaacatatcattctacagatggagagaaaaatattggtttatacaaagaggtctgaagacattcttaatgaatattttatgactattggaatagtctttctatattcagcaactttctaataacatttttgtgttattcttttctccagaccttccaggattgattcattcattcaacaaaagtttaatgagaacactctctctgttaagtactatagacacaaatataaatgcaattacctttgtccccaagaagctcagaatgttataaacttatgggcatatcagtttgttaagggaggcaggaaggtaatggagggagtatgcctggacatgtgaggcccactgggatcttggttattatggcccttatctgccaggactgagtctcttccctacactgtctcaaaaccacaattagatatcacctcctttttgttaggatggctattttcaaaatacctcagataacaagcactggcaagggtgtggacaaaagggaacatttgtatactgttagtgagaaaataaatttgtacagccgttatggaaaacagtactaagtttcctcaaaaaattaaaaaatagaacaaccatgtgatccagcaatctctcttctgtatatataccccaaagaaatgaaatcaatacctcaaagaggtattgttggaccttatgctaagtgaaggaagccagaacagaaagacaaatcttgcatgatctcacttatatgcagaatcaaaaaaagtcaaatacatagaagcaaagagtacaactgtggttatcaggggtcaagaattgggggaaataaggaaatgttggtcaaaggatgcaaacttacagttataagataagtaagttttggagacctaatgtacagtatggtggctatagttaataataatgtatggtagcaagggggaaaataatgtattatatatttgaaattaactagagtagtagattgtaagtttctatgtgaagtcatggatatgtaattagcttcattgtgataattatttcacaatatatgaaaacataatgttgcacatcttgaatatatgtataatttttaaaaatttgtaaattataccttaataaagctggggaataataaatagacattattttgcgataaatttagattcacatgcagttgtaaaaagtaacacagaggagtccaatgtgcccattacagtttcccccaatgaaaatatcttgcaaactgtagtacaacaggacaaccacaatgctgacattgatacagttaagatgcagaacagtcccgtcaccacaaggttccctcatgttgctcttttataaccacccccacttctacctgcccccactccctcctttccttcgacaaccactaatctgttctctagttctataattttgttatttcaagaatggatacaaatggactcatataataagcaaattttggcatttgaatttctcacttagattcatccaggttgtttcacatatcaacagtttcttccttttatcactgagtagtagtacatggtatgaatgcatcatagcaaaggactagtatttagaatatataaagaactctgatgattcggcagtaaaagcaacccaaacaatttaattagaaagcaagaaaagacataaacagacatttcaccaaaatagatatacagatggaaaaaaaaatgtaaagatgctcaacgacattagcgtttagagaaatacaagttaaaaccacaatgagatatcaccccacacttaacagaatgactaaaattaaaaaaagtaaaaaaaatcttgaatatatataattttcatgtgatttgtacctcaatgaagctgaacataaaaacactggtctattatgaaaaataataaattgagtttctaaatgaaatatgagccaagtattgtaggaacatacttcaatgattcagctaattttatctcaagagtcctgcaagctttagaataaaaggtagcatgtgaatggataagtagtagaaggcaagcagagaaggaagaagagacaagttctgtgcacctttgggagtgctgtatgattttagagtaggctaaataccgactaacaagtgtggtagggtctgtttcagaacatgtaaacaaagttaatggttttagacttgatcttatgattaagaagaagctgacagaagtttattagcagaggggtgacatcgtgaactttgttttatgggcaaacaaatctggcagaaacataaaaatgggctggagtgttgaaatgctggtgtcattaagagaactgtagttattgcaataattcatataaaatataattgaaggcctaaccaaatggcaacagaaatggaaaagaggggctcaattcaagagctataaatgaggtagaatcaataggaactggtgatatttgattttactgatttatgccatacctagattatctctgaatgcatagacgagaataccagagtctaaatccagcctaaaaagagatatgggtttatattttggcaggttctgtgatctaatgtacactgtatcatagtttgaaaatttaaaaaatatatatacgaggttttggcttgtatagaaatgattattccctgtatttccattatgtccatcaaagttcctcacagcgtaattagcattatgtgtgtttctatcagttatccaagatatgctcactttagcaaacatatcacaagaaacagaaattctgagaatttacattcagcccttattcaccatattagttagcattactgctcatgtgcaaaagctactttaaattctccattattacaaccattttatgtttcacttagataaatatatggaggtaataaaatgcacatggtatcagattccacatgacaaattgaaggctgttaaattttatttttttcaaccaaactggttttaggttgtagaaatgcaaaaaagcacatttaagcatttatgctatctacttttatgattcacattagaaaatgatccaaataattcaaactcaaatttgtcagtgaaaacatagctttggactttaagaatatggtaactcgacatttaacctattgtgaaatggtcacagcaaagtcaaatttatcgtattcctggacagattttgtgactccaaggaaagtaacaaaggttctgtaaacctcacaaaagttattcatgtaattattatttgaattaacgtagtaaaccctatgccaatgaatgtaattgtaaatctacaagtttctatttaatgctcaaagtgcttggctaccagatagccaggtaaagacgaagaaattggctcccatttacctggaattttcatacgaactgtaattttgcttcttttacgtatcctgagtaatgtgaactatcagagactttgttcaagcaaaatccttcttgttgctatgaaatttagttaatattcagttcttcaagtttttaactttcaaatgggtaatttaatttccagcaatatattttccttggaatttttcttcctgccttacatgtcttttattttggctttcatcggcttagtaacattaacgaagtaaacataaaacaaaacaaacaaacgaaacagtaaagtaccagtgcattttccgaaaagaataaaaagtaacctaattagacatgaaactcatttctaacaaagatgcaacatacagagggcgatgaaattatctcatttgtcttactgtggaagactcaaaagtcataagcaacaaaaaagttttgacttagtgaaactactctgagaggtcatatttttattttacaggtgcatttgttttattatttttcatgtatttagtggggatttaggtggcacaggaagataatttattatgtagaaaacagaaagacttctactagatactgaacccattttcaagcatcgttaactaagcgatttgacctatattgtatggataacatgctcaacagaggagaaaataaatctcttttgatctttgcttttcaaataaaaacaaaatcataatattttaagtagcttagttaaaatgaaattaaatatttaattactaaggatgtttcagaaatcctatcttttttattagttgttttcacttttgtcctgttattaaaatattttatgtgtcatttcaaatctggttttaaaataattttctcatggagaacatagtttttaactatgttattcagtaactttattttaatactaaaacagtctcataattctatggcatagccggaatttggacttgcttaactatgctggttaatgggaaaggttgacttatagtaatactgcagagtaagtgtttaaagtgggtacatttatgtcatagaatcaattcagttttattcactttttcattgccaagaaacattacactaaacatgggttatagggttactcatttattcctaaacgtagtgaggtattactttaaaaaatacaccacaagtcaaatggaagggccctggtgggacctgattcaccagtgaatgaggagcgtctgaaagctgcagttcagggagagaaaagcactcccagagtagctgcagcagacagaatgttggcagggcacagggagcctggtcggcaaacgagccctaggtcagtgcagagggaaagggaggatacatttgtagtttgtttttcatcacttcttgaagtcccctgggaaattaaatgtcatctgtatgaactatggccacaggtatttgttaggaactaagtcctggcccagttgaataaaatcagcaatttatttttttttgattggcaactataaattcaccaataaagagttatgaaaaaggttgctcaaagtatgtaatagtggcatgaatgggaacttttactcaaatttgtaaaaattatggtatcaaatttaagtgtataaaaagttaggtatttgcttgtagaaacttgaaactacaattttgtggcaattactattcagatgaacacattagtggtggaagtgacccgaaattctacacatgttatagaaagaactccattttatttaaaccgctaaactcaggcttttttgttcacagaaatgtgtacttttttttggagtaagagaataatgttgacaacattattttataaggaagaaacacagctataatcactgcagtggagacatttaatattcacaccgaagaaggcaaacatttttcatatttctagacaacaggtagagatataaatttattcaaatgacagataaaaatgcttgtatctaatgctcattcataagacgtgcttgttaagtcccagggagacaatgaaataagctacagaaacttcagacagaatcatatgctactccatcttagtttataaaagaaaagatggatattctaaaaccgtaatttttaacctgaattacttttacaggactaaagaaactttttttatatgtaagtgtaagaaaaggatgcacccaaagatcaaatattttagtttttaatcatttcaacaattccctatggaaaaaaaaagtggttatttaagtattttgatgtataagaattttctatcataatactaattatttcttacctaaatgttctctagttctctatttgtattgtacattagaactaattacagagcaaaaatggaaaaagtatataagcagtagtgatcccacattgcagagtcatacaaaaacgtacacaaagtaagtccctaagagcagtgataaattcataattatttgaaacgtaaaatgaaacatgtaaaatgtttaaacaataaccaatcatgttaagaattgaatacatttcaataataattaaatctttactattattggctcacaacctgtaatcccagcactttgggaggcagaggtaggcggatcacgaggtcaggagtttgagagcagcctgaccaacatggtgaaaccctgtctctactaaaaatacaaaaattagcccagcgtggtggcgcgtgcctataatcccagctactcgggaggctgaggcaggagaatcgtctgaacccgggaggcggaggctgcagtgagctgagatcgtgccattgcacttcagcctgggcaacaagagcgaaactctgtctcaaaaacaaacaaaaaaaaccaaacaaataaaaaaaataaatgtttcataataataaaagtgtccctaagaaatttattagaaagatttaatgaaatgtatgatagtaataattgctgttgttacggatcatagcactgtctcaaatgagcttagaagtgatgcttccaacatttcatgggaagtagcaaaatctaactcaagaaaccctagcttttttcccaaatgtctctcattatatacaataatgaatgcagcatcacttgaacctttttttcctgagccataaggaaaatgttataggccagaaaggtcatcattagatgacacctttgttcatatttctgtttaagtgcttttatttccctcttctgaaataagccaactaaagaagacaatgtaacctagagctgactaatggaacctgagggaagtataccgtgggcatctaggaaagatttttttctctgatcaagacacatacaaagtaaaagctttgcccctcttttcctatttttgcatgttctcaaggaaaaataactggagatgaagcagccttcttgcccctatgaaggaaaagacaagggaaacccagagatgacccagattctggacagagctgaactggctcatcagcaaccttgaaatagtctctgaatttttactcgtgagagatacataaatagaatcattatttattttgcatattctgtcacttgcagccaaagcacactcaaaacataactcactatgttttataaaagaattttcacatatattattgagatattagaaaacctaaatgaatatttttcatacaatactatttttctaaatgtgaaacttggtagtggctgaaataaaggaggtaaagtagagaatttctgttcaccataattgcttgtttttatcttgtgccaagatatgcagatatcactgaatatgctttcctcatctgacttgctgtccccctaaattttctaagagtcattttcacacttacatgcatgaaataatttttttaaaaaacatgaaacactgcttttttggagtgctcccaatttgcatcagatattttatcactgtcaatgaagtctgtatagaccagtgagtggtaagttgacacttttcttcttcccccatcccacatccaataacttaaaaatacagtcaccttgtggtgtttgaattaataaaatataccctgatgtctgagattatctgcaaaaatatttaagatatggtatttctctataatataaataggaacatgtacagcctagtgaaaattgatagcaaaatgtaataaggtatgtgttcttgtatacacaaaaagctgtagtttatttaattgaattatattcataaataaaaagtgtccaacaaacaaaaattgttttcaataagttttaaaaaataagagggcactacaaatgcagatattagcatgtttccactcctgactttgggtatcaggggaggttagcataaccctctttctggtagaatagaaattcatttattcaacaatctgagcatttactataggtccagtactgttataagaattggaattatgtttatacaagaaaagaagagatctctacataacacttactttgtattagaaaaaatacattaaattatttaatataaattgagatcaagtgctataaagaagatacacaagatggtatgtgtgtatacaataaaagcaaattgagagccttctttaaaaagaaattgaccaggccttccaaaggttcttttgctgaaattccatagttaccaagcaatctggaagttaatttggctttctatggattttgatataattaataggatgtcttaaattatggaattgtgtatctgaatccctggaaaggaattatcatcacctcccctatatattaagtggtatataaattttatagtagataaagttgagcaagtgaataagagcctgaccatttctgggtgtcatgattcaattatgtttccccatttgccaagatgagagtgagactctggactatggatgatcacataatcaaggtagtgcccactggaaaacccgaataaccttcctaggcagcagaaacaactagctggattatactagttgactatgttgagctagacagcaaatagcagaagaattgcttgttcccccatcctctttctgccattcaccagttgactttcttggctctctccctctctccccctccctccctctctctctttctccaccaaccccccatcctatttagtggtctttattgaatccattaagtcaatcaattgtttaagcacaggtgtgagaatataagaatataaagttcatttctttctcttgcctgattgccctggccagaacttccaacactatgttgaataggagtggtgagagaaggcatccctgtcttgtgctggttttcaaagggaatgcttccagtttttgctcattcagtatgatattggctgtggatgtgtcataaattgctcctactattttgagatatgttccatcaatacctagtttattgagagtttttagcatgaagggctgttgaattttgttaaaggccttttctgcatctactgagataatcatgtggtttttgtcgttggttctgtttatgtgatggattaatttattgatttgtgtatgttgaaccagccttgcatcccagggatgaagccaacttgatcatggtggataagctttttgatgtgctgctggatttggtttgccagtattttattgaggacttttgcatcgatcttcatcagggatattggtctaaaattctttttttttgttgtgtctctgccaggcttcggtatcaggatgatgctggcctcataaaatgagttagggaagactccctctttctctgttgattggaatagtttcagaaggaatggtaccagctcctcctcgtacctctggtagaattcggctgtgaatccagctggtcctggactttttttggttggtaggctattaattactgcctcaatttcagaacttgctatttgtctattcacggatttgacttattcctggtttagtcttgggagggtgcatgtgtccaggaatttatccatttcttctagattttctagtttatttgcatagaggtatttatagtattctctgatggtagtttgtatttctgtgggatcagtggtgatatcctctttatcattttttattgcatctatttgattctttcctcttttcttctttattagtctttctagcggtctatcaattttgttgatcttttcaaaatccagttcctggattcatttattttttgaggggttttttgactctctatctccttcagttctgccctgatcttagttgtttcttgccttctgttagctttccaatttgtttgctcttgcttctctagttctttttttttttttttttttttttttttgagacggagtctcgctctattgcccaggctggagtgcagtggcacgatctcggctcactgcaagctccgccttccgggtttatgccattctcttgcctcagcctcccgagtagctgggactacaggtgcctgcaaccacgcccagctaattttttgtatttttagtagagatgggtttcattgtgttagccaggatggtctcaatctcctgacctcgtgatcagcccacctcagcctcccaaagtgctgggattacaggcgtgagccaccacgcccgggcttgcttctctagttcttttaattatgatgttagggtgtggattttagatctttcctgctttctcttgtgggaatttagtgctataaatttccgtctacacactgctttaaatgtgtcccagagattctggtatgttgtgtctttgttctcattggtttcaaagaacatctttatttctgccttcattttattatttacccagtagccattcaggagcaggttgttcagtttccctgtagttgtgcagttttgagtgagtttcttaatcctgagttctaatttcattgcactgtggtctgaaagacagtttgttatttctgttcttttacatttgctgaggagtgctttacttccaactatgtggtcaattttggaataagtgcaatatggtgctgagaagaatgtatattctgttgatttggggtgcagagttctgtggatgtctattaggtctgcttggtgcagaactgagttcatgtcctggatatccttgttaaccttctgtctcactgatctgtctaatattgacagtggggtgttaatgtctcccattattattgtgtgggagtctaagtccctttgtgggtctctaaggacttgctttatgaatctgggtgctcctgtattgggtgcatatatatttaggatagttagctcttcttgttgaattgatccctttaccattacgtaatggccttctttgtctcttttgatctttgttggtttaaagtctgttttatcagagactaggattgcaacccctgctttactttgctttccatttgcttggtagatcttcctccatccctttattttgagcctatgtatatctttgcacgtgagatgggtctcctgaatacagcataccaatgggtcttgactctttatccgattttccagtctgtgtcttttaattggggcatttaaaccatttacatttaaggttaatattgttatgtgtgaatttgatcctgtcattatgatgttagctggttattttgcccgttagttgatgcagtttcttcatagcattgatggtctttataatttgacatgtttttgcagtggctgataccggttgttcctttccgtgtttagtgcttccttcaggaactcttgtaaggcaggcttggtggtggcaaaatctctcagcatttgcttgtgtgtaaaggattttatttctccttcacttatgaagcttagtttggctggatatgaaattctgggttgaaaattcttttccttaagaatattgaatattggcccctactctggcttgtagagtttctgcagagagatctgctgttagtctgatgggcttccctttgtgggtaacccgacctttctctctggctgccctttacattttttccttcatttcaaccttggtgaatctgacaattatgtgtcttggggttgctcttctcaaggagtatctttgtggtggtctctgtatttcctgaatttgaatgttggcctgccttgctagtttggggaacttctcctggataatatcctgaagaatgttttccaacttggtttcattctccccgtcactttcaggtacaccagtcaaatgtagatttggtcttttcacatagtcccatatttcttggaggctttgttcatttctttttactccttttttgtctaaacttcctgctttatttcagtaatttgatcttcaatcaccgataccctttcttccacttgatcgaatcggctattgaagcttgtgcatgcctcacgtagttctcgtgccatggttttcagctccatcaggtcatttaaagtcttctctgcattgcttattctagttagccatattcaataaggaaaataagaagtcaaattttccctgtttgcggatgacatgattgtatatttagaaaaccccatcgtctcagcccaaaatcttcttaagctgataagcaacttcagcaaagtctcatgatacaaaatcaatgcacaaaaatcacaagcattcctatacaccaataacagacaaacagagccaaatcatgagtgaactcccattaacaattgctacaaagagaataaaatgcctaggaatccaacttacaagggatgggaaggacctcttcaaggagaactacaaaccgctgttcaatgaaataaaagaggtcacaaacaaatggaagaacattccatgctcatggataagaagaatcgtgaaaatgaccacactgcccaaggtaatttatagattcaatgccatccccatcaagctaccaatgactttcttcacagaattggaaaaaaactaccttaaagttcatatgggaccaaaaaagagcctgccttgcaaagacaatccatcctaagcaaaaagaacaaagctggaagcatcaggctacctgacttcaaactatactacaaggccacagtaaccaaaacagcatggtactggtaccaaaacagatatatatatatatatgtatatagaacaacggaacagaacagaggcctgagaaataatgccacacatctacaaccaactgatctttgacaaacctgacaaaaacaagcaatggtgaaaggattccttatttaataaacggcgctgggaaaactggctagccatatggagaaagcggaaactggatcccttccttacaccttatacaaaaattaattcaagatggattaaagacttaaatgttagacctgaaaccataaaaaccctagaagaaaacctaggcaataccattctggacataggcatgggcaaggacttcatgactaaaccaccaaagcaatggcaacaaaagccaaaattgaaagtgggatctaattaaactaaagagcttctgcacagcaaaagaaactaccatcagagtgaacaggcaacctacagaatgggagaaaagttttgcaatctacccatctgacaaagggctaatattcagaatctacaaagaacttaaagaaattttcaagataaaaagcaaacaaccccatcaaaaagtgggcaaaggatatgaacagacacttctaaaaagaagacatttatacagccaacagacacatgaaaaaatgctcatcactggtcatcagagaaatgcaaatcaaaaccacaatgagataccatctcacactgttagaatagtgatcattaaaaagtcaggaaacaacagatgctggagaggacgtggagaaacaggaatgcttttacactggtggtgggagtgtaaattagttcaactcttgtggaagacagtgtggcaattcctcaaggatctagcactagaaataccgtttgatgcagcgatcccattactagatatatacccaaaggattataaatcatgctacgataaagacacatgcacaggtatgtttattgcggcactattcacaatacaaagacttggaaccaacccaaatgtccttcagtgatagactggattaagaaaatgtggcacatatacaccatggaatactatacagccataaaaaaggatgagttcatgtcctttgcagggtcatggatgaagctggaaaccatcattctcagtaaactatcacaaggacagaaaaccaaacaccacatgttctcactcacaggtgggaattgaacaatgagaacacttggacacagggagaggaatatcacacactggggcctgtcgtggggttgggggctgggggagagatagctttaggagaaataccgaatgtaagtgacgagttaatgggtgcagcaagctaacatggcacatgtatacctatgtaatacgttgtgcacatgtaccctagaacttaaagtatatatatatatatataaagaatataaagctcattagttttaatagagttcaacatatatttaaggagcacctactaagtttcagggaagttaatttaatgtaggtgttgcagtagacttcaaagacagctcagatttcccatcctgaatgatgggcaactttttacaactagaatagacattaattggtaactttgggcatctaacaaatatctgaagtggactcagattattaaactagataaccctgtttaataatatttgcttggcatattcaaatatgaatgacaccccaaatcactaggcaaagcaatctcaaaatgcaacatagggagttcaacatgtgagaaaaaaggagtatacatatattttggaaaaacacatttgctttcatcactgaaaggccagttaatacttttcaattatcttcagtggtatagaagaattttaaatcagtaattatgtaacattagaacatattacatatgtttttcctaaccaatttttagatgctatattttgtaaaacttgcaaaaatcgagaaaaaaattacacctctctagttccttcacacattatttcccttacctatattctgtgaagactaccacagcttcacaacttaaaaaaaatacttctaataaaacttgtttctattctctgaaaattagttaagtgttttttaccttttgtttttcttcacacatcagcagtctttttccaattctgtaacaagaagcataactttgcattttgaaaatgccaatcaccttaaaacttctctcatgctagaaacagaaaaaacagaacagttctcctttttctaatgctatggaagagtggttttacatacacattaattatcttgtataaaaatgataagaaataagaatcgggctacttgaattatattgaaaatattgatatttttaatcaaattgaataattctatagtttaacacataaatcagtaaatcaattattatttagattgcatttttgtcatggatttacatcttgagggactcagatgactccctgaaatatcatgatctgtttttgttgccagtcatgatgctataatttatataaaatattcaagctgacttgtacataaactaattgacagatgtaggaattgtcatttggggattaatcattttgccagtacattcaagtacatgttagataattctaagatgtacgtaaaggaaacatcccctctctttttctctccaatattatctactatttttaaaatgtgcctacctttataccattttctcctatttaaaattatgtccatataaacagataataaatggagacgaattccaattgggaatatttttacaagataaaacttgtttcaatttgcattaccatcaacaaatagccaaatcacccttttttcctatattaaaatactagcaacatgtagcattcatttaccagatttaaattttaaaaagacctgtatttttacatgagtcagaacaaagtgagactcttgtccagagaaatagtactgcagtctgaatctagatacagtattgaaatcaaattctgaatattattggatatttacggtcactcatttaggttagtgactcatttagatacgctttctatactgaacagattacagagattagggaaaatatattactgtcgttttgtaccaatcaataagaaagcaaaatctcctggaggctccgtttagtgggtgatcaaatgttcataaaataaatcataaagactgttcttacctataagttttagtgtccttacattatggcagttgattatcaagaattcattgaacaacatatgcgagcaggacctctatttcttatttagccatttctctaaaaatttggaatttaatcatttgagacagatgagaacaaatgacaacttcccaatgaacataaaagggaagaccacagaaaataatgcctattatttttgctcattaattcattcattcaacaagtatttaatgaatacctgttatgcatgaagcactattctagttgccagaaattcatcaataattgaaatatataaagtttctgccctcatattgcttataatttttatttatctaaatgtgagattagattgcttatataacttagaattaatataccactctctccacctcttctcattcttagagtgtatatacaataaaaacccaaaaaaaatgcaacaaaacatggaacagttaatctagtcaatttctggactaagttttataattaaatgacaattacattgatattattatattattttgtattgtattacatgcatattaatgtattacaatgtactgtttaatacagtggtagactgtttaacgggcacgagttcttcccattcctgtaagcttccttctatgcagtgagactgtgctgctgcttctcccttctagacatgaatctctttctaggccctcttgaatcaggaccaaccttgtgacttattttgactcatggaacattacagaagtgatgcataagctctggatcctaggcttcatggggttcataaatgccaccttccccctcttggagcattgtcatgagacctccatgttaataagcccaggatggaaaaccactaggagagggagacacagtatcctggctgggcttcgcctccagctcatccaccagattactgttgctaaaaaactgccagactaattgacagaaatatgagaaacagtaacttattgctgattaaagccactaagtgttagtctggtgtgctaagaacaaatagataaaagacacataaacgtatataccagacactgtgctaaataccacctatgcaaaattcagcaaaagctttcataatctttgcctatagtctctatcatattgtatagcagaaaagacacgaactgttcaagtattcacacaaatattgtgaaattgctatggtagcaaataaaagaaagaaaagtaaaaatattttatgagagattgtgattcctagagggaagcacatttctggtacaggtgactttaagtgcaaagtccctgtcggagaaagcagcagataccagaaaccaatagaaagaaggcatttgagcctgcgatagagggttagcttatgaagagataagattgtgctagtgggttacggttaggtatttagctgtgtagcatatttgatatatggaggatacagttagtagcagctcttatattaaaaaaagaaaaagaaaatttgggtttctttgtgtatgtgcattttatctttttgagcaattatttgctacaagagcattcaggaaatagaagcaaaacatgctccaaaatatcagcagaggcagtgcttaaatttcattactaaggcttctttcatatctacactcttagagtggaaactaagtaacctaaataaatctaataatgaaaatgaattagagagaaatgagctttggtaattgtgactgtctttcaattgaacaattagactttaacatagaagaaaagaaatatgataggtcaattaaacactgtatataaccaggcaaatcaacaagtttctatagtacaggtcagctcggtactgtgtggccaccgactttattgactcagtacaatacaaagaatatgcaaaattttgaaagtgacgaaatttttctgacactactattattctcataaatgtgccaagtgaaaaaataacaattatttccaataaaaaaaacaactaatgcatagttctgttaaaaacaagatttgctttcctctaagctccaaaaatacagacatagcaatgaacaaccctgaaattcccttcctttgcctgcaagactcacaataaaattattgcccagaagtgctggcaagtgaccaaaatgaggaggcatttttggggattactggcttaaacaataactccttcaaacagggaaagcaaaggaaaaaaaaagaaagaaggaagaaaggaaggaaggaaggaaggaacgaaggaagggagggaaaagaagagaaaatctgtattctttttgttacattcaatcgtcacaatagagtaattttctctcatcatccataaatctatcatcttgctaatacttaggtaaaatcattttcattgtagcacataatatatattaataagctactagactttttctaatattctactttcctttccactttagatttaacaatcatataataatcactgttctgcttgcaaatgaatcatatgcaatagtaaggaaatagctaagagggagatgccgcccatgagagatttaatcataggaaatggctgactttttatttccaataaccatctgcactcatggtaaatcaggtgctaatgaagctcaggcccagactgcacaggagcataaatctcaagaaccaaaagtcgtggagcaacagacctcagaaaaacagaattttctaaggaaatgcaccaaaattatcatatagaaggtcaccatctgcaaacgtgtcacataagtgaatatatttggtaggcctaataccacattatgacactggctgtaaacatcaaatctctacttttcttttgaaacttaccactttcaaatattatgatcacttatggttttttacgtcctcctagatagtcaacatcttgggggtaggggctcttcattccagtttaatttttatcgcctccacagtggtttgtccttataagtacttgatatttggagaatgaataatgagaataaatttattaattgtggaatcctacttttagggcagaaaagttttgcagaatttttttctccagtggaggaggaagccaagtcttaatgcagtagaatttgtaccagaatttgtcttctgagagtcaataaatgtacctatatcttctaagagtttttgtctctcagtaattataatccttaacttcacgtcttgctcactcattgttggagtgatatatgtaaaagaatcagaacagagttagaaggagaagggacagcccagaaccgacagtataaattcaaatcctgtcacaaaatgatgcaagtctaaggacttgacaaaataatttcctttttctatacgctagtataatacatagatcatatctatctcgtaattattaatcattatatttttagccactggcaaatcatatcaaagcaaagacctggtaaagaagaggtatgatatctctattaactcttgaaccaacctaagttctataccatgccacacttcacttagcctcattattctctacttgtttccatgaatgcagaaatcttagtcaagtgttaataagccttttattttcatttgttttctgtaaaaaaatataattagcacaaaaaagaaatctggttgctagagccaattagtctgtaaatagctttataaattgtattaggtaaatattaatacttagagcagcagtttttaattttctgtggatcacagatacttgaagaatttgatgacaggtgtgaaccgtctgccctgatataaacacatgatatatatgtgcagaaatatggctaaaatttcaggagttttacagtcttgaaatccattaatagtacccaggactgtgtaaatccaggtcagaatttctgactatagttgtatttgcaaactgagaaattaacaaagatcttaggtggaattcatcatacataacagactttagatgtagactgttttttatttcttatccaaaaagttaatcaataccagagtttatcatgctagattacaattttaaactgtgttttcatatatccacatgaaatccacataaaacaaaataatgaatcttttcatttaaaactgagaagacagacaaattttaccattcagtgtatatttctggacatgatatatagagttgtattcaggtaatgttatgcagtactaatcagaattcacaaaattagagttgcttacatctgatgagtgggttttaaccctcagaagctagttaatgcatactcctgccccaggcaaactgacattgctgtatcctgaatgtgttggcatttgacctatgggaagctaacatgctgttagtgagaggaacatgtgtatgcgcatcctacaacacattactttcacatttactgctttcttctctttcatttatcttaatacatgacaaaaaaattgacaaatctttgtttcgtaatgcaaattattgcacctgaagccaaatccaatcgattctcaattcaacacataagatgaactgagaagggattttatggcatctaatattataattaggcatgtttttaaagaaaaattaatattaaatatagatgctagtaaaagctaagtatcagatttgagcttcaattttcttcaaagattttctctgcaaaggaacatacgttcttaattatatactttattgtgtcaaaattgtagaaaattaattaataacaaaatacgaagaaacctataacttgcgttatagcctgtagtgtaaggacaatggtctccaatttacatggctcaacttgtgattttcatagtctacaatggtgtgaaagcagtgcacattcaacaaacactacacttcaggttttgaattttgatcctttcccaggctagagacatgcggtgcaatactctcttgcgatgccaggcagtagcagtgaacctcagctcccagccacgctatcttgagggtaaacaaatgatagtctatagtgtactgtgtttccagataatcttgcccaactgtaggctaatgtaagtgttctgagcatgtttaaggcaggctaggtgatatggtttggctgtgtcctcacccaaatctcatcttgaattgtagctcccgtaattcccatgtgtggtgagagggatccagtgacaggcaattgaatcatgagggcgggttttttcccatgctgttctcctgttaatgaataagtctcacgagatctgatggtttcataaaggggagatcccctgcacacactcttgcctgatgccatgtaagatgttcctttgctcttccttcactttccgccacggtcgtgaggcctccccagccacatggaactgtgagtccattaaacctctttcctttgtaaattacccagtctcaggtatgtctttattagcagtatgagaatggactaatacactaggctaagctacgatgcttatatgatgttaggtatattatattagtctgttttcacactgctcttaagaaatacccaagactgggtaatttataaaggaaagaggtttaatggactcacagttccacatggcttggaagaaacttataatcatggtggaaaggtgaaagggaagcaagcacctttgtcacagggtggcaggagagacagaacaggggaaactgccaaacactgttaaaacttcagatctcgtgaggactcactatcaccagaacagcatgggagaaaccaccagcatgatccattcaccgcccaccaggttcctacttgatacgtggggattatggggattacaatttgagatgagatttgggtggggacacagagcaaaaccatatcatatattaaatgcatttttgacatgatattttctttttttaattttaatttttaaatagaattcattttatttggagcagttctaggttcacagcaaaattgtgcagaacatatatagagttcccatatactccctacccccacatatgcacagtccccccaccatcaaaaccttataccagagtggtacgtttattataattgatggacctacactgacacataattatcaccccaaatccagagttttcattagagttcactcttggtgttatacattctgtgggttttgataactgtataatgacaggtattcacctttatagtatcacacagaataatttcactgctttaaaaatcctctgtgttccaccaactcatccagatttttttagggtgattttatgaatcaaatgagatataggtaaagtatttagcactaggcgtggcacacagaaagtgcccactaacaatagccaacattagcattaatcatcagcttgagttgactggtaagagctaaaagtaaatggttgcaacagaaatgaagaaacagatgcaaacggtattttctctgtgtgtgtgtgtgtgtgtgtgtgtatgaaaaaggtagtgtatgtaaatacacaaacagatataaagaaaaagaggtaacacagaaaacactacgacaaagttactgaatacatgtgggagagagagaaaaaaagctaagtgcaaagaatcaagccttgtatgttagtttttactcaatgagatgcaacccaaatgtgattagatacgcaagataatttattagggaaaacgcttgtgagggaaaagtaggtaggcacaggaagagcccgggagagccctcagaccatcatgcagatccgatttctgtgaaagagaaagagaaagaagttctggacagtggtgctgtgttttgttgttgtttttgtttttcaatttctgggatacatgtgcagaaggtgcaggtttgttacataggtatacatgtgccatggtggtttgctgcactcatcaaccccccatctacatttggtatttctcctaatgctatccctcccctagcaccccacccccgacagaccccagtgtgtgatgtttccctccctgtgtccatgtattctcattgtttaactcccaattatgagtgagaacatgcggtgtttgattttctgttcctgtgttagttttctgagaatgatgatttccagcttcatccatgtccctgcaaaggacataaactcatcctttttcgtggctgcatagtattccatggtgtatatgggccatattttctttatccagtctatcattgatgggcatttgggttggtttcaagtctttgctattgtgaacagtgctgcaataaacatatgtgtgcatgtgtgtttatagtagaatgatttataatcctttgagtatatacctagtagtgggattactgggtcaaatggtatttctggttctagatcgttgaggaattgccacattgtcttccacagtggttgaactaatttacactcccaccaatattgtaaaagtgttcctatttctccacatcctctccagcatctgttgcttcctgactatttaatgatcgccattctaactggcatgagatggtatcccattgtggttttgatttgcatttctgtaatgaccagtgatgattatctttttttatatgtttgttggccacataaatgtcctcttttgagaagtgtctgttcatatccttcatccactttttgatgtggttgtttgtttttttctagtaaattcgtttaagttccttgtagattctggatatcagccatttgtcagatggatagactgcagaaattttatcccattctgtaaaattatgtaaatgcacacatatctatctgaaaagaactatctgattatagtttcttttgctgtgcagaagctgtttcatttcattagatcccatttgtcaattttggcttctgttgccattgcttttggtgttttagtcgtgaaggctttgtccatgcctatgttctgaatggtattgcctaggttttcttctagggcttttatggttttaggtcttatgtttaagtctttaatccatcttgagttaatttttgtataaggtgtaaggaaggggtccagtttcagttttctgcatatgaccagccagctttcccaacaccatatattaaatagggaatcctttccccattccttgtttttgtcaggtttgtcaaagatcagatggttgtagatgtgtggcattatttccgaggcctctgttgtgttccattggtctatatatgctgttttggttactgtagccttgtagtatagtttgaagtcaggtagtgtgatgcctctagctttgttatttttgcttagaattgtctgggctataggggctctttttggttccatatgaaatttaaagtgtttttttctaattctgtgaagaaagtcagcggtagcttgatggagataacactgaatctataaattactttgggcagtatggccattttcatgatattgattcttcctatccgtgagcatggaatgtttttccatttgtttgtgtcttctcttattttcttgagcagtagtttgtaattatccttgaagaggtccttcacttcccttgtaagtgagttttaaaagataatttcaacttttattttagattcagggagggcacgtggatgtctgttacatgggtatattgcatgaagctgaagtttgagataaaaatgatcctgtcacccaggtagtgagcatagtactcaatagtttttcaactcttgtccctgatcttctctccatgttctagtagtctccaatgtctattgttgccatgtttgtccatgggtacccaatgtttagctcttacttataagtgagaacatgtggtatttggttttctgttcctcagttaatttagttaggacaatgacctccagctacatatatattgctgcaaatgacatgatttcattctttttatcactgcatagtattccttggcatatatatatataacacattttcttgatccaatccaccacagatgggcacctaggttgattccatgtcttggctagtgtgaatagtgctacaacgaacatatgagtgcaggtgtctttttggtagaatcatttattttcttttggatatatacccagtaatgagattgctgggttgaatggtattctgttttaagttctttgagaaatctccaagctgctttccacagtggatgaactaatttacattcccaccagcagtgtataagcaagcattcccttttctctgcagcctcaccagcatctgttgctttttgactttttaattatagccattctgattggtgtgaaatagtatctcactgtggttttgatttgcatttctctgatgattagtgatgttgagtaatttttcatgtttgttggcagcttatatggtttcttttgagaagtgtttgttcatgtcttttgcttgttaaatagttttgttttttacttgttaaattgttttgtttccttatgtgttcaaaatattagacctttgtcagatgcatagtttgtaaatattttctcccatcctgtatgttgtctatttactcccatcctgtaggttgatagtttcttttgctaggcagaagctctttagtttaattaggtcccacttgataatttttgcttttgttgccatcacctttgaggactgagtcataaattctttcccaaggccgatgtttcctagatttccttctaggattcttatagtttgaaattttacattgacattacttagcaatgagggagagcacaattccagcacctactgctgaggtattttccacagttctggctgtggaggctcctacttcactccagagcaggcatgccaatctctggcatgagactaaaatgcctccatggccatgctgctgggtctccaaagaatgactgactttgtatgcacctggattaaaaatggcctcctgctcttggtcccaagtctgggaaaatgtctgcagcttttccaagtgcctttctctttcagcgcctccaagcctctctccaaggcagttccagtgctcaggagaaacaaaatgctcttccttggtctaggttgctcagatcttcagtggaaatgtgagtcacagagggagactctctgtccctctcacctacccgggcttcaatcacgtttatcagccagatgctaccacgggagctgtctgccaacaaccccgggaactggggtgtccttcatggttctggttgattccttttttccttcttgaattaaagctcacatagttgatctttatgtactatcctgctacctccaagtggctgaggcaagctacctctaatctgccatcttgggagtgcgtagtggggggaactatatttttaatttatggtgggtttatggtgaacttaacctcatcataagttgaggagcacatgtacatcacttgtgacaacaagtagctgacaagtgaaagaaacacatggcaaagtaccaccttgataaatatctttacatcctttgacttggctgctacttgctttttgatatctttatcattatgagagatgtgtataacagaaagaattacagatgatgatttcttaaagtgattagttactaaatataaattatatttatatttattaatctatactcttatctactcaccttgttttaggggctcatatactttcctggaaaactatatataaatagtataaatggctattttttcaaacattttagctctagaaggatttattcaagtttatccattgaatctgcccatccatatctgttttacttctttagtcctactaattatccagtttattattaccttgattattgaatcaatgcaatctgacaaatatttccattttccccttctgggagcaaggtgggagtatatctcctggccattttatggaggggataaggccacaactctacgtttgatccataaggtgttaggaaacatgatgtgggtaatttcaagtctggaatagttaattgcccacatgagattcactggaattctctttccttcttgcacattgaatgacaaaattcgagttaacggccactgtgtcatcttggacccttgaataaatacagaaacagagctctgcaacccctgcaaataatttggaacatgacagagaataattctttgtggatttaagtcattgttattttggggctgtttgttaccttggtgtaacgcttcctaacatgtttaaaacattcactaatgtgtcttttcaaatacagttgttccacttccaaattattcttcagaaaggaaccacatttttgtttgtttctatttgtgaaacagtaactgttgtattgcataaaaatgacagaaagatgccatcataaagtaaataaaattttaaaatttgtcttacatttattccgtacagtgagttctttgccaaaaataaaatctgagttcagtaattaaaatgctagtctcatcaaagctctgaatctaatttaaagttgagattacttccctgccttagctattggctgatgcaagaataaagcccatgaaaaagaaagggaagggacaacttcttcactcatttctcacctaggacttcttttctcctgctctatcttggctatccatattctctgactcctccaattcagaacaagcagtagaagaggtaaggagagaagggatagttcttccttgagtggtaccatggtagatgactcccactagtattttctactttttccatattttaaaattcattttctgatgggcccgtgctttcattttttcatttttcattttttcatttttctgagatttctccctatcctttacacccaaccagtccgctgacatagtcaagtgcatgttttgagtttatccttatcccctaggcatctgccaatttaattctcatttcctctgctgaggtccccttgcccttcctgaaagatctaagacagtcacagagcagctcatgctctcctcttctcttctcctcttccaatctctctctctagcccacatgctgaatttcaccctggcaaactcagggtccacaacacttcccgaactgcaatcccctactctactatcaatagctccccaacctttacttgctcatatgtgactcatacttgatgacctacaaagcagtggatactaagacctccaagcgagacattaaacctcctcttttgactttggtttaggaggggttaccccactgggagcgatgaagtggacctgacagcatatctccctccagagacacctcttaaaaacctttcccctctccccatgggcgctcttccatatttttggtttgatagagtgctttaacagtcctcaaactggttctgcattagcatctctctttgcaatgtgcctcagctgaaacttccattagaatcatttgcaaacagaaatcaagtcttgccaactccacctgtctcctataccctcaccaccagcccccgcacacattctgataaaaagccttcagagacttcatttgaatttaggattaaaatctaattaaatcctacatgatctaaattctgcctgtcttaacaaccctttggtatgataataagagctagtcgcatgagtctcctgtttctcttatgaaagaactctcttgccgtacagcagggtttctcaatctcaatactatttacattgattgggcagatacctctttgttataaggcactgtcctgtgcattgtaggatgtttagcagtatccctggcctctatcaactatatgtgattactacccccaaccttgtcgtgacaatcaaaaatgcctccagatattgccgaatgtctcctgaggagggcacagattgtccgtctgttgccttagaaacttcatatgtgatattccctctgtctcaaagtctatcttgctcattctctacctaaaaatttcctactcatctttatccctgaatgagtttccaaaactaagtcagttcttctggtgataaagcatctcaacattacttttcctttgtagctacacaggtggtttacaacctccctctctccgcctcccacagagatacttttggagcattggtttatggcatatgccacatacccaggccactacaacaggatgaggcctttataatgcaactgaaggctgaggaaacacccagacctcgttggagaagcttccaggcagtgtaacagttttaattttctcttttctcttttagatatgtcattggctgaatcaaaagcctttgctgatgtttcttttgtgagtagaatggatgaaactgagtgagagataataataagagctaagaggtaatgaacatgtactatgtgctttacataaaataatacattcagtcctcacaatgaattagcactagctagcttcatctgacaaaagacaaaatcacaattcagagagaataaagtattcatttcagatcaggtattggcttcatagatctgccttgattcttcataactgctgttccctctgctgggaagtttcttccccctattaaccacatgcctttcctcctcaccttccaggtctctcttcgaatgtcaccttctcaggtaggatttcttgagtgctctatttaaaattataaatagatgcctcacgctggcatttcctgctttgctttcttcgatagcacttcctgccatctgaaatgctgctgttttactttgattgcctctctcctctgaaagactggaagttcttcgagggcagtgattttcttgcaaggctaaatcctcagtacctgaaacatgcttcacacttggtgagttcaccataaacatttgttgaataaaggatgagtaaatttcaatcctctacatgaaggtcttagtatttgaactaggcatacagtcttggggtgaaatgttggttcaaacttgtttcaagaatgctttcattttagttttctagaaacaagaatactgaccatgcaaattgtatacaggtaatccagggtacatacagataatccagggtaaaagagactagaagtgactctctcctgcctccatagttaatttctagagaggaaggccctgaggcagaaagcaggtagacaaccagcttgcacttgtgttggtggcctgtcagccagggttgagtttgacctggcccgaggcacccacagcagctgtggccaaaatcagactgggccaagagaatttttcatggttcaccaagatcacctgctgtgataatctaccctggtaacattttatatttctgaaaattcgccttaatttatataagtaacctaaatccatcatgctgtttttaaaatacattttctatccttcttgtctcagaaattatagaaacagatgtatactctcatcacaaaaataaccttacatcagatgaaaattttactaggtcatgcccccaaaattaacaaagttactaactatgcaatttttcattttatattaaatcatacgaataattttcctatctccctaaacccattaaaagtccagtactttatagcagagatgacattgaatgattcacaaattaatgaaaccattgttacagtgctttaaattttaggaactagaattataaaaaccttataaaaccatgactccccccagccccttcagtagcacatgtgttgcctgtttgaatactaaacgtgtgagaagccattttatgaacactttgcactaaataacttttctaggatgaataagggtgcctagatatttccacagaggcagattagtgacattcaaattgtaatcttgttcctcgaagcagaagtaagcttttctataaaggacccaacttgaaagggaaattttgctgacagtgagagtttgagtttcagtccctaaagccaggggcaagtttttcaagagacccatactgcaaggccacattgtggactatgtaacttcagctaatttcttggaaatgtgagtataattgtctctgcattttacatatttaagtgatatgatgtgacagcatctgggttataggatggggggttctgaaccatgagaacccctaaatttgagaccgttttgtgtcaggatattctgagctctgtctcaagggattttttcctctgacccacagtgcagaattgtttcctgattaggctgtttcaaagctaaaagggacaaaaatagggctgagcagccagccagccaaatgtaccttttataaatctatctctaaacttgtagagaactctaacaatggtttcattaatttaacaatcactcaatgtcatatctattataatgtactaagctcttaagagagaaagaaaaaagaaaattgttttattcccgtgatttaatttaaaatgaaaaattgcattgatggtagtcttgttaaactttttttgatttgctttatgatttaaagtatggactttcttttcttgagggccatgcttctgtcttctattttaaaacttctaaataatcattcttatcttctaggacaggtatgaaaacacttgataagtgattttaataaaaacatatactgtgtacttgtaacttggtaacaaacgcagccaaaaaggttgcatattgaaacagtgtatatccaaaccgtatacctagcttggcccccaagatgcctgtgggaacaatgaaataccctgactgatccccattgctcaccatgtagcttactttggctagatcactttcctgggtccctgggatcttcctgggattcttgccaaatccagtttccagttcccagggtaggttatactccttttgcacagttcttcacagccgtggtttgggattgtcccatcaaagactctttgtggacaatataatactctccctttctcagagagctcctttgataatgtcctaaaacttctgtctttctaatccacaaaggatttttcctaggttcagaattttctggatctgctagcctactaaaatccccctgtgattctggagtatagtagaaacatcagagttacttagtcagacattcttgaaatagattagactttaccaggggtgactgagccaaaattgttacatttcgtaaccatgaaaatgaaagacttccactgaaagcaggacatattggaagacaaatgcatttgattctaggctcatggggtcccttttttctgctactaattttgaagttgacctctttacgaacattgattctcttttgagatccagtcatttcaaggggaagagaagatgatattctaatccatttgcccacataaacagagtcaaaaagcacgataatattaatttcttggttttgaatattcatttttagtttgaaaagtgtatcatgattatgtaagatgctaactttagggaaaagtagataaaatggattcagtttatctatggaacatctttgtaaactttctgtaaatctaaagttattccaaaataaaaaatttatttaaaaaatttgtggatgatagaaggggacctcagtgattcaaaaagtcacttaaatcccagagaatgatacaatcaatatttgtagaggatagaaaatgatccaacacctctcctagctacattgataattaatttgcattagagactgacatcaaatgcctcagcctatatatgtttctgtgtaaaacactcagaattagaaggaggtctgcagcaggacatatactgaaaacttaaaattcaaaatgtgcagaaagtcccttattttaaatcaacagtgtacttaaaaatatttacctactcattttcttcaggcttcctttatactagatgattatgcaaatagaatttaaaagggaaaaaacaatctatgtttttgctcttgtccattataaatatttacgcattttggtgaagcaggaaagtggttgttagcaaaactgatttggatggataggaggaaattttgattaaaaataaagtaaagcataatgagattggggaaaatgtcatctgaggaaaaaaatctcattttttttttcagtttttaccaacatccttttttgagagtactgcagacaattatgtcacatacacatttttaagactttttcccattacactagacttcttcattttctaaatttgttatttgtaaatggaattcatttctctggcttcattttcttgtctcattatgctgaattcagcgagtgtttgttttgaaaccctctttaaataagagctcccatttcttttcatcatctgtaagttcttaaccatgtacaaaatcatttttgttgaaccaactttccagttcacgcaccactgctactagaaattctaggatgaaatccatcattaggcgactcaaagaaattatggagtttttttttttttttttttccactttctgtttcttgctagttattgagaaatttggtgattcagagaataaggaaagagagtggggagcgctctgactagtgtctagtaaccccttagtggatgacttcagctggctttaagcaattgctttttttattttattttttattgttttttgagatggagtcttactctgcggcccaggctggagtgcagtggcacgatctcggctcactgcaacctccgcctcccaggttcaagcaattctcctctctcagcctcctgagtagctgggattacaggcacgtgccaccacgccagctaattttttgtatttttagtagtgacggggtttcaccgtgttagcgaggatggtcttgatctcctgacctcgtgatctgcccgcctcggcctcccaaagtgttgggattacaggcgtgagcgagcgggcccggccttaagcagttgcttttaatacaataattcctctcccaaagtgttgggattacaggcgtgagcgagcgggcccggccttaagcagttgcttttaatacaataattcctcttctaaattcactgtgaggctgcagtcaggaattggttttggtaattgtaaagtccagctgaagtgctggtggaaactctatactaataagtgcttggcaattatagttatgtccccattgaagtgatccaatacatgttgcgtacttcgctatatccaaaactggcagaaatttgtcttcagtgattaaaacagttatcactgcccagccctaaaagatttataaacactgtatacatttagaaaccccttttcaatctaaaaataaatatataaataaataaataataaaaataaaaataaacaatggcagcatgtttttaattatgcctaattgaaaaaggaataaaatcatttggaagttaggtgaagaaaagaggatgaaaagtctgataatcagtggttattctaaagaaaataaaattcttctcaatgtaaatcatataaacataccagagtgctttaaaaatacagttaaataatcacattgttttactgttttggcaaaagttccatttagcatagaaaataaatatcactcatattgttttcattttgctttatgtgttcaaataggatatataccagctctacacatcatccaaatatataattatgtggttaattatcacaacatagtgttattcttattaactttaaatattttgtgattattagaaaacaaatttaataataaggagtattcattgctttcatcacacattgattaaatatgtttttctgagggtctgttgagtgcaaagaattgtgctgtaatagtatatattttttccaatttttctttctaactgttgatttcttatttccttagcaatcaaagcatatggactatattttaattctacagacattgcgttaggcagaacagctaccaacacccaatccctgaaatttgtgattatgttttgatacatggcaaaaggaactatgcagatgtaattaaggttaagaactttaaaataggaagattaaatccaaggagttcttcaaagtaaagaactactacatgcagaaggtatgtgctgcctggggcacctcgtagttggaaggaaggctcctcacagtgcatgatggagctgtgggcgggaaaacaagagagaaggccattggctgagagctcaggggctcgttctctctgtgctgccatctctaggtgagaaactccagtgttggaacctggccttcaatgttgtcatgccaaggtaatcaataaggtagagcctcttttatttaatgccaataagcaagtaggtcagggtgatttaaaactttttaaaatacataggaatgtgctatgtgggtctccatttgtacttttgctccaggtcctgacaatttcagtcataggcctgagataataatttgaataacggacttattgaaggcttagtgaatgtcctctgtgtgttggatatcatgcagactgcttggcatgtactatttttttaagttcagataacaattctttgaggtaggaataatgtgtgtacatattttagagatgagtaaatgacattacaggagtagagtgatctaactaatgaatcttaccaaagaaaagcattcctgtgaaatctgtgtgactaaagggagggtagaaatagttgtcttccccagtttcctcttgctttgtctattttctttagagatgcccaggctggagtgcagtggctatccacaggcgtgatcatattgaactgcagccttgcactcgtgggctcaagtgcatctacctgcctcagcttctccagtagctggaactacaggtgcaggccactgtgcccagcttcctcctgtctctagccacactgtaatcacaaatcacaaaagttttcttaaattatattggtcccagaggaatagtaatgatatttgctacagtttcagtttccatctgtacttaaggaggaatagcacccaaactcagcaagcaacccagagctctagttcttgattctgcaaagtttttgttatagtaaaatcttttgttttgtcagtatgacttctttttggagtctgagttatgcatttgacatgaattcaagttcagttatcattcatctcctttgtatttacacaaatcaattaagtctaaactgcaaatagtttttgtctcaggttcacctctgataggctggtagcagctgtctggatagtcccgccaagaaggatcgagtagctgcatgtagatgcagtaagaaagagcacaattagaagaggagactggggatatgcctaccatgaatttcttatccgtaatcagtagagcccagcccttgtgcacagatatacaaacagtggcaatttttttttttgtccaccaaaggattattcaacaaggcacatacaacctatagagaggaagatgcctctctattcactcaaatacatagtttttttttttttgcatttccaattatctattgctaataatcttttcagtgcttacatatgtgcatgcctgtacacacacacacacacagacacatacacacatatatcctaaagtttgtgaaactatagtttgccttatggaaggaaaacacttgatcctattcacaggggtaatttttagacatctctattcataggtataaccagcttagaaaatttactgctgtattaagggtcagaatagcaactcacaggaaattgaacatttggagaacccaataggtaacttttaagagagaagtatttatgatatgaaggaacataaaagttttgtttttactccctttggttttcttctgtaattctagattgggaagaaataacagagagtgcttgaagaatagatgtggctaggacaatatctctgaatctctgaatggcccatggtggtgacccccagccagagtgaactgtgcagcagcaatggtgcccagtgggcagcaacagtggaacagaaggtgaggaaggggccagaaggaatcctttaggaaattaagaaaaggataaaaatatgataaaaatgtggtgtccaggcgagaaacggaataacctcatccctgttctgactaacaatttggtaatattttgacagttttgaacaagaacttccttctccttttcttttggagtacaccatagtgaaagacctatggtaaaaaacaaggtacaactggaatactgctttttgtttttctattttcaatagtatctcctgtttataatggattgttttaatctcagggaagaacatctgaggagatcaccgggtctctaaataccagttcttgtctctgcacaccttttttaggggggactgatgcctggttatatctgcggtacaccagttcctaaagcaatacctaagaaagtcaatgtttcctagataaacttgactttcatcaaatgatatttagaatcagttttaaacttgtagagtattgcaatcaattatgatcatattttgcagcatatatcatgaagtccaaatcattttagcttaaagaaaacagacgtctattattttttcacttagagtaagtcaggaagtgtgtagtcttatgtgttggctttccagtgtcatcaggggcccagattcctgtctttctgctctgccatctccaatgtgtggtttctaacctcatgatccaaagtgggttcttttgctccagcccgcgtatcaatgtaccaggccagtagaatgaagaaactaaggagagcaaaaggaggctccttcctaactgagtcaactttctttaagcatttgtcctgaaggtctcacacaatatttttgcatacgtctcacaggtcaaaacttagttatgtgtccacacaaaatttcagaagaggctggaaggtgttgtcttttagctgaatgcattatcatcctggaattcaaatctgggttctaatagtaagcgagaaagagagcgtggttattaagtggtgtcatttggcacagcctgtcaacagaggacatgttaattggcattcatactgatgttttaataaagcatgtagtgtgcttatgaggaccaagattgaccatactttggtcatcatcaatcatggactgaaaggcttttaaacatgaggtatgtaccgcctagcattcagtaacaacccacttagtcattcctaccttaattttaggtgcatgataccaaaatgttaacatatttgagaaacagtccaagctaatttaatttacgtaagtacatttttagataagacaatgataaatttgaaaatcagtttggtttaatgattggttagttaaaaatatatcaaataaataactttttctaccttagcatttttaaaattctggacctaaaattattacattctatttagggcaaggattagcaaaatacagcttacaggccaagtttgtcttgacttccttttttgtaaataaagtttttttgaaacacagttactctcatatggttacatattgtcagtggctgctttcactctatatcggcagaaccgagtaattgtattagatacccccaccactaaacccaatgtgtttactatctggattcatacagacaatgtttgctgacccctggcataggcaaagcaaaatacatgacacaatgaatttccctcatacttagaagttagggcccacagaactcacctgaaaagttgcttaatagttacttaattatatagcagattaatcagtttttaacttgattctgacgttcctaaagaatggcaaattccttcctaacacaaactaaacctttacctccgtggttctcaactggggtcaattgtgtctgccagagacatctggtaatatgtagagacctttttagttgtcacaagttggggttgggaggtggctgccactggcatttgataggcagaggccaggggtgctgccaaacgtcctacaatgcacaggaccgccactcaacacaaggaactatctggcacaaaagtcactagtgctaagactgagaaactccatggtaagtgagaactccctaggaccgaataggtagttgtcaataacaaaaaggaggaattactttccttaaaggtaaaaataattgtggcattcggtaaaaataattgtggcattctttcttggtggtggaggttttgctgtactccttccttgtttttattctccgaatgaaaacaccatttttatctgaattagtagctcaaagttttccattaatcacctcaaacggactgacacagtgtttcacacacaatgtcacgcatgctgtatgctaactcctgagttttgttctgagggagaaaaatgaattccatggccaaaagtactagaggaagaacactcatcatatcatcatctgggaggttcactgtttacctccaggatattaatggcactcagaagactggtggtgaagaaacctaggaactgtagaaatgtaaaacctgatgaggctgctatttgtagactaggtccagggaagatgtactaggtcagaggagaagatatcatggcagaatcttctaaacagtttttcatggatgacttattcatacatggtcctcagacatggtcctcagagtgaaaaataaaagaattcctaagtaaatgaatttggagattactaccttttacagagtttaacaagttcaattatagcaaaggcttttaaccctctttttctgtgtgtgataaatcccattggcagtcgcagatctcttctcaaattaatgtgatcaaatgcataaagcaaaatgtatagggtatcaaataaattgcattgaagtgtaattaacaaaacaaaaataaactggtgatatatgaatgtaagcatctctttattatcacattaaataataagatctagcagtaggtctactaactaccatacttttaaagtagtagtgagtacaaataatatttcaagacagctgcaataacggtgatgtgatatgaaaacatctgtcatttttgttggggacaaagtcacaagtactgccaatattactacagcttgttgtcttcattcaaacggaagaaaatgctaaatttcagtgaagtgaaaactaaggtttaaaccatcgtagagcctttaaaatgttatgttacttgtgagtttccagaagtaatggttgtgggacttgtttgaacttatttgaacatagaaactttaatatattttgaaaagataatttcacatgccatgtgggaaatgttgccttgagctagtgctgtacgcctgaaagcttctaatgtaatgatgcagtattgcatttataatcattgttttaagctagcgttttcaaatccagttcagctccatgataacagctgttgttttctttaccgatgtatttcactttcagatatgattttttaaaaatttctttgaacttcatacttttcttagcaaatatctccatttaaattctcagaatgaaaataaaaatgagttgtctcacacctctacacttagaaaatctaggctgcctgtggccctttgccctaacacgtgactcctgtatcatgtatgtataactcccttctaattaagcaacctcattcatcaagaaagccctgcagcgataaggtaatttttgccacaggaatgtgacactaccatgtgccagttgctgaaatagttgcacagattttagtgaaatgcaagagataagtgagtaagaaagtgaaaattgtcagcccataaattactgctgccctcagtctacagtaattacagcaaagctgtagataactgtccctctgatgaactctagcaaaatggtcttttaagtttatcagcatattcaggtacaactctctcaggaggcttggcctcttctaaatgatcaaatattctgagggtgggtggcagaaggacaaaagatgaggaaaaaggaaagagaaacattatttacatcaattaaagtaatttttaagtttattcttttaaaattatctagtagaagccttctttctcacttatgattcctttaaatgacacttgctattttaatgactattaaaatagtcattaaaatattaagtactaaatggtacttgctatttttattaatggatgccgaaagcagtcagggagctaattattatattgtgaaagtaaaaatatatatgaggctcatgtaaaacagttttgtttgtttcttttgattatttatttatttatttatttatttatttaaagacagtgtcttggctgggcgcggtggctcacgcctgtaatcccagcactttgggaggccaagttgcgtggatcacgaggtcaggagatcgagacaagcctggccaacatggtgaaactccgtctctactaaaattagctgggcgaggtagcatgtgcctgtaatcccacctactcaggaggctgaggcaggagaattgcttgaatcagggagtcggaggctgcagtcagctgagacggcaccattgcactccagccttgtgacagagtgagactccatctcaaaaaaaaaaaaaaaaaaaaagacagggtctcattctgttgcccaggctggagtgcagtggcataatctgggttcactgaagcctcaatttcctgggctaaagcaatcctcccacctaagccttcagagtagctgggactataggtctgtgccaacatgctcagctaattgttttgtttgttttctgtagagacggggtctcactatgttgcccatcctggtcttgaactactgggcttaagtgatcttcctgactcagcctcctaaagtgctgagattacagttgtgagccaccatgcctagcctcatgtaagtttagagctataaacttaaatgatgggtcatcagtcatattactttttttccttttcaacatttttattatctcaataatcttataaggtgtggaatctactattattcccattttataggttagtacaggtatcatcagttgaagtgtccttttcttttttttttttttttttgacacagtttcactctgtcacccaggctagagtacagtggtgccatcttggttcactgcaacctccaccccccgggttaaagtgattctcctgcctcagcctcccaagtagctgggattacaggcgcctgccactgcgcccggctaatttttgtatttttagtagagacgggtttcaccttcttggccaggctggtcttgaactcctgaccttgtgatccactcgccttggcctcccaaagtgctaggattacagacgtgagatgtccttttcactctcactgctagaaaatggtggtgccataatttggaaaaaaaaaaaaatcttctgcagatttggtaaaatgatcctgaaataatgtgaagccaaaaaaaaaaagtggatatgcagttgttctatgtttaaaactattaagcaaatatatacatatattcatttaaatatatatacatattttaatatatacatatatttaagtgtatatacatacttaaatatatatgtatgtagatgtgtgtttgtatatgtgtatatatattatatataaaatatatatatctaagtaaaaaagacaaattaaaaatactaaaaagacaacagtgctgattctagtctgaggagataataagtcatcatttcaacacttaaaattttatgtattgtcgaaattttctgcagtaggtaactatacttttattggcaggaagagaaattcttatgaaaaatgattgatattatatcttttaaaattgtaagaataagtaaattagtaaattccaaagttcaaacattaacttctattgataatagagttttaaaaattctttcaggaagatggagaaaaaagaagactgacaactctcccaagcagcaccatttccaaaaacatttacaagatagtggatgtggtggtgacaactgaggaaagagcacagagacaaaatcagaagcttgttgaactccttctctctctcctaccaacctggaacagagggcttttatatagaatttcaagtgctgtcctttacccctttgttaactcattctaagcatgaagacaagcactcttggaatgatcatttaaaacagtcactgccctttcatgatagcctcctcagaccttgccagcttgaacaataaattacaaatcatttttttgctgctattgctgaggtatagctttcaatattatcactgatttaagagttgatgtattttgaaaagtcagactaatatggcagcatttcggatgaggcctcttttgtgtgtctgctttattcctttgttggagttccacattttctttgtgtgggaccgaggaatcatggaaaattgccacttgtgtgataaattactgttttcacccatcaaacatagaaaatgctccatgtgagccttgcacaccattatgttgtcccatctaggaccctttgaaagtcagcagggtgcatctggctgaaattcagtcaggcgattaaatttattcaagcttggtgaacttgagagctttcaaaagaagagtagctgaagggatgagattatagtcctgacagggctctggaaagggtgtctgacacctgacggctcacagcgagccatggtacctgttcccattgatttgcaacaaagtctttctcaataagtatttccacttaacatttcctctcagggaacctgtgccgttgaagatatttacaagttgctttcagcttaaaaataaatcacctctaattcctctaagcgaaatcaatcaaaaacctgtaaaaaatggactggttgtttggtcgattctggcagaaaagtaaacagcacttcagcttttctccgccattaaggcctaaatggcctagaaagtaaatcaatatttctagtcagccttctggctattgtttagccagtagatatggatttctctggcttactgaactcctttgggactagcctataatcctctgagaggaataataagttcgttatctagttcagctctctgttgtacatttaaatggactacatccatcagcagcccttgttaaagttaaagggtgagggcatcccattcaaccccctttagagtgagacacttccaacacagtgagggggaaattataattcaaagttctactggttggcaaatggcctaaaaaccctaagtaagggtgaggcagtaatttgagtatgaggaggcatatcatactgctgtttcaagctaggaaatgctacttgcccatttctgagtatactatgatacatacataagggtatttgctagagagtctctcattattcctactagtccttcttgaatgtttttatttaaatactcctgtgattctgaacagtaaaagctatcagaactttcctgatgtagcaaaccaacatgcttccacctctccttgtcagcaaatggagaatctcatacttctactaattttactttaataatttaaaaatgactgtactaacagcttggcaatgcagtttttgagggttttagaagataagaatcctggataaaagaccattccttgaagaaattaatttccccttgcctttcaacttgataaactaaaattctcctttaaattccatccatgtattctggcttcatatgaagaagtgataatgtaggaataatttattttgagctattttatacacttaatttttatattattttgttgatttcttaacaagagccacaaagacaaaaatgaattatgattacttgaaactttcaaatgtaggtatttatggtatccaagacatttctttaacaaaacaaaaacaatagtgtttccaaaggtcccaggtgtctcttattaagtcttggcatgtatttcatttagagattgttttcataattttttaaagtaaaattatcacaacagaattaataaagggaaatataattatttagataaaatagtcacaatagaatttagaaggtagaatatgtatgcaacatatactcatttaggaatgaaagttattatattaatgcctaatattgagctagcctatgaagctgacttgttctgtagagatttttactgctgccttcttcaaggactcacctcttcaattgccagaaagtttgttttagagagaatacttaattatttggaaatcttttatggggaaaaattaaattcagtaaaaatcaacctaaaagtttgtattcaatttgatacgtttgttaactacacttgctagaggtattttgtgattaaataataactttaccgattattaatgccacattaaattcacttttaagaattcagttaacaactatttttgcatggaaatgtagaattttatctattttggtttttgctgtattttgaagaagtctatgctgagaatctgactgtgacagattttgctcctcataagccaagtcaactttctcactatcacctttcatattctccaacttatttgatggctgatgttcttcccaggaggagataaaaaggtgacttgaatgataagggaggccagacatggtggcttatgcctgtaatcccagattttgagaggctgaggcaggtggatcgcttgagcccaggcaagaccagcctaagcaacatggccggtctacaaaagaaaaaaaaataaaaaaaaaaaaaggaaaaattagcccggtgtggtggcagatgcctatagtcccatagtcccagctactcaggaagctgaggtgagaggatcacttgagcctggcaggttgaggctgcagtaatcacaccactgaactctggcctgggcaacagaatgagaccctgtgtcaggaaaaataaaagaaagaatggtaaagacaaagggctcttctccgtcttttagatatattgacacttgattttcatacttttaattcttcagtagtgttcacatgcttaaagttaaaataaatgcaaaatgctcactgtattctcattctaaaattgcgttggaatgatataatattgagagactttactaatcatatgaaatgagaatcagatagaaatgatagaatttatttgcaaaattgagttgatttttcatgtttgattatacttcaacatccctattaaagttttacttaaatggtgtgaaaatttacataagaactataactcttagtacatttataatatacatttcatgtgttttccaaaacaatttggaaatcaggttatgtctgcataacctgacaataccaaaatgtatctatctcttacttgtcaggaaacatttcttaccaactgacttggaggtatgaatgcatgtaaattttctctgtattagcttcatttttattctgatgtttgagaaacactaacatatatagagaaatattattatatcaataaggtttaatttgccagtcaaaacctttcaagattataaggttatagcctttatctgggagttgtcagtactggatgaggttgccaacacaaaaaggtagtgagaatctagttgtttattttgttttgtattgcgttaacatgatataatcacttttctgagaaacataagttatttctgcatcctcataattatcagtgaatggaacgtactatttattcaacacatgattgttaaaagaacatataaataaatgaatatgtaaatgaatatatatgactataaattaagactactattttgtttctgcagcagaagcttagacaatttattaatgtgtgtccctggggtcttaccagggcatgcagtggcattgacagaatgaattaactgagtgaagctgttttggtgctgttgtctaaactcagaaagtggagagtagttgacaacaaaagagtttggtcaaatcctattggaaattccaaatcccattcgcaaaaagtggctataacaaacaattacaatgaataaaataagaatttgatcagtcacattcgactgactagaagacatttattctatataccaagatagctttggaataagaatttctctaacatcctttcacataggagataaaacttctacagaaatagctctgtgctacatcaaaagcatttcagggaagggctcagccaattataacctgagggccaaaacagacctgttttttgtttttgtttttttttttttgagacggagtctcgctatcgcccaggctggagtgcagtggcacgatctcggctcactgcaagctctgccccctggggttcacgccattctcctgcctcagcctcccgcgtagctgggactacaggcgcccgccaccttgccaggctaattttttgtatttttagtagagacggggtttcaccgtgtaagccaggatggtctcgatctcctgacctcgtgatccgcccgcctcggcctcccaaagtgctgggattacaggcgtgagccaccgcgcccggtcaacagacctgtttttatacagcttgtgtatgtgtaactgatttgatgacaacgaacaccaattttgaaccactattaagcaaaatgttacttccccaaaacaaataaccatctttctcattagtataccatatgatttaaaaaagcactcaatattatatttttaatgttattaatgcatactatgtagaaatttattctttcttttgatgtaataatctacataaatatctttaattttgcatcttggactgcaaagtatgagaattcattatctggcctttacaggaaaagtttgccaatcccagtgccagtgtatcacactgctctcgaaggatcatgaaatatttacattgctaatttagctgatacaacatctttaggcctttatcttctcttccttcatctcaccatctatttaactatcttattaatccaccttggttagagaaccctcaaggataatgtttttatagtgtctaacgatttctttgttctaaatctgaacgagaaactctgtgtctactatttggtctagaaaaaccataagcaacctctctgaactgatgttacatataacatgaagattgtgtatatcaccttagagccatgcaactaagaacaacatgagtctggtgacacagatccaatctgaggggagctagctggacatggctgtatggtgaatttttaaaaagaaaaaaaaaaagtaagcacttagttcagttcatttctttttatcttaaatagcacaaaattatccttttgtcatttaattcacagtggtatctagaaatcagtgatggaaaagatcaattaggtcatttagctcctttccaaggttccaattttctctttcagcatattaacttttgcctgtccaaatttaagtgactaaagagatgggtttccacaacttacttgggagatatttctaaatcaaatttatctgtaccaaagcatcgttaaagactttgctattagagttatactaaattgttctctgcttaattgcatctcatttttccttcattcctcttggctactcaaagcaaactttgtttttctttgaatagatttattttagaccagctcatcctcatatattattgacaaagaatatatcattaattgtttctgttcattacatgaattgttgcttaaatatttttgttcttttgctcagaaaccacagtggaaaggaggccactttgtattaaaaataacaatatttcataggaaattctcttaaattcatcaagggatccagtggctgtgcataaccttttctagcttcaacccatcgaacatgaatgccatgtaagttgttgttatatcttcacctttcttcctgctattcatttccccatcaatgaccattttttttttattttctgaaacttcaatcacattaagcttttcttttttctgccataaaacatggctcccatacccctcattgattaagtctaactcaagatattctaaggatgctaggttcaacagcatattgttctcttcttcctgcccaattgatggatatcctgtaacacaatcttgaatccaaaaatgagctgattaaagaagtattaagaaaatccatatatatgactaagtcaatccatcagtgttttgctcagtagggtcaacttttctgtatgtagaaaataccactgccaggagatagtaatgaactacgacctctgagagtgttgcaacaggaactaacaacaaggaaacttttgctattagagcaaatagactcctaatcaacatattatcgatccttcatttttgtcaaggttattttgtgctttaaaaaatgatcctacagcaaggctttaataggaaaagtagactaatttgatttaaagagtaaatgctattaattatgaaagacagtcaataaaaagcttgttcttccaaacataaaggcaaatcttatagtgcctttgatttatggtaatgaatacaatgatgaaatattttgactagtatctcttactctcaccctaccttttgctgtttttcttgctcacacattagaaatacttaaaataatctcttccaagccatttttggaacaaaataatttttataatttagtaaatatactttttaaatagataaacctgttacacaatattttgatattatttccagaagaaatgtaacaaaaaggaaaaatttcattttatgtttaaagatatgggtaaacatttatagttgcttattataagttgatgttcaaacaccatatagtgatgagatttaaacaagaattttagcattctaaaatccagataagtaaaaaatttcagagaactaccatgtttaaatgatatattactatatgtaaaaatatgtgcaaataccaaacatgtaatattctgtattctgacatattaaatctgttaaagccatttttaggttccattaatttattattcacattattttatctgaaagaaattaagatatacattatttcacaataataaaaaacagtgaatttaagaaaaaattcttgaacatctatatataacctattggattactagtttctctaagaaaaagggttaatgctttatttccctaaaatgatctaattatatgcattgcaagttattttatgtctcacttcaataaggtaaaatttattggttataaattatacatttgaaggactgctttcaatataactttcctcattatgagtcatcaatatatgaattgtttagtcttctagactgtaattatatgactatatcactggagaatggtagggcaggttaaccttacatgttggttaggatgagatttccttctgttatgaaagggtatatttataggttaggaattaatatattttaaatatattaactgtgaatagatgcaaagtctgttacctgaaaaatttcacatttttttctaaattttactgaagatttgtttatttgatacaacaattaatttcaaggtgaaataaagtagcatatcttgtaagaaacaagaggcacagtagcctagccttgcatagtgactaaattatcaaaacttacatggaacaaatagtttgggccattcatttaattactaacagattatattttctacaaaaagaaagctgtgttggcttaccatcagggactccattaattttagattcatatcagtctttgttagaccttacatactgagatttaatgcaaagatgatactcaagttcacctcaaagctgaaaactccacatctgtgtggccatggaccaaaaggctgttttgagcttggatttgttgatgggcttcttcaaaaagcatgatattcaacaaccttaatgacatgtaggttaaagcagatggcatatttaaacagaaccagtatttatttttaaaattgctataagcagtatgttttaaagtgctctggacacatttcacaccagggtgacaatatgcttcaatccacaccaagctctcttttagctaaagctgccatgctatgtgactatctactgagtttatagagtaataaaactctgaagactgaagccagatctctgaataaaagaggcagaatagttgctgtagtctctgtatcttactaattcagaggaagacgaatttctaactttgaataaggttgagaagatggctacgatttcatttccatggtttttattacaaaaattatgttatatggaaatattgaagagattaaattattccggtcaataagtttttcaagctttctgggagagagagagagagagaaatttacatacagaagaaattgcggggcatgaaaatctgctaagggttacatgttttctcgcaattttacataggtagacaggacatgatctaaatgttcttgaagatagaaaattagattattagtatgaataattgtgttgtactatatgaagagctaaagttacaaataccagtttcactagtacaagaccgggcaggggataagaattgtgagtgcgctgacctgtgggagtttgccgttctctgtttaagcgtagtggttggcctactgttaacatgtggactattttaggagaatagaagtactagtgcatatttgcacctttccctttttccatagtccagttgttagaaatattctgtaagtatattctcaggttctactgtggaaagtgagttcttttcttctttactccttttaagatagtaaagatcacctctctgagagtctagaactgctgtgtccttctagtcaaaaagttgctttgttcattgcgtttcttcattgctcattttctttagccttacagagtctctttaccacttctatcactatgtgtgacctgcatgttcaccaccagggtccagtggacacttctttgtcatatatttctccttttgattacttatttttcacttttgtttggttacgttttgtttcatgttgcttctcttgtacttcttagctttcatgcaaaaaaaagtggattgtgcttgttaggtaatttaagcatttttcattatgaatgctttcttatgtcaagtatagtatttgggttttctccttttagataaattaattgttcccgggtgctcaacaattcggctttattttcaaggaactgggagtcttctcttttgtttgttatttcaaaatgaatagtggtacaaaacagtggtgcaaaaaatagtgttgcaaaaaatctgatttcagatggccacaattttactgaaatatctgaacactcagcatcaatataaacattggaatcacttcaaaggatgttttacgcattggagaaatgcaagatagataaatgctcacctattgcaactatctaaatatctactttgatctcatcctcttgaatgatttcgatcaatggtaatgactgggtgaagagaataaagataggaaaaatgaagaaatgccaagttttacagtagccattgtgaaacattatgttaaaccacatttaccaataaataaatggtcttctatgtttccttgagctgaggccttgagactgtccttgtgaatacaaaatgaaaattagaaaaacagacactttataatgaacatcagtaggatctgtatatggtactaaaggcataattcattcaaaaggctgagcaactgacaatcaatgctttgagcacaaattcacattatgattttgacaaattcacactatcattttcaaaagaaatagcgaggcaaagctataaaattcttttataaaaaagaaaacttactgggatgtgtgaaggcaaaatcttggactctgtttttattatcattttgctcttccaaaatgagcaaatcatctacagaagtaaaagatttagtagtaactttattctgatgagctagaatgagagtagagccagaatagagattagaagctcatcaaggggatggaatcagagtgaacagttgttggcatttgttatctggagtcatctatgaagtaatatgagctcaggatgctaacacatggtctatgactaaaaaaaaaaagttgcagaaacaagagggaggcaagatattgacttgcagaaggttatgattttgaaattcattaaggttttcaggttggttgtgggcccagactaatgcttaggaaagatctaggggctgctcgaatgcaaccccaacaagttatgtgcctgtaaaatttgcagatctgaatatctcacatttacaacccgcagacgtgaagagaaagtatagtgaaattagtaagagatttggactcaagagatatgagttcaggagtttcctcggcgacttagaaaacatatgtatccgagttgaatttttaacttctccaacgctcattttctgattggcaaaatggcaataccactattaccaccatcattactactactagaataaaagtggtctaaagctattgagaatatatcaaaaatatatttgaaagcatttggtacagaaaacaaaatgttagtattcattattataaatatataataatggttaaatagccacaactttttgtatatggagctatttatgtgagaaaaataacttaccatatttgagttttcagttattttataatcaatagctccagttaatgccctaaaacctaaatattagtgagacagaagtatgtaacttgtttgatattagttaaatttagaaaaattatattttattaataacaatacttacaaagccattcatcctgaaacaatagtacctataatacaaataacccttaactaattttataactaagtgctaagattaaaggaaaaaaatgtgaattgattactatgtatagtgactgtcctatatatttacttgtataaaaaagcaagttttgattttagcctgagataaaagaaaacttagagttgatagtactttaattgagaaagactatgggatgacatccaaattatgtgtttctagaatggcaatgaaaatctacttcaacagggtgttctttgaaaaagtcattcctcttgaagttctcaaaaagagacagaatagggaacagactattctgaagcctttgaatctaacaaaatgacaaaatgaaagttttttttaaacagtcttcatagactgccagatttttctcttttgatagaagagatacacgaaggacaatattaacaagaaatttagaatattacaaaaaacaccataaattttgacgataagaatattttcaaattattttaaaagaagttctaaagtatttaacagactatccataaaaaagcatttgtatgctgaagtgcgtgtaaaaatagttactaaaaatccattttgaagcatcatataaatctcttcaattaaattgcaaatcaaagaggaaaacaccctttatggtctcctttagagtaaggaccatgatttcatttccttgtgactctcagtaatgccaaacataatgcatgttcagtaaatagtcagaataacccacagacttccttacattatgtttaataatttgtgactcctagagaagttaagcagtgattcctcagagaaatcactgagctaatccaataaaaattcgagtatttcaggtctcttctgctgtttctacactagccaagtacaagtatatactctggcatttggacatatacttgtgcctctacagaaagcaccatattctccagagatctggcaagtaacagacttcatcttgccagtgtagaaatagcattagagcaagactaattgctggaaagcctgttcagaaagatttgtcattcaggatggtaaaaataatcctgcttttcagcgtacattcaaacttttttttatttccagtatttaatggagatcaaaacattaccatttccacaagtgaatgcgttttatgtaatgcagctatttcctttgatttgagttcaagcagaaaggctaaaatgaaaaaaaaaattctgtctagacgtatcatgtttgtttcttgtgtgagatgaaatttattaatcctgaaatgtggcttaaggacatatttatatgtgttataagtatcttattgaaaaacagaaatgccaagagggagagacctcttagatatacccttgaaaacatagtcaagtttaagcaggtcacattcagtggggggtccagagatttatattcagggaatctaccgagctatccttgactgcctccccactcaatttgctgtcctgtactagatatgttgtcttgttgactacaaaatcaccaccaaatatgtctgcttatagtagcagcagccaacaccttgcatgactttattaacctgattctgccagtgacaacatctctaataaaatccaatgtctctgattattttaacttttggctcaaggtttccacttttaaaagaatattacctactagattttcaatcataatccaaaatgtcttccattgtgcatggccaaattgccatagtcttatctaaacagttcagatcaagccaatttcttaactctcaacctttaatagtaatgtgaacatagctgttggatttctagcaccttgttcccttatctaccatctcataagcctgagaaagcatatctgtgatttgtaacacaagagagccaacataaccacagtaaataaaagagaaacatgttatgatgttaagccagtgcactgcttggcatgcattaagttcactgtagctgaaaaaataactgtgaggctctatatcccattaacactgtgttaattattgtcattgtctcatcaatgttttgtttatgacagctctggctgacaggaatagtgggatgttctgtcaaggccatcacctgatgagattttattggcaaaagatctttcttccctttactatgttaggggtatcagtgcttcattaactctaaacataatcgcttgcaataggcccagtttttaaatgtttcaaataattgatataatagtccctttccagcattatagttaaccaattcaccctctaaaaatgagagacatccctcaatctctctcaactcaaaagaccactcaatggcagtcaaatatgaaaggaaaatactgtctcactggggaagactttttaatacggataggatgttttattcctttatgtatgatacctgtgaataaagaaagcctccatagaggaggaaatctatctcaagaaaaaaataaaacacaataatttgtacacacacacacacacacacacacccgctattcagctatgatgaatcattgccctctcccttttaaatcttgctcaatgagagggctgtggggtactacagattcttgggcaggggctaataattaccattctctttttaattatttatttctatatatagaaatagattatatgagatagatctatttcatttcatatatgacactcaatccttattttttaaaagaaagaaggaagattgcatcattcttaccattaaactgtcttatcacagcttagctatttctgtaagtgaaaatatttcaagctaaatgaaagttccctgcaatttcaaattcacagaataattctaatttaatgataaagatgatactcctacccatatcaatgcctaattttaattccaggaacatagtttcttactaacattgcttttgcttttttttccttattgactgctaatacaattctttatgacactgggtgtgcgctctagtctacaatttaggaattgcatattttaaaaatgactcagtttcctcacttatgtcattagagtcaaatttgctactctgtttaacctgcaatactgttatgacaatatgaaatttatgagtatgacagtatgtaaaaatagctatcaaaatgtgaaaagttattatctatagcactgacctgaaccataagtaggtactataagagtgatcattaattttatgtgtcaatttggtaagggtatgatacccagtttggccacataccagtctagatgttgctgtgaagatgttttatagatatgattaacatgtaaatcagtagattttgaataaagcagataatcctccctaacataggcgggccttcatctaatcaggtgaaagccttaagaaaagagatcaaaggctccagactgtaacctgaaaattctgtctgagttcctagcctttggactatgcactgcaacatcaattcttagaggaatttctagccagctgtcttgccctgcagttttcggacatttcagctccacaatagcatgatccaattccttaaaataaaccttgccttctttctctctctgtgtatcattctcaaccccatctatctgtatatgtatatacatacatagatacacacacattctattggttctgcttctctggagaatactaatacagtgtttgttagaagaaattacatatatatacatacccctcccataaattgaacacagactctctcttttaatttaaaaaaaaaagcctgatattctggaacaggatgttctctctgtatcagaatcagtttctgctcctagacagcagtcaagttctgccagtagataccagcccctccttcctctagcttatacaggcatgagagtaattaatcctcatgcttattggagtttagtttggctttggcacagtatgctttccctagcaaaccataattgattctgaataattgatcagcaacgaacattcaattttctttatcttctcttcctctcattctcctatgatatatgttttctttggggaaccattttccattttaaaaaaaaccccaaatgcaaggccttttagtgatcaaatcaattcatgctgctttctgccaattcgcatcaactccaatgcaactcctgttggagaactcttagggaaccctaattagtgtcccattgtatccattagttttcaataaggaagtaaacttcttatgtaaaaacctcggaaactatttacatgtgactgctttgccatttatcaaccaccacactagcttgcttttttcaaaaatcctttgatgaggactgttattgaaaccactaaaccctacatgagtcatggaatctggctagacaaagacacctaaaatcagaacctgtgatactcatctaagctttgttaattcacctaaggatgatgtccctcacttttctcttatgtaaaagtaagattataatgataccccacttaaataattattataattccttaggcaccagaataaaacctcttagcaaaacagaagtaaaaagttctttgaggaaagtagtcttcaaaaagtcaaggcattttatcacatcaaagagaagtgggtcactttcaggccaaaggcatgcttagtgtaaggtgcaaaattaagcttacttatttagtgaggttggatatctactttcttctaataatcaaacatagatggatactagatgaaaagtaacagaatgtgagaaactgttggatgctgatattttgagatgaatcatacatatgtctcggatatccccatttaacctcctattcaatttagatgcaatgcccttttatttctttcaacctctgaaacaagaaatgttatcatgaccttttttttattgaatattatgctgttacatacacacctttccaactctcgtgggagtcaaatgcttagaagaacaaatctacaagtggactttctctcattgtccattctacccaacagcaaattagatgcacactcaactgcctaccctgctatacactgttccttaaaacaaattataactcagcatcccatttaatccagttgcatgaaattaacatttaccgagtagccactctgtgccagaatctaagcctaattatggaaatagagctgcagcctcgttttgaaacaaaacttcccaaggccatggtctctagtcactttctgcatcacctcatcttgcttctcactcaatccctcccttcagtcccctcctctataccagaagtgttcttttctgctctgcttgtcttactgggccttcaccactgtgtcttcttgaattgctcctcctgctcatgtctgggaacctacactctctgcttttccttgtctttcgttggctgctcttcttctacttccttagtcactcccacttctcacctcagccattaaacactaatgaaacccaagcttcagaccagtgctgtgtccccatcctctccctggttaatctctgggtaatctcatatagtgctactgctgaaagcatcacatagaacttgatcatttccagatttatatctaaaatttcaaactccaataggatactagattccaccatttagagctcatatttaatatatctaaattgaaattcttgatttccacatttcaaattattctgcctcaagtttctcaagactagaaattgtgtacagtgttgcatatgtggataactgagacataatctagtcaacagaagaatgggtaatattcttctacataaccttgtcagtatcattctcatgattttttaaaaaaataaattacagtaaagagtatcagctggggaatcacaagaacctgctttttaaatacagaatctaccatgttattagctttttaataagttacttaatcttatgacttctgaaataattcatgacaagctacttaatctctataaatgtcagttccctcaactgttaaatttggataataatagccattatgaaatcagcttgtagtaagaattaaatgagataggcttcttaaaggatataatcagattttatgcattcattttttcttttactcatttaagaaatctgtataatgaatctaacatgtttcattctaggtgttgaggatgcagaaacaatcaagacagacaaggttctagccacccttgagctataaccaagttggagaaaaaagtcagcatgcaagtaaacaataatcattcaagctatataggttgtgcctcatgaaacaaaaggactttgtatgtgagagagtaatggaaaccaggcacagcttttaagagatgatgtctagaatgggacctaaagaagaaggagctctccatgcaaaaatataagaaaagcccattctaagcgagagacatcaggaaggacaaaggaaccgaggcaggaaagagtttggtgtcttttaggaatagatgagaatccaatcttgggctaatgaagcaacacaagattcgcaacagcagggagttgctactatctttagcttgaaggagaaaaaggaggaggttgtattaccagagcccaggggtggagtgacccagcataacatagaatcttagttggtatattcaagagaagttggatccaaagaagagatacagccattattagagatgctgccccagagggagaaggagagataccttgaaaatttcccttaatccctccattcgttatatcaccaatgacttccagtgactgaaccaaatcagatgccagatgacacaatagcctagcaaatgcagtctaagaattcaatctccaacacacccagtagaaagagcaaagggtaagaaattgacttgagagcaagttggctcagaacagtagacccttaaattcattaagggtcaactactttaatactttgggaaaataatcccactatgcagggaaagaggatgaattttaaaatgtcatattttaggtatataaagaaaaatcctgcctgaccctgatataaagaaatgaagatattagaaaaaagtgttggctctacatgtccaggtactactgatcacgacagcacttacaggctctaaatggttaacttcctgaaaagtggctgttatatggaaaaccataaaacaatcattggtgatccttgtttctatttaaaaaaacatgctcttaggttcaagtagactgacccactttaggactatctatccctagggatcttgtaaaatgcagagaatgagaaaaacctttagaagatgctaaactctccgcttttaagctaactagcatgttgaacaatttatttgtacaatatgagatatgaccatattgcatctcatcttatggaattactcaagttatatacaattttctcaagtgctattgctagtctggatgtaggagtgaagagaataaattgagggcttgatctatgtttggggttttcagagaagacatagaaatgaaagaagaacagattggttgagaatataatcaagtgattatgggttctgtattgagcagataatttagtccaagaagatgcttatagttatgaaagaaaattcaggatcaagtacatgaggtctatagaaggtcaaacagtagttaagaaggagtgaagaagtgtgagagctaaaggatgtaaagtagaagtcagaaagtgagggcaatgaggcattctagtgcatgaatgtgacagggagcagctgaagagaatggaagtgatagttctagttcaacggttccaggaactgccatgttagggagttagaaagttgcccacatggatttgaaatttgtccttaatttattcatcaaatgtagttagtgctattatgtctattgttcaacgttgctgagtaacaaacaacctcaaaaatcctatcggcttccaataacattgtgtctcgtgcttatcagactgtggtttgactattttcagttgatctaggctggaccatgttgctccacggtgtgagactggagaactttgctccaggatttcagtcttttctatgtgtgtttattttagagggcaggctgatggagaagaagctacctgggtatgctcttcttattgagagtgacagtacaggaggcaaaagcctaaccacacaagcaaattaaaacctcaactcacttcatagctgctaaaatttcgttggccaaaacaattcatgttttattaaaataaactgaaaactgaaattaataagaggtttttcttttctaatgagttgtattataaaatcatacggcaaaatctttggttaagacagagtaaatatttcaaatgaagatgcaataagaatgaagacaaatgctgtaaatcatgtgcttcagtggactttgagactcttggcaagtgaatggaagtcaacagagatcagcaacaagagagatagaatagacagaactagggactaatgttcaaaaaaaaccatgatcctctccatgcccctacacagaagaccttagaagaataacagtctggatagggcataaggcagtgaaaaacagaaactaccctcccccaatcctcacaaaccataaatagcaggttgtgggggcatactgataattactagtcattagaagctaactgtggaacacacactgtaagaagacaaaacatattttatcaaacacagttatgaagaaaaaacatggtggctcctgacaaagtaggcacatccctctttcacggtttaatgatcaattactcagttgaagttttggtctctgaggatatcagagtaagtgtgattgattgggattttatagaacttgtcattaataaaccctaggtgttggaggcaggaaaaacgcccatagcctggttaattatcatggaagtacttcggatttttgtcttggagggagtaagaacagaataaggacatttctgaaatcaataagcaattgtttatgtgaccggtatggttctagcaatatggggaatacagaaggcttgtaagacaaagcaatcattttcacagggtaaaattaaccacaatattaatgctacctgattgtaggctgaactggaaaagtctgaataatttatatattgaggtgcaggcaaaatgccattggaggatacatttaacaaccttccaaatacatagaacaattgccatttctaagttatgttataatcctattcttctagctcactgattcttctaaatttcaaatatagtattttaaatttcatatttttggttctttacttgataatgaatccaagctttaaaaacaagctaaaaaatgagtaaatacagttggcccttgaacaacatgaggttgaactgcatgggtctacttgtacgtggattttttttcaacaaatatattgtaaaacttattgaagatttgggacaatttgaaaaaactcacagatgagccctataacctagaaatatggaaaaacatgaagaaaaagttagatatgtcatgagcgcataaaagatatgtagatgctagtttagtttatcatttactaccataaagtatacatacatttattattaaaagtgaaaatgtattgaaacatacacacacgaacacttgcaaacaatacatggcaccatttgcagctgagagaaatgtaaacaaacataaagatccagtagcaaatcggacttgcataaaattaactgtagtacataaggtactactgaaataattttgtcactatctcttattgccattgtggtgggctcaagtgttgtgagtatctgcttaaaactccacgtgatgctaatcatcccgagggagcagttcctttctctagtaaattccgtagcacagtaaaaagccatcattctcagtccttgtgtacttttcatcgtgtttagcgcaataccataaaccttgaataatatcatgagacccacatgaaatgctactaaggatgcttgatgtgttcctgagaagcagaaaaatgtcacgacattaaagaaaaagttgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgctgtggcgggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaaaaaaaaaaaaaaaaaaagttgaattgtttgatatgtaccgtagattgaagtctgcagttgtgtttgtccccatttcagacaaaaacgattcatcttataaacagacaagtactgtaaatgtattttctcctccttatgattttcttaataacactatcttttctctagcttaccttgttgtaagaaaacagtgtagtagtacacacaacatacaaaatatgtgtaaatcaactgtttatgttatcagtaaggcttctacttaacaacaggctattaacagttaaatttgggagggattcaaaagttaaagatagatttttgactgtgtaggaagttggtatccctaactcttgcaatgttgaagggtcaactataagccaaaacactctgataccacaactaacaaaatctgtattcacactcaaatgtctcaggtattcttccatcaatttttctgaccttttaattacactaaatatatatatatacacatatatatacatatacatgcacacatgtatatatatactctttttataatcttccttcagataagcttaacacattttaaaattttaatatagttgtatatttttataaagtctggttctgtgtaactttctattcatttttctccaaattcatctcatgtgtatattcattctatttctaaaccttttgctattcctatctctaagacatttttattcagcaagacacatctaaaatagattttatctgcattcacttatataaccaaacgtatttatatttccaagcacatttctttcaagaattatttaacatttatccattgttaatatgttttcaaatgtcaaatcttgtatatgacaaaaggtatgactgaataaatctggctacataaaaacgttaaaatgactgtaacactaaaagtacacatatatgtgcacatacgtatcccacaaataaaattaaaagaaatttgacaaaatgagtaaatagttaccacatctgagctacataaatatctttaagataaaaagagctctgaggaatcaatgatattttaaaaattgtatcaaatcaaaatgataaaagataagactagataacccacagaaaaatgaaaatgtgttgaatttctattgaaatataaatatatacaattttattaaagtgaatgcctctacagatggtcccaacctatgctcgtttgacttaaaatgattgttttgactttacaatggtgtgaaggtgatacacattcaatagaaaccttacttgaagtcttgaattttgctcttctcccgggttagtgatatgcaatacccctgagatgctgcgcagtggcaggtttctgcagctcccagtcagccacaccatcgggagggtaaacaaccagtactgtagtctacagtgtatggtattcaatatattgcatgagatattcaacaccgttataaaataagctttgtgttcgatgattttcccaactgttaatgtaagtgttctgagtgcgtctaagttaggctagactaacctataatgtttggtcagttcgatgtattaagtgcactgtttatttatttgacattttgttgtagttttcaagttacaatggatttgtcaggacgtaaacccattgtaagtcaaggagcatttgtatcttctaatggccaaaatatttttctttaataagttggtaatggcccagatacgggagtaaagaactataaattaatataaaatctctggagaatgtctgacaacaaacatcaaaatatttaaagtgtattatttaacaagtcttatggtaatcagagttctgggttcaaattgttggtctaccacttggttgctatgtaatctcagtaatttattttactccatgagttttagcttaaattcctgcataataggatcataacaaccatctttcaaggtggctgtaagataaacagtataatacacacatcttaacacattttctgacaatgataactgttcttcagacaaaaacttctatcctaatagtttctcatctttctcccctacctctttcttttttttctggaaataattatagatacaaagaaagctctgtatacaaagatgttaaccaaagtatcatctctaacagtaaaatataggggcattggtttaatacattatgtcatattaatatagtagaataatatgtgaccatttaaaccatgttatagaaaaattaatgagattgtttagtaaaatgcttaagtgatattgatataccagaaaatcaagttgtataagtaataagtgttttattatcacaattttgtttacttgtgtggttatgcccttataaagggcaggtatttctgtgtatgggtcatgcatgagcatgatatgatgtatatgcatgtgtgattgtgtatgtgtatgcataggcacagagaaagaccagaagtctataaacattcacctattcagaaaaaatttgctgaattgctgctataaagcagataccatactaacttctggtgataaaaagtaagagaagacaaacacaaatttgtacagcaaacaatatattgggaagctagatgttgttagaataatctctaaaatagatttcaaattctgattgggataatgctacaaagggacaatgtgatgtggaagaatgtaacaggcacattgacttttgaaagcaggtcagaattccctgctcaagacccagttgaactgaaatctgcaaaaagtgcaagacatacatagcaaaaaggggaggaaagagagcccggggaaaggagcaaaggaatttggtgtggctttaatagatgagcctgaggctcagggagtctggaaaggcaggtgacagatcaaaccaggtttaaaatacactgttaaggagagttgaggaggtgatcgtataagaaaaatgatcagagatctgttaggaaaacatcactttaactatagactgagggagagcaaaagtcagcgaggaaggccaggcacggtggctcacgcctgtaatcccagaactttgagaagctgagggaagtggatcacctgaggtcaggagttcgagaccagcctggccaacacagcaaaaccccatctctactaaaagtacaaaaattagaaggcgtgatggtgcgtgcctgtaatcccagctactcaggaggctgagacaggagaatcgcttgaacccaggaggcagaggttgcagtgaactgagatcatgccattgcactgcagcccaggtgacagagcaagactccagctcaaaaaaaaaaaaaagtcagtgagatgaggagtaccgtgaagtcatttgagtaattcaagtgagagatgacagcagcctggactaggatggagtgaaatggaatgaagtgatggatttaggagctacttacagggcaaaactaaagtgatatagcaatggattggatatggagagtgcaacatggagaaaataataatatcaaccacacaaggacatgagaatgaaaaaaacaatacgccatttcagcatcccagatggggccaggcacagaaacagactgatgttgagtgagaagcagctgatgaagatgacatagaacttttacttgcataacaaaatggatagcattgccattcatggagatgggagatagggaacactattaattttgagggggacagtcataaattcagttttacatgtaaaaatttaaattattttcaaaatattcaagaggagatgccaatgtggtagttgggaaaatgagcctggatctcagaggagaggtctgggttgtatataaaagttacgaggttacatatgtggtcaataaagctaaaggtgaaagggcctagtaacaagtcttgaggtattccaggtaaaggagaagaagcctgaagcgggatagagtaggagatataatgtcacagaaaccaagggaaaaagggggtttcaggtatctaactgtaatacatcttgctaagaactcatttaagatgcagataacagaaatctccctgaagaaagagagatggaagtcattggcacccagggcaagagtgatgaatgtgtagacagtattggatcagacttgagctgtgaaaatagaaaatatgaaaaacatcttcagtattttggctataaagaggaggaacaacaaaggatattcaccagaaagacatgtgcaaggcaaattagtatagaatttgcttcttaatgggagagatttgagcacattaagagtagagatttgctcttggaagttaaaggctaaatccacactaagtccttttattcaatatttatgcggttttaacaaattgttgtacattttttaagtttacaagttgtgatattatacagataattcaagaaaagaaatattaaatagattacagcaaaagatgtaaagtttcaaaatatatcaataaaaatataaagtagatgaattagagggatctatataccctttacaaatgtctggagcttagaaggtgaacaatcagtgtgagagactgggatagaacaagttcgagataagtgagtataaagaatctagagggggtcaggaaaatttaccctccaaaagtaaaacagagcaggctctgggaagattttaaaacttgctcgagcaactaaaaatgagagttgaaaagactcctgtgatagtaagaaggttatttcaatattatatgacatacaaattgttttggagatggcatagtgtggtacagctgcagaacagcccttccctagaagccaggcaccgggtttggttttgtctgtgtcaataataaaaggcagtagcttggagaagtcatttaattaatcagagctttagtttcttaacctgtgtatttaaagagtttccctacattttctgtaagtttcttacaacattaaaattctttgtctctgtaactaacagaataggtatgctgtaagaaaaaaatatatacattgaggtaaacttaagtgtctctagagcataacattatcaaactttttttgtaggtcctgtgtaagtgagaataaaagctccacacagtccttgacttcattctaaataggttgacacgggtgtgaaatgacattctccagtcttagggatgtgtgaagggcacttaacatttctgacaagctgagtcatttgacattattccctgtgtaacttatccattaaaattttatctgttgtgaacataatttttaacaactacataaaatttaaatactctgaagaaagcacctagtcatttcaagactttctgatgtgatctatgttgaaacaaacaaacaaaaaataaaaaaaaaccctcctatagagtctcaccagagtacaggtttaaaagttaaaatatgtatttctaaaagtaaatacattatataagcatatgaaataatgaatatataatacatattatataaagtgattacatataaatatatttctattcctttttggaatttgactattttctggtgaatattaagattagcttagttttatgtatcaaattaatgattaacattgagtcaaatgacattcatatatatacatatttttaaattttagtattattatactttaaaagctttagtgtacatgtgcacaacgtgcaggtttgttacatatgtatacatgtgccatgttggtgtgctgcacccattaactcgtcatttagcattaggtatatctcctaatgctatccctccccactccccccaccccacaacaggccccagtgtgtgatgttccccttcctgtgtccatgtgttctcattgttcaattcccacctatgagtgagaacatgcggtgtttggttttttgttcttgcgatagtttgctgagaatgatggtttccagcttcatccatgtccctacaaaggacatgaactcatccttttttatggctgcatagtattccatggtgtatatgtgccacattttcttaatccagtctatcattattggacatttgggttggttccaagtctttgctatggtgaatggtgctgcaataaacctacatgtgcatgtgtctttatagcagcatgatttataatcctttgggtatatacccagtaatgggatggctgggtcaaatgatatttctagttctagatccctgaggaatcgccacactgacttccacaatggttgaactagtttacagtcccacctacagtgtaaaagtgttcctatttctccacatcctctccagcacctgttgtttcctgactttttaatgattgtcattctaactggtgtgagatggtatctcattgtggttttgatttgcatttctctgatggccagtgatgatgagcattttttcatgtgttttttggctgcataaatgtcttcttttgagaagtgtctgttcatatacttcgcccactttttgatggggttgtttgtttttttcttgtaaatttgtttgagttcattgtagattctggatattagccctttgtcagatgagtaggtggcaaacattttctcccattctgtaggttgcatatatttttatatagggtttagcttttgatgtcaatatatttaagaaaaatttctatgtttttttcagttatgtttcatagaatcaggataacttctgaaattttggaaggtaagaggatgtccctcccactcttactcattgctaagaactttgtaaaatgtatgctgtttaaaaacatatatacccttcaaattgatttatattatgggttatgaccaaaatcttacctttggcctcaagtcctggtacggtttggctgcatccccacccaaatctcatcttgaattgtagctcccataattcccacgtggtgtgggagggacccagtgggaggtaattgaatcatgggggtggtttcccccatactgttctcatggtagtaaataagtctcacgagatctgattgttttttaaggggaaacacctttcacttggctctcattctttcttgtgtgctgccacgtaaggccttcccagccccgtggaactgtgagtccattaaacctctttttctttataaattaccaagtctcgggtatgtctttatcagcagtgtgaaaacggactaatacaagtccctttttactgggtttaaattagttagtttctacatgcacaggtaattttactcaacgctccctttgtctggcaatccattcgaaaactttttcgaattgtaaccattgccttcaatgaacaagattgtcgtctgctccccaggcatcactgaccgggcaatttcttccttagtgtaagcaatccaacaatgaaatattctcacagttactgtacatgttcttgattataaagatacacatatttaatggaaagaactaggaccataggaacagatttggtattttattgtttctaataaattaacttgtgaccttcagaacgacacttaagttctctgcaccctgctggtttccataatgattaggtgttttccaagattacatttcctctaaagttttaggcttctacatttttaaatatattataattatgattaatttcacaatttcaaagatttagtgtaaacttgttctgagattgttatatgcagatgctgtattagaacaaaataaaaactgtgaaataactagcaactttaatgttcacatataagacttcaagaaatataacaaaaagtggagttatcctggctcagtgaactaagctataaaatttttgaatggtaagagctgttagaattatgaggtatccactaattcagaatattaaatttgagatatactttatgaataattttcttttttatctcaactgggaaaaattattcttgaacctcaacagagaagtttgataaatgacatttaaaatgattaaaaatcattcacccaatttaagaaactccctaaataataatctgcagctcaattttggttaagtttttgcatggacatgtgaaaattggaaagtaaaataaattgcttctggtgattttttacttttttttttaacttgtacagtatacatttatttaactatgactgctagtaaataattaaatataaacctctgtaaagctttctgctgtaatattttggatgagaaggatagtttaaacagcaaggtcttcaggatatttgagggtttataccttgcagtaaaaaaggagagaaaataaaacaaaaaacttttacctagtttggatggaaaccttctagaattcattatacactaatttgcttctttcaaaaaatgtcagagttataaacataagtaaacttgagtttgctgatgcctggtcatcatttgcttattaataaatgcagctttctgtatctcactggtgtttgtaggactctgtacatctctatattgctgcattacacagcctctgattataatgcttctagagttagagtttttaaaaatatatattttatatataaatttatatttttatattttatattttataaatataaatataaaaaattttatatttataaatgtatatattatatatgtacatatattttatatatgtgtgtatatattatatatgtatatatattttatatatgtgtgtatatatacatatatgtatgtatatatgtatgtatatatgtatatatatacacacacatatattcacatatatatgtgtgtgtgtatatatatatatatatatatacacacacacatatattcatgtgagtatacatatttcctttatggcagagtgtaaaatagcaattccttctaattataataatacagcatacaatacaaagtgaaccatagtgtctcctacaaagtaactatcctacaaatgttagctgtcattagtactattaaatagctattgaaaccctgatggtttgtatcagtccatttatttctttttaacaggctatcattctgatgcaaacataaataacaaacaatcttggactatgttgaaaaatgggttaggcttgcagtcaaaacatctaggtttaatcctggatatgttgcttcatagctaggttaatttcattagcattgttacccttaagcttgttgtcttagattttaaaagcaggacaataatggttatcttgcagattcgttatgagtagcagtttaaaaatagatgtgacaaaaaggtgagaaattcattatcacaaaactgtcacacagaaggcattcagtaagggttaactgaatctgaaatcaggaaataaggttgcttctaaaatataaacatttataaacattcacaatattccaggccataggttctgcatagcacattagggagacaagactcactattaagaaacctgtcattgaatatgattattgtgattgagagagcagagaaaggagaataatagaatccttactctgggacagcggaatgtttgtcctattaaaaaaattctttacacaattataatttattttattcaaaaaataaattcactgtaattacgtatgaagaaaataaacctctgcaaaattatctatactatgggaaaaagaaaaggagtgagaaagtaattgagtgaattcaactgttaatatgatatataacacatttttaaatttagagtagaaactataaataaagctatgctgtaatcaaaattgtactaggaaatacacatgtaaagatacttctgaatatttctttgtccaattctcagtcaactgtaaaactgctgagttttggagatataaactttgcaaaactcagatcattactccttttgggcttttagttacaattaaggaaattatgattatctatttgtttatatttgctgtgtggcaaaagacaatatgaaaaatgttacttagtgagggtttggtgatcgttaccagcttccacattatccttaaagttgtgttgaaatgattgaagataaatgcacttaatttgaaaaaaaaaaaaatgttggactggaactgatagtgttccaggaaagttgaaagaaatcatgagcaggaaacagtgaacaatcttacgagacatagagacatacaggctctcagttagctctgaatggcctttacaatcaagatataaactatgtgacaaatgagtgtaaaataccaaagcactggcttgtttcatgaagataagaacagtctcaaagtccttgtgttccatatggtccatggatttccaaagaggaatatgcttgaacagatcaaaaagcaaaatagacattgtgtctggctggtatttgggacatggaagagcgacatctaatttcttaaataatgtcaacttatactgctgtgcttttattggacagatatgtgtgaggctttgaatacatccaaactgaaacttcaagaacaaacatcaatattattgattattttaactttttttagaagttctaactaaaatgcagccctgggcatagaaaactggtgtttaaaagaaatagtcttattctaaacaatatatatacattgtttatattttatataaacaaaattttttgtttatatatgtattctgtttatattttgtattataatacatttactctgtattaaagatgaattcaagtggtaatattttcattgtgatatggctcaaaaatatgtttacattttgtgaagttctcttgtctcattgatccttaggctcctaaagctaatctgcaagagggttttcagatttcaattttaattcatttgccaatataactgctagaaaatcacatttagagtaagttttggtaaaatatctaccttattacaaactgagcagatttgggtggggagcagtatctatcctatttatattaataaatatatttcagaatctattttttctctgtacttctgaagtgaaaaataaatcatcagagtagacttaaaagtgaaagtggctgctattgtcctaaatctatcccatttgtgatatgaactcagaagcttcagtttctttggaaattattatagacacggactactgcatgaagtttcatttaccttaaacttctaattgaagtttcacctatatgtggctgagatgctgattcagttcaattcaaatattaactaactaaatccttatctggctgatgagaaagaaagagtagcccacatgaagcaggagaatagggtctggaggcagggaagctaaggtcaattcatgctgacgtcctagaactggatcaaaaggaaaaccccacctctccatgcccaagtgacaaaggatcaaatgctactccttccacaacccccacccccttccactgcgtcacagatggaaaatggaaagtacctctgattggacgtgggccaagcgtgggccaatccttcatttgcataaggtgccaatccatttcagcctctgattggccagagtcaaacctccacttccatcctttattacatagcgtataagcaatgggaaatctttaaagggtacttaaaccccagaatattttgtaaccagggctcctgagctgcttgcttgagcccgctccaattctgtagagggtattttcaccttaataaatctatgtttctgttgccttttgtgtcaataaatctatgcttttgttgcttgttcatgcatgctgttcaaatccttgttcaatacatcaagagcctagatgactcacgatcagaaccctttatctagtaacactttacaaacatatatgctcattttaatttttaaaataactttttgaataaaataatgtatgtttataaagtgcatagtaaactgtaaactaatatgtaataaatgagttattgttgtcatccttatctttttctaatcaaagtagataatatctattctaaaacaagttattcaaatgtcttttgccctttgtcttattcaaatgtcaattgcctctagaagttttgattttaagaaaaggaaatgttttgcctttcaatctttatcaatggaaaacatttcactcagtctcaaaatgcaatttccacagatattttattgggtagagtacttttaaaaagctctaaaataagaaagtgatgataatggaaagcaatatttagtatcaactttgaataggcacaaagagcactgatgtaattagagatacttagacatgtagctaaagaaaatatacctctgggagaaaatgtaactgctgttactattttcaaacaaatatggggctcagaagtatctatttaagtgccaatattaaatatctcaccatgtttccattataaacccttcttttaggagtttataactgggccataaaaattcacttcaggcactccttagtatccaaaaaagctattacagccttctgggaaaataataagcatatttatagaaggtatatataaaaatattgatatgtttacctatttttaaaaatgcacttgtgacaactaatctcctttatcaatttgctgaatcatattaccttcttcagttccattaacctaaaaggaaaaatacaattaaatttagtctcctttcaattgtttctaaatatgattaatctggtgtcaacaaagtatcgctgtacttcagaatttgcctgctggcctctaaaaagccaaggaaggggtaataacttttaatggagtaaatacttgtttatttttctgaagttaacttttttgttgttattgttgagatttttctgttgcaaacattgtgtacagtcaaaaactctgcgaataaagaaacagagacacttataaatacatgtgtactttttgattatttctttagaatcagaaagacttaaacccatgtacattttattttggcagaagatcatgtaatttttccacaattactcacataccgcagcagaggacacaaaatcattccaggctttattaatttcaaatacccaaaactgtcttgagaagaaaatacctttatattattttatttgatagtgaagtcttaaagttctatttctctcataggttttttgtttgttttagcagttagctaaaaagtttcccaattaaaacattttagtacttaatcctatggttgtcatgcatgagactggttcattaacaaggtggaaggtagaatagtgaatagatttttcacaatataatgagcatgataataataatagtagtagtaataagaaataacaacaatacaaagaatactaacagcaaacattctttttgagtactttccacctcactggtatgcggttaagttctttacatacattattccccaattaaatctacgagatcagcgcctgttttgctagggaaactaggctgtaaggaatgaaatcactaacgcaatattatatagctaactattggcagtgctgggactcaaattacattctgaagatgaagcctgtgtttaataatcaagttctaccactctttctactttagaagaaaatcagtatgatttggttaaattagatgctctaacaagaaggaaatagctgacccaaattatagatggaaaactatacggtaagatagctggattgctagacaatagtcagcataatatcactattattaaaaattcataaatatttttgccatcctaggaactagtctttaaacttactacataccttgctattcaattgcaaaatgtaagatttaaaaaatggctcttctttaaaataaatgtcaaaaagaatggtgttatttatctttgaagttagcaatattaattacttgaaaattagtaaaattgtctgacgtttaagaggttttaaacggtctcctaactattatacttttagattttacaaaatgagtgttcaaatatcatctggtttataattaatacataaaagccagtgaatctaagtgcacgtacatttttatttaactgtgtaattactgattagtagttcataaaattggttttgatatattttgagagcctttacaataactttgcaacttttaactcatgcaaaagtgattcagtataaagttggactaaaattcagaacagaacttcttttacgaagttaacagagataattgatatttcactcaatgatgactgcattaaaatcattgacacacatttaacattcataactgctctaacccttgaatttggtatatggcaatatattgaatctaaaactcttaattgctttctcatcaatctatttctcccctggtcttttcctctttgtaaatggtaactctattcttgtagttgctcaggcccaaatctttatcatttagttgtcttctacatgtcatttaaatcaaccagtaaaactcattaatgtcaacttcaaaatatatccagaatgcagccatatttcatcactttcaacaccatcaccttagttcaaccagtattactccctacctggtcttgggcaataggttcctaactggtttcaccatttaaatccttactctctacgtcttccatgcaaaaaccaggattggtcactgttcatctagccaaatcctaccattcagtaaaaccaaatcatcatcactatctctggggtcatgtgtggcctgaacctctgctctttttctgtcctcattctccctgcccagttttgtttgtttatttatttgtttcaatcactcagctcttgctacattggtctttccttgagtacacctaatgtggatctgtccttgatgcttcgtgactattttcctccctgttcaaaatattcttcctccagatttccacctgtcccattttcttcatcttttttttttaagtctgtgctcaaataccatttagcaaaaagccttctctgaccaccctatataaaagagttaggtctatcactctctggaagcttttttatattaataataaccatcccttatattctaggcattctgctaaatgtattatatctgctatttcataatcttcaagacactactgagaggtaggttttattatttctcttaaataactgaataaaatttaaataaaacactaaaggtatggttaagcttcaaaccgggtctccggattcctcagtccttgttctccatgaactgcataatcccatttatgcttcaaaactctcccaatttaacaaatagggaatgtgaggctcaagggtttgaaataattgcccagatcacacagcaagtaagtagtagaacaggaattcaaatgtaggttgatcaaatctgatgtttactcccctgcaccacactgccttcctgtggacaaggtcatatccttattgccaattgccagccaaagatagataagatgagttcactctccattcttctgggctttatttttgcttacttactcaagtctcacataaatacatattcatcttagatctataacttggttgatgtagaaatataagaaaagtgcacatatgatatagaacattaacaatattgacattatcccagaaattatataattaagaattgaaatttatatgattttcattgatttttttcttcttttatttgctaatattctatcctctcaacaacatactgctaaactttgctttgttcaatgtccatgcttgatcattgaattaaaatccctctaaaataataagtaggacatatctcaaatatatgtatccataatataaaacatattcatttagaatctttgcaatgtaccattatactaaggccataataaaaattctcacttgtctgtatacttggtgaaagaataagatcaactgaaccatatagttgctttatatagaaatcagcctgtacatatctaattgaatttactaattgtcacaggtgaaaaaaaatgccattttcatactgaaatcaaatataatcctgacataaaggtcataaatttaaaaatttatgcaaagatacctcaagctactactggaacacctatatccaacatacagaaagaatcaatacaagcattaatctgatagtcagtattagacataaagtgactgaaatagagcttgattacaagagcaatgtctcctgctttgagaataaacatttcagttttgtctcagcatttatgtaacagcaggagagagaagacaagttatcttgtgacaacatcctgcagtatgtcattgacattatcttataattagacttgcattaaagatgattaatagtatcttctttggtgcctaatcagtgcagtctcatagcatatacaaaaatgagtattttagatcactttaagtcagtattacagcagtaaaatcgttatgttccttttccctcaaagccatctcaaacaaaataacaatattttcattcaatttttgttggtaacagtttgaaagaaaatgccacaagtatttagagtgttgaaattcaaattttatctaattaacctgaaactcctgtattttttgaatccagatttaaaccactattgtggctaccgctaatagctatatatgaattaacagaaaatgaaagatttacttctaagagaaacataacacaagctagtttcatgtgtagtcaattcaaagttttatgaattattggactcagattacctacaggcctggaagacagtggctctgtctactattggagatgctggctcattgcactgaaaatttgctatttatgtataaaggataagattggacttagaaatctgtaaattaagctaagtgatttaaagccatgcagcgtacatgtgagacacaagaatcaaacccttaagctttatttgtgaggaagtagcattcatgtgtgcttagcctaccaagggggatcagcaaatgtttgctgaatggatgcatgaatggatggagtggcttcatagcacaataaagtcatgtaccacaatagttagggggtacagctggaaataacaagtctttataaagtgaccagactaaaacagctttaatgctgtcccactgctacctatttgcctactgggatctgagtgatttgttgagaatgaagtatcctaggcaaccatgctaaaattatgagttcagaaaaggcgaactatttaacaggctagacatactgatggaagctattgtggggccttcaatttaaaatttgttgaatttgtgtacttagttccactgactctgtattattaagaaattccactatgggccaagcgtggcagctcatgcctgtaatccaagcactttgggaggccaaggcaggtggatcacttgaggtcaggggtttgagaccagcctggccaacatgaggaaaccccatctctactaaaaaaaaaatacaaacattagccaggcacggtggagtgtgcctgtaatcccagctacttaagaggctgaggcatgaaaatcacctgaacccaggagacggaggttacagtgagccaagatagtgtcactgcactccagcctgggtgacagagtgaaacactctcaaaaaatacaagggggaacacacactggggcctgtcagggagtggggggtgggagagcatcaggataaatagctaatgcatatggggcttaatacctaggtaataggttgataggagcagcaaaccaccatggcacatgtttacgtatgtaacaaacctgtacgtcctgaacaggggcaaaatgccaccagtcattttgctaaaatgcaacaagagtcacctatgcttcacttcccaacaagttcttcatctccatcagcctcagcctcaatttcattgcccatatcactatcagcagtttggtcaaagccattcaacaagtctctagggagttccaaattgtctcacattttcctgtcttcttctgagccctccaaaccgttccaacctctgcccagttacccagttccaaagttgcttccacatttttgggtatcttttcagcagtgacccactctactggtactaatttactgtattagtccattttcacgctgctgatagagacatatctgagacagggtgatttacaaaagaaagagttttctttacagttccacatggctggggaggactcacaatcatggcagaaggtgaaaggcacatctcacatggtggcagacaagagaagagagcttgtgcggggaaattcccgtttttaaaaccatcagatcttgtgagacttattcactatcatgagaacagcacaggaaagaactgcccccatgattcagttacctcccaccaggtctctcccacaacatgtgggaattcaaggtgagatttgggtggggacacaaccataccacaatgttttagaatacatttggccctataaaactgtagattcaagtctacaataatttctcaaaagttttcttaaattatatctttctctatgttttaaattttcctgtttatacagtttgtttctaccagcacatcaattttctattgatggttcatttatttttcaatattttcaatattgaaaattttattgaatattcaataaaaaatattctgattctggcaatcagaaataataggcaattatttaatgcctattgtatgctagacagtgttctatactttgtttcataactttttctgtgatatatatatataattttctttacaatcatcttccaatattctttcattttgactcattttgcttactttatcagttctgttctctgagccccttattactctcatcagtgactttttactgcttctattttgactttcacttctgtaactgctttatatttacctttaacatcttccttagtctctcctggtttgggttttatctttgtgtcactatacattctgaggtattgaaatactgatttgttgttttgcatcgaggttgtttgggggtatgaggaagtgagaggttcataaaataaaacagtgtgatttccttctgctcataccaatatttttcttgttgcttttctcagcctgctccttcctccctttctttttctctttttgttttcccacattattgtatagagcctatacttgttcattttcttcattattgctcttaaatgaagtgagtacaacaaaaattgggactgttaagtgcagagtatcagaggtttcctctaattaatgggaagtttcttaggattaaaaataggtgcacatgtgattgtgtaagtgtgtatgtttttgcattacattgtatacccctctccctttaattttgccactcactgattcagctaatggcaagatctgagaacaaaaaaacccatgctcattcagatgctaggaaaacaggctgaaaagagcagagaacattccccaagcccctattttactaaggactctttgtaatataaaaaatataaattttttatctgaacaaatgaccattttatatttctatataaaagttggtggtttaataatacaggactagaataatgtagatttttaattttcatagaaattaaactctgtagccaaaggccctcagagattactaaacacagaaggcatattgaaaacagaagattctattttgacagaaggattagacatatttttgttactgagaaaatactatttattttcatagactgaatgtttgagtccccccaaaatgttaaaatcctaatctcccgtgtgatggtgttaggaaatgtggcctttaggagataattaggtcttgaggatggagccctcatgatgggattagtggtgccataagaagagaggagataacttgctctctctttctctttttttctaccttgtgaggatacaaggagaagatgtacatctgtgaattagaaaaagggtcctcaccagaaccaaatgtgcagacatcatgatcttggacttccaagcctccagaactgtgagtaataaatgtttgttgtttaagccactcaacctatggaaatttaatacagcactctgagctaagacattcatgatcacttttaggtgcctttagttctggtagtcacatggaagatatatctgaagagtctgatctcctcttcactctgcgccctttccactttatagtggatgcacatgaaaatgtattttgggggccaggcacggtggttcatgcctgtaatcccagcactttgagaggccaaggtgggcagatcacgaggtcaggagttcaagaccagcctggccaacatggcaaaaccctgtctctactaaaaatacaaaaattagctgggcatggtggtgtgtgcctgtaatcccagctactcggaagcctgaggcaggagaattgcttgaaccaggacccggaaggcggaggttgtagtgagctgagatcaggccactggactccagcctgggctacagagtgagactctgtccccccccccaaaaaaaaggcaaaatgtatttcggggaaattcctgcaagcatactagtcttagcaagtattggtgtggcttcacttgggaaatgattgctttttactgattgtttgctctttctagactttttagttacattctttcacaggaaatatgtttgacttgttgttattaaagtacatagtgtttctctgtggcccgttttgggtcctagcaagtggctgatggcttccttgcactttcacacactcgtggcaacattcaaaagaaaatgaagtcagacttggaccaagatatacgcctttagatgatgctatgagatggtcttttaaaaatatttcatcaaagttctttgtcttgaaagactaacaatgcttgttagattgttaatttttgagatccatgtgacttatatctatattttcatatcattaaaatatttcactggctgttgagatataagtcacaatctgccaatttgtcattcttttcaatgacatctggatccaaaatcatgattggttaacatgtgaagttggtccattaattttatccaggaaaaagttattggaagctacatacatagttttaagatttaaaatttcaaatttctatgactaataaactacagaatccctcatgccacatctctaacacattgattccgtaaatgtttcttaaattatgttcagtgctaagatgccaataaagtttcattttagatgaatacaatataaattgatttattagttgaatatttgttgtatatttgggccaactgtccaagtgaatttattcagatatccacattttatatataactactttcacatttctgagtaatttcattggcacatttttatgtgttacagaagtactttatgatttggtgaaaataatatttactttgattttcatatcgtaccatagctatctaagaatctacctttattatctaattataaccatcctgccaacaattctacctctagatttgttctattctgcatagacatatctacctagaagagcctacctcagagaggaatttccctctgaagtatcattttcctgtggcctgttttcttgccttcttgttttgatctttcaggcgatgtgactttcctggctatagttgctctcctgagtctctgacctcccaacataaaaaggcctcttctcccttgtgttgcctccgggttttctctttcattgttatgtgtgtaagccttccttctgcatgactgattgactttcttccctgatctcctgttttggaagctggatcatcatgaccacttacctgaccgctgaaccatcagccattctgcagtgtaacttttaacaccttttagggttccttaaacctcacatttttatctactgagactgtgatataactttaagcagtaatattaaaacttgtaatattcatttacaacagacattttttctgcttttttaagtgaaaagttgaatattagcaatttaattggatcaacctaatattaagtgtaaacataaactgtgctgctgaaaatgttcagaaattcaaactcctctacttcaaagctctgacaccatgtcacgaaccaaagaaacaatttagtagctcttacataatagactaagtatcatcaaacaacactgtttactttctaaaggcaatactctaggtgccttaatgaataaattttatctataaaaagtacttttaaaattatattttattgtggtaagtcattaaggagcaaattttctgacaatattttaactagttttgcacttaatccaataatcaaattaagttttatctatgttattatagaactgatacattcttgagaaagatgtatatattgattcatatgagatttttcataaaaaatatattaaagaaaaatagcccctcatatgcaataatgggaaagccacatggatttatattgtagctatggtataagagatcatgtccttattataatcttcacatctatgtttacatatgttatttataaatgtacattttgcaatgtcttgacatttgttagctgtgaaagactatgccaggtatgtttcaggggaaaatgaaagtgcttgcccagaaatataaaaacaatgttgtctcgtctcctaatatttacatttttatttctgttgataaaatagacttcagtgtaacagcatctatacagaataaattcctgatttacaaaatcttctgcaaacaattattggtttctcactgcaaagtatagaagttgctactgtcaaatcagaaatatttccctttgtaactgtctgtacttgctgttgccctatcatcgctataaagggattttttaccttgagtaagaattgagcaatttgcaaaacaggcaaaaatgaggagtagacataacccttctaagagctatgtactcaagccccatcatcactccctccgtgcaaaacaataggctgtaaacaccatccatgtctgtagcacttttccacatgtctttattctttcaggatatactcctaaattaattccagctcaaactacttttagctcttcactctgtttctcatttattatcctacttctacttcctcagatttagttctcccctctctaaatagtgactgtcagttagtcttcatggcctctggcttgaattgtatccacaaggttttctggcttgcaactactttttaaaatttatagacaggaattgatctctaagagtggatccatcaaccataatcccaaaaggagaacaatttgagatgtggtttccatgttggccttcatcctgtgccttagtttagatttctttagctttatttcagtttttattttatctcctctatttccctcatttcatgcttctctctctttcccttgtctttctttccgctatttaaatgctccagaacctttttattttaatgtcaagtaacacgctccaaaggtatcacctgggaggaatgaggaaatatgaaggcctagaaacctagggaagaaaatcaaatgcaatgaatggaaggaattgtaataaacacacatggtaagagcatggtggagtggatgctttggtgatattcccagatcccctcccttaaagactaaagtattcattcttcccagctgctgtaaatgctgacaacagacaacagctgggcaaggggagcctccttgtctgaggtcacacactctccctgggagcacgtcgtatctattgactggctagcaggaagataaaagacttggttcctttgcttcagggattactgtcaagagtcattccaattctagagctccccatgagattagctgatgcctttttttgagacttcattgcagttcaactcttctcaatccaatttcctccactgctttgcaggtattgatctcaacaaaattcttgcatgcaaatttccatatcagaatcttttatctaataaacttgaccagaaataataggctttgggggtcagagagatctgggtttgaattcaactgcacttttacttgctagctgtgttactttggggtttattttctctataggcaaaaatgggtaataagaaagcggaagtattctacggtggtgacatccttgaagttgtacaacataattccctgaaaaaaaccactacataagtgaaagattaaatcatatatttaaagcagttactgttttgcagagtagacacttaatacattttttgttccccccttttaactttggacagattgaggaaaacaagaaggaaaccaagcaaaatagtcaattaaggatctaattaagggtagagtattccttatctaaaacgtttgggactggaagtgttttggatttcacatttttttctgcctttgtaatatttgcatatatacaatgagatatcttggggatgggacccaagtctaaacatgaaatgaatttatgtcttatatacaccttacactcatagcccaaagataattttataaaatattttaatgattttgtgcatgcaacaaagtcttgactgtatttttactatgacttgtcacatgaggttaggtgtgaaaatttccacttgtggagttacatcagtgctcagaaaattttggattttggaacatttagcacttcagagtttaagattagtgatggtcaatctctttcatttttggagtataagatagttatcttagaatcaaagagatttttcagttactttaatgggatgaagacaaattaagatggacaagcaaactgtttgccactgctgagttatctttattttgacttgaacctattaaaccctttgtgttaggcagaaagtccttctctgtcccaactatgtccacgtctcaatctctacaacctataaatatgtttccctatatagtaaagtgggctttgaagatgcgattaaattttaggatttggggagggattattctgaattttccaggtgagccaaatgtaatcacaagggtcctcaaaaatgagaggcagaagagaattagagagagagatgactacaaaagaggttagagttatgcaatgtgagatgagttcagcctggcgttgctggctttgcagatagaagaaaaggagccatgctggaaaacatacaaaagtagctcctcccatagagccccagaaaggaaagcagctcattggacactttgattcttgttcagtgagacctgtgttgaatatctgacctatagaaccataagataatacatttaacaaatgtgtatgttgttttaagttactaaattttaattgatttattacagcagaaatataaaatgagtacacttttcataactcatggaaaagttatcaaccagtaggccgtgtctagcgaccaaagagcctcaaccacgtggaaagaaagggaacaagatgggaaaccagtaagagtatgacgttaatcattggaataaaatatatttggcatataccaatggttgatcgtatgtttacaatatgtttctttcacactaagcttgttttgccagtaccatctcttgaccttctaagatgcaccttctcttccccatttcctttcaattgcatccataaccagaaaagttatatttcccatcacattgagaaatagctgaaaactttctttccttatttttgcctactgctcaccttattttgcttaatattaacactctgttaattcaaactagctcttgatctggatttttatctctcaacctctacctaaattaacttttttcctactatttctccagaaataagcattgctctcacttgttttgttgtcatagtttatttgtatcacaaggaaagactataatcacaactaaacatccattgattcatcaaaatagaagaaagggaatccctgagtttttatgtgatttgaacaaaatacagagttcaggagaagaacgcagtatgtagaggactaattaaaatcacacaggctccagttcagttcctgctcctccaattggtcagtatctcatgtcaaggaaattatttaaatgtctaaatcacactttatcccctatgaaagatgggctatactgacccaacagagttatgtgagtatagtaaatgatcataaagtactctagcaagataacagataataaacttcaaataaatgttattatttttactacaagaaccattgacattaataaatattgtcctgaaaaagctcccaacattatattcaatgccatgttatctttgatggcttttgtgcccatgtccacatactcttctaatttatagtctgttcttcatgcaacaataatcaagaaaaaagtgaaattgaatagttggttttatcaacttgaaactttgtttttgaaaattatatttaaatttctattataaattatgttagaaagcaagtttattatttacaaaactatttttggaaatatgttctgagcttccaacaactgtctataacttgaattttggcacctattattgtaatattctttcctggatgtctatggcacgtagatattctaatagactatgacttagaataatatcaaagggaaattcaatagaaattatcagtctttttggcacaaaatatttcaaatggaatctaatgcctaatttttcccattgtatgtgttggcatattaacttagatactatagacttttacaattggcataaagtcttgattatgccagataaaaaaatttgagagatctgctgcataacattgtctctgtaattaaaaatactgtagtgtacatttaaaatgttgttaatacactggatctcatgttaagtgttatactacagtaaaagaaaataaatcagagaactttaaaaattaatttcccataccaaagattattgtctatttatttttaatagtattgaatgtttagctctttgaccaaatagcattattaaataaatacaggcaaatactaacttcatcaaagtcatatttaacaagactttgattgacttgccaacactatgggtgttgtttttcctctgggccatggctgagactgagaattcctgccctctctcttcgtaagcatttctgaccccctggacatttattttggtatgctgtccacttggggacaagttgctatagttgtgaccactctctggcctctttccctagaaaaagcagatcaacacccttctttccaaaatgcagcattttgtttttaacctaaattcagtaattagatatttaaatgctattagatgtaagtaaattgctttgattttttatttcactcttagtgattttccagtggttcatttgcaagaggtacacatgtttctaccacaaaactcattacagatagtctagccttagctcaaattttaagagtttgacctttgttttaattaatgaagtggcaatattaaattattaaaagtactggaaccaaaaaaagtgagaatcatcctcaaaaatattttaatgaaccccagagtaaaattagctaggtgaattattaaaaactatattatagttaaaatgctttcctagtatccattaattaacacaattaatttcacctttcttaatgaacataactccattggcatttggcattttttcctctttcttgggtttctttctgcttatttatgtgttttagcagtaaagaactgcaacctcagcaaactataaattttatttttggaacacaaaatattttcctgggagccacgacttaacgatttatggagaggtattttatttttaaatatatagaggatctgcaagaacaacaacaataagaaaaaactttatatcagtcccagaaaaagtggttctaattaaaaattaaggtagagtttattaatttagtaaccaagtccataagaatagagaacaactttttctttattcagtaatgcagaattaacattaaatctctttgataattctaaaactatccgtgcttttgtattttagttttctacacacttaccagctcattggtttctggattagaaaaataaagttaaacacaaattgaggagcagtactgactgtgcggaaaatatgctccactcttaaaagtatgctaaatatattttttaaagtttctaattaaaaattatttacttaccaaatgtgattgcacatgtcggctttatttaactgatttaatattttgattgcatacctcctaaatatgttttcaactaagataattgtgttaatttgcatcttgaaagggaatctttcaagacagagaattgtcttcaaggtaatctctggtgaattaaaaatatattttttcaacaatttatgatataatttttaaacattaattccctacttactctataacccccgaagttctccctagggttatctcgtaagcccttcttaggaaatgactataagattgtgccttagagaattctagagaaagctttttaaagacaggacttattggtctttacataactgaaaaacacgtcaaagaaatagaagctcagagttcaatattttttctttagcataggatagataaaattacaaaaattctttcattgctgcgttacagaatgacaagaataatgttatagtacataaatgacaaagccttattatctacactgctatactgaagtttgagaaattctgaagtttccaagcaagtctccccacaccacaacccccagaacaagtatctatctaaatcaaataaaaactcagggatactaggagaaattaattcaaacttgacagatttctgaccccagttgttagtgtaacactagaatagttaggattaagaaaatggggctcaagctctctgcctcgttatcaggttctatattgttactgcttcttagtgaggctgatggagtcgaattagtaggtcaagagagcaaagctagtcagttttttaacagtgctaccaagcacgtcacatttggaggactcagcacagaatccaccgaaaacattttgttaattttgtactcatgttctaaacattatttaaaaaggatcaaacacagactctctcattaaagagatattgtcaagcctgagtttgattatgtgttaactgagaacaatttactgcccaaagcccctatacagttaacacaataatttagatacaaacagaaagaaaagtgctatgaatcttgcttcctggagtgacagaggttggagcgtgggtgagatttcaatgaactacatttatgagtggccaggaactatagataacagcatagttagatgcaatattttatctcaaattagacccagacattgtgaagcaagatgtccttctagcaatcttagtaagtgttggcagcaagaataggtttcaatccaacaatacatttctaaaagaagcagataattaagtatcacctaattatcttccctatatcttttgaaaggttaacactttcatgttttaaaatcaaagtaataaggggaaaaaatgtagtgacctgaatatactccctaacctttaaatttctaagactttttttttttaacatttcaaatcctatatgtgggaaaattatattataatgggggaagcctccttttttttttcttttagttcaagttttttccaagtttcttgtatttcactggaaacaacatagccagatgaaatatctccaactaaagtgtctttacaaaacagacaaacaaaagtacattaagggggtttggatttttaaaggaggagttactttcattacacgtactaatccccaaactctcccctttacatttgacagtggcctcattcctggtattagctaatgtcatcagtgttaacttctatttcagtagagaagaaaatgtatcttctcaagatacttttaaatctttgtttaggcaaattctcaatatacagtaaaggaaatacaaatagaaatatttctaaagtatctaaagtctttgcttgaataacgatgaatagaaataatacacaaaaagacctgtgttctcttcaccccttgatgaaatgaaatgccacaaataacaagtgaagctccctgtattggcctccttacttcctctcccatcctctctcctcatagataaccactttcttcagtctggcattcatcatgtccatgaatttatgctttctttatgtatgtataggtctctaaaacataaacattagaggcacagtggctcatgcctgtaattccagcactttgggaggccgaagtggatggatcatttgaggtcaggagtttgagaccagccttgccaacatgatgaaaccccatctctactaaaagtgcaaaaaatagccaggcatggtggcaggtgcctgtaatcccagctacttgggaagctgaggcaggagaattgcttgagcctgggagacagaagtttcagtgagcctgagatcatgccactgcactccagcctggacgacagagtgagactctgtttccaaaaaaaaaaaaaaaaaaagtaatgaataaatgtggcagactgccacagttactacttgagattgtcactacaacagttactactgttactacttgagaccatcattacaagactgaatgaaggaggaggaatgcagagatgctaacaaaaaacaaaagaaactgttttcaaaaaagggtccagggaagaagaagatagctccctgcttctagtgagcaaaggcagcagccctgagcttctacagcccttcatatttgttgggtagaaagagcagggaggaggaggtaacgattggtcagctgcttgattgatcacaggttaacattatcactaacaggcttcagatttgcctaatcacaagaaacacttgtgcctgggttctgactgccctcagcattccttcttggcagcagatgcagtttgtcaatttgccaacatcctgctttcatgagaacagtttgctgtttactaatgtagcctccagtgatttactgagttgatcaggaccctcactcatgtagcctccagtgatatactgagttgatcacgactcactcatgtagcctccagtgatatactgagttgatcatgaccctcattctttcggccttcaataaataaaggtatgtatttattttgtagtctgttcttttaaaagccaaaatgtgggtctgtgagatacattcagattgataaaggtaactcaaattccttcattgtcactgctgactgatattctattgcttgaatttgctaacacagtctacttactcatccactgttgatagtacagtaggtggctccaataaattttatataagtaatgcaaataatgtttaacactcttaaacaagtatccttatacatacctacgaaggaaattgctgagtgttggcatgagcatgtctttaaatttatgtctactgacaagttgctcttcaaagtgtttacatcaatgtatatacaaatgggcattgtttaacatttgcttttgctacctgattcatgccaacacttggtatggtaagataccatttttagtattctgatagctgtgaagtatcagctcttatttttatatgatttttcctaattgaaaccagttgaatagttttccttctgtttattgagcattcatttttcttcttttagaattcttttttttcttttgacagagtcttgctctgtcgcccaggctggagtacagcggcatgatcctgcaacctccacctccagagttcaagtgattctcctacctcagactctctagcggctgggattacaggtgtgcacaaacacacccagctaattttttgtatttttagtagaggcggggtttcaccatgttggctaggctggtcttgaactgaactcaactgatctgcccatctcagcctcccgaagtgctgggattacaggcatgagccaccacgcccgacccatatcttttgcctatcagactgcagattggcttgtcttcctcttcatattcacagaagttcttttcatattccaaataataatcatttgtcaattatagaccttgaactttctcaataaagtttatctttagtctttcattttgtgtttgtttgatgcacaattatcaattttgataaagtcaaaaaattttttaactatgaaaatatttatgattttgtcttgcttaagacattattttttactctggactcataaattgttctcctatatatttttgtaaaagtgttaaaattttgtttattacatttagatcttgaatgcagtacaaattattttgtgtaatttacagaaataataattgtgagcattttggatcattcctgaatcaaaggaatggttctaattttcatcattatgtgtctggtttgctaaagtttttttgtactgttatatgttttttgctctcttatcaactgcctttattttttgcttttaatgacacatttaacaaattatttttatatatgttctcctttgatagatttattctattataaatatcctgatattgagtcatccttgtatatttgagatatcatacaactttgtcataatgcagtagatatacatacatatcaggatatgatttcctagtatttgcttataattttacatctatgctagtacttgatattagcttttaatttccttcctcattctgtcttagattcaaatgtcataaaatgagtgggaaacagttcctttctttgtaacttctttactttgtaacaaatttaaatttgtaagtatgcttcagaatatttgctaaaattgcttttgaaaatatcaatgaatgaaggggtgaactgattcttaattactgactgaatttccttcatgggttttttcttttaaggttttcatttcttttgttatcagttttgtaaatagcatttctctatttgttctagttttcaagtacactgaaataaatttctttataatattctttttttgttacttgggtttctatattttaattcttgatattcttaatattgattcttaaaattcttcatgatcacttttgttgtttcaacctgtattggtagaatatttgtctttcagtaaacaaatatctaattttgtttactctctctaggtttttattctataactttaatatcatctcttacaaatgtgtttaactctcctcaaatttttggagttcatcctggctttaaagttgataatttggtcattaattttttggtcttcctcccacaaaataaattgtttgcagatataaatttcctgtaaatttctataataattctgttgtaagagttttaatatgtaatattttaccacatattatttctaacttttttctaatgtccaatatgattctttcttttttgggataagatcatgctatggtgcccaggctggactcaaactccctggctgaagccatcctcctgcctctgcctcccatgtgtctgggatttcaggtatgtgccactgtgccccactctatgccatatgattttttaaatctataatgtacatatgattttgaatgtctaagtaaacatctttttacatattttctttctgtagttgctaaaaattcaccttaacattacctttcatgcaaaaatgtggtttacctgataattcttgaaacatagcatcacttacataaattttataaatccaaactgccaatcttgttttataattgttttataactgtctagtttactgcataataatatgttggatgtgtacttattttgtcttctctatttttattgccttttctaagcatttttacaaatattttcttatttcttttgcattacttgagatttgcttcctcatgttttccttttaccggtttggaagaatagagtaaccttagaaccatcagatcccatcacttctctccaaagttacacgttcgaattttactttgttgttgacctctcaatcagacaccattaatttattcagccaatttattttgatttacctacttttatacaagctgcttttcttctcgtaagcaaaaccttttattctgggcaaaaataaattttagcacttccttaagtgaaaattaattagaaataagctctcttgctttgtgtagaaacatattttcatttcctatttggcctccaaatgataggttagcttattttcaaatcatgggttgacaattatttgtttcagaactttaaaaatattattctcctgtactctgacttctattgtcgatgttgaataatcagttgtcactttagttgtgttccttggaagataatttgtcctttccctctggaactttaaaggttctctcattctctctttttctctccactttgtagctttactaagacaaatttgaaaattttgttggcttgtttgagtgtttgttgttgttgtagtttttgaggtggtgtgattctgcataggatttattatgatccctggattcaaaatttgtgttctttgtaaattcagcaacattttttatgcactgttactttaaatattagctctctcaccttctatttatcatttacttctggattctaatcgcatgcttctctacttaatatttaatttcttttcattttttaaagctctttccctcatgttttactctatcttctgtttcattaatactccttttagctgtgtttaatatttatcagtcctctattgtggattttttctaatttaaatattcatattttacatttatatacattgaatttggcttgtttttcaaataaattggttttgtaaacaatagtgagaccttgtcaaaaatattggtataatatcacctgagttttataaatcctctttatatctacaactgcaacatttttattttccttccctaaaaattctaacatttttgtgtacaattttgacattgtatatgatagttattatcttagttttattcagttggtacctacatgcattattttatcttattgataattgtatatatgagtttttttcttagtaaattttcacttaatattatagcaatatcctgtatgacaaaatgataaactatgtgttcattagaaacattatataatagttgacaagtgtacagacttttcaggtggatgaataagaattcatatgcggtctccaacagttacaagttttgtaacttatttgatttctctaaacttcagtttcctaatctagaatatttggatagtaaattggtagcattaaatgctaaaatataaaatagtaacaatataaataacatctgatgtttattgaaaattacactaagcctttgatatcagtcagacatttttatcctcaaaggagaatatgatggtagtcctattactatccccactttacaaatatatgtaatgcatgtaaagcttttagcatattgcctattacattataaattctccgacaaataatggttattattatgtttacaacccttcaatttctgaactcatgaatattgtattattaagagtggtataaaagagcataaaatataaataatatactgtcaaaaccaagattcactgggccactaataagtatttctgttaattccttgcagtaagtatatttgagaaatattataactatttagttactagttcaaagtgccattttttcagttgctaagtaatagaaatatggcattaattcttaaagtatttcagattctctacctgtaccactattgttcccacctcggtcacttatatattctcattctttctttgagaaaatagttgtaaagactttcatcttttctctctcttgttcctttattcttgctctttcttttctttgtagctcctcaccataatgtatagagtaaaaactttcaagtcttctaggatgacaaaccctgaaggaaatggaagagtgaagtttctaatttcttgatttcccttttcccactatatattttaaatatataatccaagagctgctacattgctttgatttattatgtggaagaggaaacttgtaattattaccaagcaaaagtcaattgatattgaggaaaaaatccaaatagaactatcccccaaactttgcaatagcccctttctttatttgtcagccatgtttctttttatttgcctaaattatttcaaaatgttttaccaggatataaaattcagaaatgtatttaaagaagaagaaacagcagaaaggagataatgaagaggtaataacacgaaggtaaaatgcataatctgaagttctgtgtacatggtcacaatttgcatttaatcaacagtgattataagataaattgaaggaactgctcaataatgattacagtttctgatcttaacaggtagaaatttttcccaaggatcataaagtaaaatctgtatatcaaaaaatagtgtccctaataacttatatccattaaacacgggtataagtttcatgttttttataagccatcagcatcttatgaaaatgctatatccttctttaataattttgatattctgaaacatagacgtaaagttgccttccatgaaagtctacttgtttatgctgtaggaaataactagaagttctaccaaaagtgaatatctacactgaagggctcacagatattttttacttttaaattaaatttcactaactataatttataacataaggaaaacccgtgctttcttgacttaattgaatatctagttcccctttcacacatatcccaactaaaactttctccaaatacttcttgcaatctcttgtttagtcaatgtattaggtacttcatgaaggcaattccctttgaagtcaatttgtcctctaaaagacttaagagaaaatccgggcgatagtagacccaagagccagacaaacttactgtgttttaaaaagcagctacttaaccaatgtttcattcaatcgaaagtggttcttttcttggatagttatgtgcacatccttaaaatctcttctgagatcctcatcaaagcttcctgagaatttaggtaaattgatttacttagtctttcatcaattgctctgtttactctttaggagtgatacaatagggcaaagagcagttaaacagaaattcaccttgttaatttttaccacctttcatatattacttaggcacatgacatacagacagacactcagtgggatcattaatggcaacttaaaaaacaattcaactaaaccttgacttatgatcacatttttgaatggtaatgtactcaacaaaatacaataaaactcaactttataagccatgttttctgagctttctctaagttttcctcttacttagctcaatatttgctcaatttgtatgaaaagaagtgtttaaagtacctggtacagggttctgtcaaaaagacttttgtccagggacacatagaggctcatataaaaacaaattcataaacttggcctcattaatgccatgctctaatccaatagtgagagaggaggcagttagaggctggctaggcagatagagagggagagtttcaagagagagacggtgcctatgggaatgcacctgtatcgcccctgtggtgtaactagcaggtggaaatgtggttaagaacttcctcttataccaggatgtctgctcagaagggactgtcccaacttaggcacaggcacaataaattaactatgtttccttaacttgacccactgctaattgtaatatcattatcattgtagttttggcaaaccctgtgggtttcacttagggtagtaaccaaggtggagtcactatggccaaccccaggtatgcacggatgcatcacccctagggggaactttagctcccccatcagggtggaacccacagaagacttccttgtttttgccacatgaaagaaatagaactcagccccttactggcagccctcttttggggcccctctactgctgagagcttttctgttgcttaataaatcctactctgtcttactcattttctggtgtctgtgtgccttattcttcttggtcataggacaataacttggacctcactaaactaaagaataaggagacagcaacaatagcttccacatgtggatcaggaatagggtacattaatttattgatatgggtctgaaaattcacatatgcagagttacttatgtatagaaatagctttgtgttgatatacactgataatttgtgaagatatttatttttaagttagattataagataaatttaatttaaagcatggtatattcatgtttagtttgcatcgttttatcattttttaaattttctccatcattgcatcctaaaagtagagctaggaacatgtccggatctcacagatgaaaatgttcaaaacacttctagataccaaaatacctgtgataataatcatacagtgtatcacagccaagttgtcacagcacacttactggttataaccactgactttttctaagctccttttgtgtatcagaagctttttcttgactttgacggtgtcgggaaatcctaatttccgcagttcactgggaattttagatgatttaatctgatttttagacggtgcttggtcaaaataaaactatctaaaaactcacagagtgacatttaaatgccaagaaacttagacatttcaatctctttaaaacacaataaatctctttgttgaatactccagtttatgcatgcattcactaatctgctcattagttttctcattctccataaatttattgagcagttttgtgtgcaagacagtatgctgagtgctggtgtgatgttttccaggaatttaacaatatagtgggagagagattatgaattacaaaaataatagaagagccacataatgctgttacagcctcctctatgagtactgggaacatttggaagagaaagatacttaggaaaatggggtggagaaagaaagcattatgcagaaagtggaattaaagaaggatgctgaaagttgtggttgatctcatgtgtaatttgggggtagagatgggtgtggtgttgggaagataatcagcatcctagtttgaggaaaactacaggttaaaagatacaagcaagaaaacacaacatgcactgaacactgattagaatgtctgcctgtagttttgataagactggaaagtggaaggcagatggtagtaaagaccttgaatgtctggctaagaattctgaatgctgtgttatgcaacagggaatcctaaatattcctgagtatgaccatgacattgtaagttaaacacttacaaatgcacttgtgatgtacactgtttaaaatacttttgcaaaaaacaagtaatttacttttcataacaactttctaagatgcttagttttattatccaggtatttcatacttggagaactaaaaaacggatacgttaagtaagttgcttaaggtcacaattaggaagtggtagagctgggattcaaatccagacaagtctgtttcaaattctgtgttattaactattacactatcaaagtgagggaaccgagtcagattttaagattaatttgagtgcaaatatgggtgtgttcaaagaactggaaagactaagaacagaattcaataagaagaattttcagcagtatgagcatgagataatgttatttaaaccagagtggtggctgtaggaaacggatgggtgcaatagatacaagtgtccttaggaactcacaactacatataaaaactacagagtaagttaaaccatgtcatttctcaaagaatctatgtctaccaaatatacatagaaaatattagaacttaataatcacatattttaaatgcttgataagatctgttctttttacatacaaactcagcaagtaattttagtaagtaatttttcctaattagggaattattattttttgttgatgagcaatagccgagtgttaaatgtggaaaacattgactatggtttgtcatgttctgttttacgtggtgttaactttctgtttgtgtacctttgcattttactgattccctacagacgaaactgtgtctttgagaattgtctgtaagccttctgggatataaattccaggttattttgaagttatgcctgtttgtatcattcgcccactcaagacatcacacattcttccaaacaccccctacacttggaacaggcacccaattaatatacgccatgcaggccaccttgctcttctccttcaaaaactcctaaaaaaccatctgctctgggaggcattccagctacaataaccacctactactttcaattgcctataatatctgcattcactttcctgaacactgcttacatcttttaccattataaaatccataagacaagataatttctaaatatcttgcagagatatgtaacctcctctccaacatctacattcctttagagtagtagtatattcttgcaaagatttctgccatgacagattaaagaaatatcagctttaaaagaataagagcattaacattgtctcttgtatcaaaatgttcagccaacccagttaggtattctgattaggatttaatgccaaactctcacggagaatgttgagtgacactatctaattagttctttatgaacatatgatagtgtggaaagtaaacaaagtagtgaattgtttttaaattagtgtactttgcttctcaaagttcattatgtattacttgctaggcgacaggaactaattttgattttatgatattttggataaattgttccctgggattaaaaaaaaataagctatgacaagaacacaatttatcaatatgcaaaatagatgaaaccaagacaatttctttttaatttttgaaattgtaagtccatatattgccatgctggttaacaccaaattcctgaatgcctgtgaatctcctaccaattatgtcaacaacatgaatatcttcatagggatgccactgtccaggtaataatctaaagacatgtatcttttactcttgcaagtgttaggccttgctaaatgataaagcgtttttctttgtatttccacagcagagatttcagatcaacagacaagtcccagaggactgaggacaaaataattaatatgccaaagttatataataagaaggcacagtgggagatttctgccaaactaagagggcaaagccctacagtggctgagtggaggaggtgggtggcaaagcccaaatcatgggattagagagacaagagattggatatcaggattggtccccttattcttcaggtcaacacctaagagtagaaaaaaaattcctaagtaaaatatggcaatcaaagaatcctaggggtaatcttgggagatccttctgtgactgagaagaatgatgcccattttcatcattctgtgccatggactgcatggaagtagaaagtagcaaagagcagaaggaggtgtcctatcaagtggatctgaggaaagtcctcgccaagtcacatagaccttattaggttggaggaaaaaagcaccttagaatgacaagactcttgaacaatgtggactcaaaaatgctgagagaatgaactaggaggaaacagaggtcaggacaagtagttggtgggatgttgagaatgaaggtaattacacagtctacaaccatcaggaatagctatcagtcagatgcccaaaatatcagatgggtctccacagcggataccagtgtaagatgcccagagaccaggtggcttctgctacctttcagcagaagtagagaccatctgccatctgggagacagaatcttcccctattgtgactattaatattatatgtcaacttggctgagccatgaggtacccagatatttggttaaacattactctgtgtgtgcctgtgaaggtgtctatgaatgagatcaccatttgaattggtagacagagtaaagcagattgcccttcacaatatgggtaggactcatctaatgtgttgaatgtctaaatagagcaaaaaggctgggtaaaggagaattttttctctctgactgatacatttaagctgggagattggttttctgccttcaggtttggactccactaaaaccgttaccctgtcctacttctcaggctattggactcagactggaactatagcatcagctctccttgatctccagcttactgactgtggatcttgcagcttcttagcctccacaatcatgtgagccaattccttataataaatctctctatctgtctctctctctctctctctctctctctctccatctaatctccaattagttctgtttctctggaatacgctaaaatactcctatgttataagaaactgtgctatgccctttgtacttaaacattgttctgagaaagaggaaagtaaagtcaaagccagtgagttgagaaagatacccagaacaactgggtagttacatcaatgagaaaatgtgttaaaccagagaagactgaactgcttttaatgaacaagatcagctatttacttaatcagtgagatgccccaaactcttacttcaccagtaagagtggccactcaaaaacaaaatgggatcaattaaagaaattaatgaaactcactcttttgcacagtcagacttatgattgtttaatattttactgcttgtattaaagttgttattgctaacatattcctaatctgaagcccatcaagagaatttttgactcttttctgaagtcattcaacaagtttgttttgaattttatttagatttatttggaaaggtacacctgtttttgactgtttagaaaatattaattatcaccatcgatatgcttgcaatatttcctgcccaatagaaaagaacatgcatgacatacatatgtgggcttaaatatctcaagagcaaataaaataatttatacaaaagcaattatttaaaactataaatcagtaagcatatgttattttattactgaagcaataataatacggatcaataggtttctcagaatgtaaaacaaccagggtaattacctagaatctattaacaaccttattctcatataaattccaaattatttgaaaatatattttaaaataatatttactttgcaattgagaaaaatacctgagatcctagaattgcaaattgtatcatttagaatgaaatatttatgcttcatttcatctattaagtctctgaaaaaatatgtggatagcagctaacatttggataactactcctggcaaatcatttcatagtgtaacttgataagggcatttcttactgaaatttttaataagagtcacctgaatgtgaatttaactcagaagactataaagacaaaaatgggtcaagtgaaactgactgaatttatattatataataaaaatcataggtagaatgcaaaaaggaaacaactaatataagctaatttacaatcatgtgtcactttacagaaataccttctgagaaatgcattgtttggaaattttgttattgtgcaaatatcatagagtgtacttacacaaacctagatatttttatttatatatattatatggaaaaccaagtgtcccagcaccattactgaatatcaatcatttcctctacttgatttgcaaaaccaatatcacatgccctatattaagtttctataaaggctccattaaatcttacagaacgtatgtgttccatcactggcttaaacattgtaacgtggtccatgactgcatgcgtgtgcatggaaatggaaatagcaatggcttacacatatagtgattactacgctccaggcactgttcttagtgctttagatgcattaactcatttactcttttgtactctatggagtaagaaccattattgggtcattttacagaggaggaaagtgaggcacagaaagggttaagctgcttgttcagggtcacccagttactaagtggaggagcctggatttggacatgggttgtcaggttccagagccaccacagtcatttcttgtcaccaccacagccatttcaagcatccggttacgtggttctggtagatattgccttttctaataaagaaataagcaaaatcgacacagataagggactagtttgctccagagtctctattccatgcattttgtgtagcacatatggttctggactagaaagcattacactttgcagagaatctcagtttctccaccaaggctcaaaattcccatgctacttaaaataagtctccttaagttccccattcactgcatttctaaccatctccattgtatcgttctctgtatgacagaacatgaagtttttactccttttatctgttctgaaatttatctgtaatttttcgaacactttctctcagagctacagtttttcatctatcacaggagtagtaaactttctttgtaaaggcccagatagtaaataatttaggctatatggatcatatggtctctgtcacaactcagctctgcccttgtagttcaaatgcagccaaagatagcagaaaaacaagtgaccttggttgtgttccacaaaacattccttttataaagtaagcagagggccagaactggcatatgggccatagtttgctgacccctgatctgtcttattacttatcagtgggaagtatgtatatcttgctttgtcttttttgaagggagtacaattaagggttttcttggaagtgtttcattaatattatttttgtattatatcttattgatatatcatagttacacacattgcagatacatgtgctattttgagacatgtatataatgtgtaatgatcaagtcagcctaattggaatatccatcacctcaaacattcaacttttctagtgttagaacattacacttcttctcttctacctgttttgaaatataccacacattattgttaactatacttttcctactgtagtattgaatactacaacttattccatctatctaagtatatttttgtacccattgatccacttctaatttgaaaatacttccctattttaaaaaatcacttaattctatggtatttcctgtatgtctctagcagacctatgttcttttattgactaggattttgactgcaaacacattttaaggcaattatttagtagcctatgtttttacaaacattcatgttcaatagttgcagtaactctgtgagattgtcttaagaaaaccattccaatttacaaaggtagcttccacgttcaggaattataatatggcttttaaatctaaattttgtgctcttgtgattatgtgacacgatctttgcattatatagaaatcatatatgattgctatcagatgcacgttaacttttaaataataaagctttcaatgaactttcaactccatttttcactttctaagaatcacctaatatttctgacacatctttgtaaatcccagagagttactggacccctgcattatagcatcaatatcctgcatacacttgagtcacatgatagttttgatagtaaattctgatgggaataaaaacaaaagaaatggtattactctagctaacatgacatgtattattcaatttaatttaatagtataacaatcctgagaactaagaatcactattctactctcataggtgatgaaatggatgctactaaattctaaataatttaccctaggcttcagaactggtaagaggcagaagtagaattcagacacagatagaaccgaaggtttgtctttttcatatgacatcagaagtgtctcctggttatctatggaacccaatatcacgtttgaacttcccaaccatcaatatactttttaattttctataaactctgtttagaattctctgtatttctttatgacaaccaggaaaacttgcttataccatttgagcagtgaagttaaaaatcacagacataacttcaatatgaattttattactggttatctgctagagagcttggaacattctgaatggaattaaaatgcatttcattggtgtggaatcatgaacatttgttaaaattgttttgtaaaaaactccctaggttttcacagctgtagaaatgctccctcaaagaaataagtgcagaatgaataaaaacagatgtggcatttttgcatattatcaacaaaaatctctttttattttatcttgtcaatgtcttaccataacattatttatgccattattctgttcacaacaagtgcaaagaaattacatgacatttccagtacatatactggtcttcagtagggttttctggttacttatatttctctagagagtacctttgcacaggaagtaattttctatgttttctaactaaaacccaacctttctggctgtgcactctgagaaacagcaaacattctccactctattaaaagtaattgagtcggaacatttaaaggtattttaaatgaatgtgcactgaacattcttcaacttggttcaggaaatagatataagaaagtttttaataccctgaaatttttaagaagaggaaattacctttggttatttaaagctagaaaagattgggtttaagaactttaagacaacgggctaaaatcaactccaaggcaatgaaagcgtcttcctttaaaaagtcactagtgttttgtgtttataaatttgtgccttcactgttgaatttgtgccttcactatttaaaatgtatacaccgtatacaggtttagcatttctaatccaaaaatccaaaatccgaaatgttacaaaatctaaaatttttgagggccaacgggatgccacatgtggaaaattcaacacgtaagtacttaactcaaactctgttccatgcacaatattattaagaatattgcatgaaattattttcaggttatgtgtataaggtatatatgaaacataagtgagttttgtgttttgtgatagacttgggtcatatcaccaaaatacctcattatgtatatggaaatatcccaaaatataaaaaagtctgaaatctgaaatagttaggatcccaagcatttcacataagagctgctgaacctgtagtactcttttaggcactcagatgtagagtgaagttaattctgtataatataagctaaaaaacataatcattggcagtacctagtggtaactcaagctttcaacatcattagaatttgaggatgttaatatacctgcacaaaacaatcctatgtgacttttcaaagatgaaattgcactcagtgtggtcaaatgaagaaattaaatcatgctatgaataagtgatgttttattaggtagatgttctagcaaaacctaatgctttacctgagaagttaatcacttcttacattatttttccaattgtttgtcttcccaagagttgtgctaacttaatattaatttgatatattagctgtattcacttaaaagtttacacaaaaatattttaccatttgtaattgtttcaagtttatataaagaattaaatatattttaacaagcatctacataattgacatgatttttttctaacctgaaaacctaattatcaccttcttatagaggacaaggaacagctttgcaggcaaattaatgtatcctatcagtgggacagtttgtcacttgcttaaataatcatcatctttgttataagctttacagaatgaagaaaagagataggacccctctcatactattacacattaaaattaacttcccacaggtttttcaacagtttcctacactttcactgtgctgaatcataaagtagaaatgacagcattaactgcttttcaagagataagaagcaaatatatttcatatcagctttgtcaaataaagtcttcagtcaccacacagatacatcatatatttaattgtacacaagttaaaaagtatgccgcatgttaaaataatatgatatcatagtgcactagtaaagagggtatgtaaaaaggactgcgttattaacaattagttgatattattaagtaattacctaaaatggacacctgccattaatttctgtacaataaagagctggcacatgctaaaactggtttccttattttcttatctaactgggtaaagttattaaaattacggtaataaaggcacctaaaatacacaagatttgttaaaatgctcttaaagtaaatatagtattgcttgcattttggaaactttaaaaaataatattcttgctattaattgctatattaaagctattatttctaaactgaattacttataaataaaaaagatttttttaaagactgatctcagttccaactagcaaattatttcagacattttgcatttatttaatttccaatgctgcaattaagaaagaacatcaacactttgacttttagttggtctgaagcaaagtcccttccacgtgagattaaaacttgtcttgttcatcaaatgggatcaaaagctccttaattagtaggctggactaaggtacacagatgccctttgacctcctatgacagattgctaacattttagcatttacaacagactctcaagtatgccggctgacattcaaatataactcaaattacacttggttaaaagaattgtatacatctacatgagaaggactactggtgtaaaaaatctaagtcccggcaacgcaacacaaatcaaaacaatgactttgccagtatgcttaatagggaaggactcatccagtgttctctggattgcgggaagtgcggcaaggctgagtgcatgtgggctagcgccctctgctggttagattcttcaacgtctttaaatcaagaatcttcaagccttgattaaaaaaaacgatgctctaaagattctttctctttctggaattaggaatctatgggaagccttctaaaaatttaaattttaattcgatttcaggtattctaaccacctgaatatttatgtgaggatcacaataaaattagatccccaaatttcttttaaaatttaaattaaaaatttaataaattcttatgactacataataagtgaaccatctgataaaatagtgtaacaataaataaaataagttaaataatttaaatttaaataaattctgaataaatacctctgataaaactaatcgttaataatatagtgtgcccagcggtggctggcaagatggctgagtaggaacagctcctgtctgcagctcccagcgaaatcaatgcagaaggtgggtgatttctgcatttccaactgaggcacccagctcctctcatttggactggttagacagtgggtgcagcccacagagggtgagccgaagcagggtagggcgttgcctcacccaggaagcacaaggggtcagagaactccctcccatagccaagggaagccctgagggactgtgccatgagggatggtgcatcccggcccagatactaagcttttcccacagtctttgcaacctgcacaccaggatattcactccagtgcctacaccaccagggccatgggtttcaagtacaaaattgggctgccatttgtttgggcagacaacgagctagctgcaggatttgttttcataccctggtggcgcctggaataccagcaagacagaaccgttcactctcctggaaagggagctgaagccagggagccaagtggtttagctcaggggatcccatccccacagagcccagcaagctaagatccactggcttgaaattctcgctgtcagcacagcagtctgaagtcaacctgggatgctccagcttggtggggggaggggcgtccgccattactgaagcttgagtaggcggttttaccctcacagtgtaaacaaagccactgggaagttcaaactggacagagcccaccgcagcttggcaaagccgctgtagccagactgcctctctcaattcctcctctctgggcaaggcatctctgaaagaaaggcagcagccctagtcagaggcttgtagataaaactccaatctccctggagcagagcacccgggggaaggggtagctgtgggtgcagcttcagcaacttaaaccttcctgcttgctggctctgaagagcatgttctaacccaatgcaaggaagcaaagaaccttgaaaaaaggttagatgaattgctaactaaaataaccagtttagagaagaacataaatgacctgatggagctgaaaaacacagcacaagaacttcgtgaagcatacgcaagtatcagtagttgaactgatcaagtggaagaaaggatatcagagactgaagatcaacttaacaaaagaaagcatgaagacaagattagagaaaaaagaatgaaaaggaatgaacaaagcctccaagaaatgcgggactatgtaaaaagaccaaacctacgtttgaatggtgtacatgaaagtgacagggagaccaagttgaaaaacactcttcaggatattatccagaagaacttcaccaacctagcaagacaggccaacattcaaattcaggaaatacggagaacaccacaaagatactcgttgagaagagcaaccccaagacacataatcttcagattcaccaaggttgaaatgaaggaaaaaatgttaagggcagccagagagacaggtgaggttacccacaaagggaaccctatcagactaacagcagatctctctgcagaaaccctacaagccagaagagagaggggggccaataatcaacattcttaaagaaatgaattttcaacccagaattccatatccaggcaaactaagcttcgtaagggaaggagaaataaaatactttacaggcaagcaaatgctgagagattttgtcaccaccaggcctgccttataagagctcctgaagaaagcactaaatatggaaaggaaaaactggtaccagccaatgcaaaagcataccaaattgtaaagaccatcaatgctatgaagaaactgcatcaactaacaggcaaaatatcaagctagcattatcatgacaggatcaaattcacacataacaatattaaccttaaatgtaaatgggggaaatgccctaatcaaaagacacaggctggcaaattggataaagagtcaagacccattggtgtgctgtattcaggagacccacctcacatgcaaagacacacataggctcaaaataaagggatggaggaagatttaccaagcaaatggaaagcaaagaaaaaaaaaaccagggattgcaatcctagtctctgataaaacagactttaaatcaacaaagataaaaaaagacaaagaagggcatgacataatggtaaaggaatcaatccaccaagaagagctaactctcctaaatatatatgcatccaatacagggggacgcagattcataaagcaagctcttagagacctacaaagagacttagactcccacacaataataatgggagacttgaacaccccactgtcaatatcagacagatcaacaagacaggaaattaacaagagtattcaggacttgaactcagctccagaccaagtggacctaatagacatctacagaattctccaccccaaatcaacagaaatacattcttctcagcaccacatcacacttattctaaaactgaccacataattggaagtaaaacattcctcagcacatgcaaaagaacggaaatcataacagtctctcagaccacagtgcaatcaaattaaaactcatgattaagaaactcacccaaaactacacaactacagggaaattgaacaaccagatcctgaatgagtacggggtaaaaaagcaaattaaggcagaaataaataatttctttgaaatcaattagaacaaagacacaatgtaccagaatttctgggactcagctaaagcattgtttacagggaaacttatagcactgaatgcccacaggaaagagcaggaaaggtctaaaatcaacaccctaacatcacaattaaaagcactggagcagcaagagcaaacacattcaaaagctagcagaagacaagaaatagctaagatgagagcagaactgaaggagatagagacacacatacacaaaaacccttcaaaaaatcaatgaatccaggagctgttttttttttttaaagataaacaaaatagaccactagccagatgaataaagaaaagagagaagaatcaaatagacagagtaaaaaatggtaaaggggatatcagcactgatctcacagaaatacaaactaccatcagagaatactataaataccactatgtaaataaactagaaaatctagaagaaacggataaattcctggacacatacaccctcccaagactaaaccaggaagaagtcgaatccctgaatagaccaataacaagttctgtaactgaggctgtaattaatagcctacaaaccaaaaaaaagcctaggaccagacagattcacagccgaattctaccagaggtatgaagaggagttggtatcatgccttctgaaactattccaggtgatagaaaaaaagggactcctccctaactcattttatgaggccagcatcatcctgataccaaaacctggcagagacacaacaaaaaaagaaaatttcaggccaatatccctgatgaacactgatgaaaaaatcctcagtaaaatactggcaaagcaaatccagcaggacgtcaaaaagcttatctgcaacgatcaccttgacctcatccctgggatgcaaggctggttcaacatatgcaaatcagtaactgtaatccatcacataaacagaaccaaggacaaaacccacatgattatctcaatagatgcagaaaaggcctttgataaaattcaacagcccttcacgctaaaaactctcaataaactgggtattgatggaatgtatctcaaaataataagagctatttatgacaaacccacagccaatatcctactgaatgggcaaaagctggaactattccctttgaaaactggcacaagacaaggatgccctctctcaccactcctattcaatatagtattggaagttctggccagggcaatcaggcaagagaaagaaataaagggtattcaaataggaagagaggaagtcaaattgtctctgtttgcagatgacatgactgtatatttagaaaaccccatcatctcagccccaaatctccttaagctgataagcaacttcagcagtctcaggagaaaaaaatcaatgtgcaaaaatcacaagcattcctatacaccaataatagaccaagagccaagtcatgagtgaactcccattcacaactgctacaaaaagaataaaatacctaggaatacaacttacaagggatgtgaaggacctcttcaaggagaactgctcagggaaataggagaggacaccaacaaatggaaaaacattccatgctcttggacaggaagaatcaatatcatgaaaatggccatactgcccaaagtaatttagagattcaatgctatccccatcaagcaaccattgacttttctcacagaattagaaaaaactactttaaatttcatatggagccaaaaaggaggctgtatagccaagacaatcctaagccaaaagaacaaagctggaggcatcatgctacctgactgcaaactatatgacaaggctacagtaaccaaaacagcatggtactggtaccaaaacagatatataaaccaatggaacagaacataggcctcaggaataatgccacacatttacaaccatctgatctttgacaaacttgacaaaaacaagcaatggggaaaggattccctatttaaaaaaaggtgttgggaaaactggccagccatatgcaggaaactgaaactggacccctaccttacactttatacaaaaattaactcaggatggattaaagctggaaaccatcattctcagcaaactaatacaagaacagaaaaccaaacaccgcatgttctcactcataagtgggagttgaacaatgagaagacatggaaacagggaggggaacatcacatattggggcctgtcagggggtggggggcctagggaagggatagcactgggcataatacctaatgtaggtgacggatcgatgggtgcagcaaactaccgtggcacatgtatacctatgtaacaaaactacatgttctgcacatgtaccccagattggctccaaagtcatttgtaaaacttctctttatcttttaaaataatgtatcaggttttatgcaaaaccttcctaatcagcactatcccatcactgcataagaagtattttctcctttgcatcctctgtgtatgatactccaaccactgcactcatcttacagtattatatatgtgtttgcatgtatcttttccccactaagctataaactctaagtggttggaatggtgttaaactcatcttctaccctgagcaaaagaagtcttttctggaacatattagccttgcatcaaatgagtatttatctagacagaatgtttagtaaattgctacatatgtaaactagagcaagttatacttctgaatttgttttctaatatgtgaagtaaaaataataattgtaactatctcctaagattgtgtgtggattaaataaaataatccagaaaaatcatttagtagagtatctggaacataccccagcctttaagaaatataaatgatgagttttattgtagtctattgccacaaggacacacaacttacacgttaggtttacaactgtttattaggctataataactgagaataaaaataagattgggactaacgattagtgatattagcttaagttttcatggtaaccaagcttttttttttttcccctagtaagatgtatagatctagaaaaagcaatagaatttttttgtaactttgtgttcttttctgtatgtcatatgatactttaaattactttagttatatttgaaaataatttttatcattaggtgagtagaaaacaggctaaagcatccaggttgaaatgtaaaacagccaaaataattaaagtaattgaatttgaacataaatgaattttatattcataaatttgcaaactacatgaatcacagtacatgaaactttctggtattttagaagttattgccaaaattccaaatgacttttgtaatttaaatatgccttaaagattaaagcaaaatgaattaaataagacaaagttagtaaaagtaagatgaaaagtaagtaaacaaaatattaaaagaatatgtataaagaacaaactgtgtctacatattaaaaaccaaacaaattatgacatcacagtgactactaaacatcagtaagtaagaagagtgcatagtggcatgtgctctgcatagacataaatgtacatgtaaagatttattctttaaaagcatataaatgtagagatgcttgcttgcacagcaaatggttttgttacatcaggatttctccgtgtacttgttagtatttttatcacatcattaaaaagtttcagtagaagatgaggatcatagaaattcagatttaagtgacctccttaaagctgagaaatgaactgccaaacccaaagtctttgcaaagcccaactcatttttaaaatatatgaaggttttggcagagaatgctttttgacccgttattcatttttctttcttcctgtgtacacaagaacctctcagactttatgtgagcacatgacaccaccatgcccctgccagagatcacattttcctgagctcttgcctttaagggtggctaggtcactaagttgtgatatgagtagcagcgacaggggcgactctcagtggaaaaacttggtgaagatgctgtgggcattggacatgggtatgagaagaatactttttggggatgtcttctccagtcctcagacagaaagaggcacctcctcctggtagcatatcgtactccattttgcatttacctcactgatagtctttaccacatgttactgtgattccatgtttggcttttgtcttccctgtaggcccaaaggctttacaagagcagagaggatatttcatattaacattactcattctccaagtactttcacattatagaactataataaatatttctcaagctatacaaaataacgaaaagaaaacataagagtctgcaggtatgatcctgatgatgaattctgactttgaaagaacaatcaaggcaaaatgaggaaagcttggaagagagtcagaatgtcctgggaataggtatagaatgaatccaaggaaatgccagatggtgagacttggaggcaataagtgataagatgatcaatcataattgctagtatttgggggaacacaatatttgctagacactgttaaaatgttcttcatccagtgttaatttagttttgcaacacagcccccaggttgatgccattagtatcaatcctcattacactgattagaaaattggggcatggagagaggagaaattttcctaaagtcacacagttaggaggtggaagagccactatttgaagccagggagccctaactagcacattataaatatctgggggaaagaagaggtaaattgaggagacccaagcatgactccgcaataacatcccctgcttattagcgttgtcttaattcttcatagtgaagtatggcccataggtcacacttgctcacatgtgatatatgtagtgtgagccttactcctagctgctggtgtacacaattattgagactttctgtgatgcattatccatcggatttgcatgagttggaagtagacgtttgcatgtgcacacaagctggcctaagaacagaaatgagccatcaacagggagggggaattatcatataaatcctaaacatttcaagtgtacatctacttccagggatcataaacataaaaaggttaaataaggcaggagttgtcagtggtttggtgactatgaaacaggaatgaggtaatcaaactggtcttatctttcattgaaaaatacgaacaagcgctcattgagtgcctaggagcactcaacaagctttgatcaacagagctttggaccatacttaaaatagcaacattaaggccaggtgtggtggctcatgcctgtaatcccagcactttgggaggccaaggcaggtggatcacgaggtcaagagatcgagacaatcctggctaacatggtgaaaccctgtcctgttaaaaatgtaccaaagaaagttaaagtcgattttagtaccagcaagaccagttaacaccttagaaatgttttttaaacacagtgacaggcctaaacagttgcagccagtcaacactgcaaaataggggcaagaaccttggaccaagattcactagagtgtaatttactaatcacaaggagggtttcttgtttactactgtatcctcagtgttccataaatacattcaataaatctttgttgaatgaataaaccaaaaaaaaaaaaaaacacaaaaattagctgggcatggtggtgcacatctgtagtcccagctacttaggaggctgaggcaatagaatcgcttgaacctgggaggcggaggttgcagtgagctgagatcgcgccactgcactgcagcctggcgacagagcaagactcgtctcaaaataaataaatagcaacattaataacgatggcgtttatatagagaggctagatggattcagcctgatgactttgtcagtctcttattttgaccagtcaagctactaaagttcctatctagggagtgatgtggagctgtgcttgtcaaagcacatttcttggactatgtccatcagagtttctggaggacatggtcaaaaatgaaaatttctggactatgccttgaaccaattaaatcaaagcataaaaggacagaaagttgtatatacatgtaccatatttatgcttaatgagtttttgtatgttatgtatataactattatatgtttatataagctaattgtcataaatatatttatttatataattattttattacttactgtttttaaatattttattacatacttatttatataactattaactatattatttatataaaattgctagaaattttctaaaagaaattttaaatgttaattccacaaaagtatatgagttaatgcatgtgtgaaatatcttgatttagccattccacaatgtatacaaacatcaaagaatcctattgaacatcataactaaatacaacttatgtttttaataaaaataaaatataaaatataagtaacagacaaatatatgtacgcatattatatatatacttatataaaacataacacacatttttaattctgtatgatgtaattattatgctgactgaagtttgggaaccatggcattacatatcccaatatgaaaacactgttaatgcagaaaatacaaatttcaaaatgctgcatatgtgagaatattatttttctcttcaaagagcaatgtttatgagtgaaccattttttaaaaaataaatcattcaagggtaatattttagaattaactttgttcagtcagaaaataatgttgaacattttcacataactacatgtattccaaaagaaatgcatgagtaactaatgcttatgtggagggagaagcaacgcagaggatataattagttccaattagccatgccaggggattactttctaggtaagattacctataatgaggtgattaacctctttggaaaaagttcaagccaggcttaccttctacttaatatgtcctgtaaagaagtgttacaacgagggtcctcacaattgttccctgggataattgccaccaagaatcaattgattctattccagaagaatcaaaaagcattcttattatattattgatagaatgaatcctaacacatctatatattagaaattaagtatttaaatttcatatcaaattaactaaattatatggcacggattttatttatactaacaaaacagcaattgaactctagtcaattccaaatacagatctatcggctatctatgaacatcaaaggggaagaaaattctatcattgatattggttaacgtcacaggcttatttccaaaagtagactgtccattgtctaattagtttagagggtctcttctgtctccagcacacaattgaattttgttgcagttggagaggctgatgctaacctaggtggcagggctgaacacaagggaacagaagcttcagtgttttcaccataaaacacgagataaattgaggatagggattttggaaataatagatttaactgttgtccaagcttatctgcagtttcttccctttaaactaaattgatagtttacttattatggactaattaaaattattatatataatattatctatgtaatatatctgttacatatatatattgttgtcagcttataaggaacaataaataattttctttgtgttttaatttaacaaatacttcctgaaagtttgcgtgtaggcatacaagctacaacaatgagtagaaattttttctaaaagtggttttttactgtttaatactcttccctataagaaaatacttaaacttgaattattcttgtaatcttgtggacatctctgaattaattactgttactttacaaatcttgtttctttatttgttatcctagaagtatttgtatgtgtgtgtatataaaatttttgcatagaccacatgcaaattcatgtaaagtaataatacaaaccctaggaatcgaaaggcaaaatcaaggggaaaatatttaaaatatttgcatggaaatgataataataaaatgtaagtgtcttgcaaacagaaactagaaataaatatttctgttttatttaaattagagcatatacaatcaagccttacttcagcatgtatctgttagagctcaatggtcaccttaatttgggagccccaggaaatatcttccctctgtaaagttacaaagtagaatttttctctggtttatattcttctgtggaatttacgattatctaagctctctctgatcccaagttccatttcttcatttatcttagattctaaaaatctaggccttagctgaatgcccatcaaacaaacagggctccttagtaaatgtttgcagacaaaggaaacaaccaaatcaatagcagataagcagtattttatccaagcttcagaaactttattaatattttttgttacttcactgcagtggcaaaaataaaaaatgaacaggagaataaaaaatgtggtgtgaaagaagaaagagagtgaggggcaaaaaaggaagggagaaaagttattcccttctttattcatcctccagtcctcactcactctattccaaagagccatcttacaaacatgattttaaacagcctggatacagaagtaagtgttctggttttattaatggtgccaagaaatgatgcaggaagcttcaggtgaattgaaaccccctgcatgagaacacacacagtcctgactcatttaaccattctcatttctacctgctcagatccaacaaagtatttaagcaagtctcaacatacaaataaaaatatatgaatcgaggagcatagtaaattattttaaaagctttacattaggaatacacacatagaagagcacatataattgtaagagatttatataaatatgataaaatgaaaactcttagcaaatatatatgtatacaaatatataaatcgatgcatcacaaatacatatatgtatacacatatatacatctatatatttacctatttatctgtacactatatggtttataggcaaaccgtaatttagtcatatggaaaaactggcctcatgataatgcttacacacacaaatttcaaaaatttcatttaaatgatatagcaaagtattctaagttagaatgaaaaatgagtatgtttcttctttaaaaacacatcaattcattctagtacacagaaactaaagacataaaagtgctttaggacatgaaactctcatgaagatatgattctcttcaaaaggtccctgcacaacaccactatttctaataaaactgattttattcaaaacactaaaaatgacaaacatttaacttttaatttcagtagtcctgtttacctagttggctaataaaagatagtgacatatacacaaggtagaagtgtgccttaaaacatgataataatttacatttttaaatgaaaaaaattcagtctacaataatgaacttgtcttgactgaggcaaaagtgaggtcaaatacctgaatgatgacattgtgatatacttcatcctttctttactttcactgtttttaatagattgtgaatgtcagtaatttaaaaatcaattgtactcctgaaataacagtttaattcctaaaagtttaaagtgaaagaaaacatgaattcctacaaatgtgattctacaaagatacatgttaaaagccttcagaggaaaataaatacaaatatctcctatattctatttgctatgtcatacctgactcaaaaatatatgtaagatacacatttaagagaatatctcatgaaattgattggatgccaattttcaattggcttttttcatttgtacattaaagattcttacagaagatcaagaaaattataaatatgaatacatcaacagaatatatcatcatgatgtaagacaatttgaattgctctggaacttcaaaagcattttgttgaattcacagaaataatttctcaatggtactttatatggtaagtaaaaatatttggctttgatatagcatttttctgtcactactgaaatattatatttttaacttctcattatattctagaactttaatggaatttttatctctagataacaaatggcaattttgtgttctattactctagtctgtgggcttttctttgtctctatagcaaaatagaaaaaaaatacacaggtttgatttttctattcttagaaatgataattttccatatatatggaatatatgtatatatacatatatgtatggaatatatgtatatatacatatatatgtatggaatatatgtatacatacatatatgtgtatggaatatatgtgtatacatacatatatgtatggaatatatgtgtatacatacatatatgtatggaatatatgtgtatacatacatatatgtatggaatatatgtgtatacatacatatatacacacacatatatgtataagcatacatatatgtataaggagagtgatattttatatttagtcttcagttcaataccatcaacacataaagaataataatttgaaaattgtatactgctgacatataaattgataagaagaagcacaaactaatctataagtaatctcatattatttatttgtaggacacagtgctcagggatttatgttaaagaatttttgtttgttttgcattgctggttcttgaaggttatgtacgtaaaggctgagaaaactaaaaggtattaatacctcaaataatagttatgtagaatgaagactcactctacatatcacagttcaatctttattgcattttttgcactataaaagcataaactataaaggtagtaagatatatagaaaaatatagagaagataaatataccatgaaatagtaaataacttacagaataaatacctattgagtacacagtatgttccacaaactgtgtagttactaaagcccaagaaagaaaaagcagaaagtagtacagaaataaatcacatacttctgaccagggggctgagaacctatctttgtttcattccaaaaattagagaccagatactttgaaataagctgcgtggatttaaacagtattattgtgatcgctggccataagtgcttactagctaacttcttttagtttattctagtaaaatggttttaggtgttacacattaagaatttgaattgaatcactgaaatcatgctatgactagatttttaagaaatctttgtaagaccacctgatacggtttggctgtttccccaccaaatctcatcttgaatttccacatgttgtgtgaggtacccagtgggaagtaactgaatcatggaggcaggtctttcccatgctgttctcatgataatgaataagcctcacaagatcggatagttctgtaaggaggagtttccctgcacaagctagctctctcattgcctgccaccatccacgtacaatgtgacttgttcctccttgccttccaccatgattgtgaggctttcccagccatgtggaactgtaagtccaataaacctttcttttgtaaattgtccaatctctaattaatgtctatcagcagcatgaaaacggactaatgcaataaattggtaccagtagaatggggcactgctgaaaagatacccaaaaatgtgagagcaactttggaactgggtaacaggcagaggttggaacactttggaggactcaaaagaaggcaggaaaatgagggaaagtttggagctatctagagacttgttgaatggctttgaccaaaatgctgatattgatacggacaatgatatccaggctgaggtggtctcaggtggagatgaggaactggttgggaactggagcaaagatgacttgttatgttttagcaaagagactggtggcactttgtccctgccctagagatttgtggaactcaagagagatgatttagggtatctggaggaagaaatttctaaacagcaaaccattcaagaggtgacttgggtgctgttaaaggcattcagttttataagggaagtagaacataaaagttcggaaaatttgcagcctggcaatgctatagaaaagaaaatcccattttctgaggagaaattcaagcaggctgcagaagtttgcataagtaatgaggagtcaaacgttaatccccaagacaatgggggaaaatgtctccagggcatgtcagagacctttgcagtaggccctcccatgataggcccagaggcataagaggaaaaaatggttttgtgagccaagcccagggtgcccatgctgcgtgaagccaagggacttggtgtcctgtgtcccagctgcaccatccatggctgaaaggggccaacatagagctcaaaccatagcttcagagggtgcaaggctcaagcctcagcagctcccacatggtgttgagcctgagagtgcatagcagtaaagaactggggtttgagaacctctgcctggatttcaaagtatgtatggaaacgcctggatgcccaggaagcagtttgctgcaggggcaggactctcacagagaacctctgctagggcaatgaggaagggaaatgtggggtcagaacccccacaatgcatccctactggggcaccacctagtggagctgtgagaagagggccaccatcctccagaccccagaatgatagatccaccgacagcttgcaccatgtacctggagaagccccagacactcaatgccagcccgtgaaagcagccaggatgggggactataccctgcaaagccacaggggcagagctgctcaaggtcatggaagcctacttcttgcatcagcttgacctggatgtgagacatagagtcaaaaggagatcattttggggctttaagattttactgccccactggattttgcagttgtgtgggggcatgtagcccctttgttttggccaatgtctcccatttggaatggctgtatttactcaatgtctgtactcccattgtatctaggaagtaactaacttgcttttgattttgtaggctcataggcaaaagggacttgccttgtctcaaatgagactttggactgtggacttttgagttaatgctgaaatgaattaagactttgggggactattgggaaggcatgattggttttgaaatatgaggacatgagatttgggaggggccatgggcagaatgatatggtttggccatattcccactcaaatatcatcttgaatttccatttgttgtgggaaggacctggtgggtggtaattggatcatgggggtaagtttttcccatgctgttcttatgatagtgagtaagtctcatgagatctgatggttctacacgggggagtttccctgcacaagctctctctctctttgcctgctgccatccacataagatgtgacttgctcctccttgccttctgccatgattgtgaggccttctcagccatgtggaactgtaagtccaataaacctttcttttgtaaattgtccagtctcagatatgtctttatcagcagcgtgaaaacagagtaatacactgccaatacttttcctataactggttccattttgcaagttacttggaagtccttttcaatgttacatagttttacacaaggaattccacactgctttgcatgtttttctaaaatcattatacgcctttataattgccctttttaatgttgcttattttagtatggtaataaataattattaatatcctttttttcaaaaaaggaagtatttaaagtcatctctctaaatagcaccatgagaagtattatgtatgtgaattatgaatgtaaatatgtttatgaatactaattgacaatttatataaatattttaaataccaatattatgtaataaatagtttaaaattctagtagcataaatatttagtttttttttttcttgagtctaaaggactggaagtttttattcaaattccgtttgttggaagaatatcttaaagtttagaaagttaaacagcatgctttcttttaacagttaacttagatttatatagaaatttggaaagaatatgatataaacctttcaactagcactctcttaagcaacggaaaaatcattacctttccctgttctttcaatttctgtcataagaagcatagagaacagaactatatattgtggtaattaatttccttaagataatgttagaaacatcatgttctttaaaatataaatgaatttcaaggtgagcatgctagaggataatattaatggcatgtgatttattgtgacaagagatctgatctgaaataccattattaggagtacttaaaaaaatccatttgcaaattcctgaaaatatgaaagtgtgctatggctgagcctgtcgcaatgttgaaatctgaactatctgccattgtaagtatgaaattgcttgggtacaatatgtcttcctcacagaaattcatcagaaaatgttcatatcctgaatatatcacattatggtttagggaattgcctaaatgcttgaaatgataactgtagacttaatctgcaaatgtatagattgaaacatacatgcctaattgacgtggtaatatatggaattctgtggctgatcattatcttaaaaaatatttggccaataatacattgaacatctactctatacctggttcttgaactcgcaatagaaacctgtgactttgtgtcattttagagagcattttctatgttattatctctagcaaagactccctataagctatttataagcgaggttcattcatgactcaaatttgcaaagaagttttaatacagttagttttacatcttataaaaaacattgaagtttacaaacacattgttataaatggcatctaatcacatactgagcagtgaggaatgtcacaaattagtagagctattagtaataaaagattaaatagatatgtgaataataggagtctttatgagtaagaagacttaaaaattattctgcagaaagaaattcattagcctctgatgcttgagagagggtaataaatattggcattcttacacataggttgtcaaatatgattagcacataaatatattgatatatctctctataaagcctttaatgaacttttttatgttaaactctctaagaggtacactccaaaaggtattatccaaacacactttcgttttttgcttgaaacctattttaatatatgaatataaacttctttatgaatataacttaaataatatatatgaatataaatatgaatgcttcatagaatgacatgtgggaaagcatagactactctatcttataatatgttttgtacacattaatagctatattcatttccaggatatttgaggtgtataatcaagtgctgaaatctatacagtacatatactttcactgttatgtcaatttatttttacatgtgtttcatgaactgaaactaaatcttgtaaaataaaaatgtctattctaggtacaaaggcaacttatagtgcaaaattttaattagattactttgatttaattttgaaatgcacctggagaaaaattcaaacagtacaataaagaaaaatacagttgtcaccacaaccactttgttcccatctccagaagcaaccagagttataaaatttgtgtgaattattctgaaaatatatgtacacatatatatccatatatgcatttatttcattttctttacgataaaaagtatagttttctgaactataagaaaaaagcaaatcataaggtcatgatttatttgtagggtaaaaaacaaatcaaggaaatacccaacataggtattagattatgtttttagttactaaaaacatttttttttttttttttgagacggaatctcactctgttgcccaggctggagtgcaatggtgcaatctcagctcactgcaacctccgcctccagggttcaaacgattctcctgcctcagcctcttgagtagcttgggttacaggcacccaccaccacgccctcatttttgtatttttagtagagacatggtttcctcatgttggtcaggctggtctcgaactcccgacctcatgatctgcccgccttggcctcccaaagtgctgggattacaggcgtgagccaccgtgcccggcctactaaaaagatctcaataggtaaatttaaggaaaaattagatacaaactcatgaaacatttgctgtgatgatttatgcataaagtagtgcaattttaatatttagaaaactataaaacaattttgaaatagtttttaacagcattttatttattgtgaacctacatgggagaagattacatcaatgtactcatgagtgacaaaactgaaataaatttaagaatgtccaggtgcaggtatctaataaatggtctataacatttatggcaagatgtcagccaaatgcagcgacaataaagcccttggctttgaatattaatagataaagtcacttaaatatctatacagaaatgctagttatggttttgtagctttgtgagctgaatagagtggaaatgagtataattgaagcaaaagataattcacttcttctgccccacttttctaggggagtgaggtggagagagccatatttccttctagaaatggggaagatacggaaccaaggctttcctgtttccctgagtaactgtgaaggtcaatgtctacatttttgaagaaaaaatgtttgcctattgctcttatgaggaaagaaattttgttcgtcaagtcttttctccttgaagaaatgtctctaaaaataatttatattggtattgatattactataatttcttttgatttagtttaggccaatttgaagctgatagtccaaagatatataatccctatgtaatatacacttagcattatcaaatcagaaccctgtgtttttccttgggatcaaggttgattgctgttcatatacgtcatgaaaacttccagtgtgtcttaaaactattaatttcatgttttacttgaaatctttctttataatacatgagaatgaaatagagatgacccattgcattcctcattatagtttcatcacaacctaagaaaaatttaattcatttatcctaccatcttaatatttacacacacacacacacacacgcacacaaagcctcataaagccagtagattataaaatattctgtaccatctagtgatctttttatggcaaaattcagcaactatatctataatttcatctcttttgtcaccttacctactgttgaatttctctgggtgtttttctctcatgatgtggaatctgtgtgcaatggaggcatcctaaggggagaaaatagaaaacaaaaacaggatggtttatgatcctattattttatgaaaatgtagactaaataaaaaaataacatttcaaaatgaacttttatttacaatattattgccaagaaggttatgtaaaattaggcaaaaatgtgtgatccatatgcagaagtgatttatgtaattctatgcagaagtgatttacgtaataatttcacaattgattatttgttacatttacatctaagactttattgctatttaatttctatatctcctttaatgactggctttggcctcatgttcaacgtatgttgaagatagcacatatgagtgtaaatgtcaaatagtaatggaaaatactgttaaacaagagttagaaggatgccctaagtggagaaatgatcagtacagaggctcctaattatttgagataattatgagtaaaaggatggtgtgagtgtgcatgtctagtaaagataagtgcaatacttgacttcagaatttgctcaggttgtcttgatgtgtaattaataacagtttggaccacaagcaactttctggcatagctcgttgaatagaaaaaaaaaacaacaacaaagagaaacatttatttttggggaattggtgacaaatacaatttgtttctgagaccccaagtgcatcggttctgaccctaatggatgtttcttacttttagcaaatacagaatttttccatgagatagaaatcatactcaatgtgtgagactgctgaaatactgctatccaagcttttcaagcacggactgctccaactgactctaaacaattatctctgttattccaagtgtggagatattttcccattcttcaaccacacatgattaatcactcaaatgaggaactaatatatttaccagtcatctcaacagaaaagggctattgttgacattcactgttaattttgtttcaaagtggagataaaagaaaaagaaaaccaaactcaaggaaataaagaagttgtgtatttgagagaatcttgaaaacactaatcaaggattaaaagtctaatgaatgaaatgaaaggctaatgtgcttactcatgcataacaaagcatgaagcacaaaaagagagggaccaatgcccactgcagatggcagagagttgcaggatacagctaactgtaattttttttctgtataaacatttgataccctaaaatttgtcaagtaattgaatgaatccatgaatgaaaatcacccagacatatagatagaggtgtatagaaacaatgcttataataaaggttacaaaaatccccctctacggtttaatatttaagacgttattttgttatatatacatggccaacttcctggtttgctaggaagtacaaatatcaagatggttcacttttattcgtccaacgataactctctaatctagtcacagagttcctttttataaatttaattctattaagtcataaacatattatactttataatatgaagttgtcttactgtggtatgagattacaggaaaaacacctgaactgggctatttatggtatatgtagcatgatcaattaattaattttgaaatgcacttacttttactttatccctaatctggtacaaaatcaacttggaataccttccaattaaaggcatacattcagcagactagttaaacaaagcaaaggaatatgaatcaaacactaagaatgaataatcaatattgcttcccatagggagagtatcattgaatttacttctgcttgaattgtttctgctaagttggggagactgagacttttaaaaatagattgtgtagtacaattttttttacaggtgtatatttttgtaatgacaaatttcttcctttacaaagcaacataaacagaatagagaaagggagagaggcaagaagacaggagggagaagagaggggagagacagcaaaagaccatttaagtagactagactataattgggtaaactcctagaaacacaggactacatagccaaagatagaactaatattagcttatttatcttcaagatacttgggcaatggatcatttagttaagaggggaaaaaataaaacttagtgtcaaacactagcaggtcttttccttgtgttgaataggttccaccataaaaagagaactggcattgccaactacaggattgataaggaacaatgacagcaggtgttcatttggatgagaattcagatccaattcacatgggaccctgtccctttggcataaccccaaagggcttgatagagtactgccaaaatctgcaacactatccagcagccatttttcaagagacaccaaaggttctctaaagacagccaaataagaaaaagctaaaatgccattttaaaataaattttaccatttctgtctgaatgcattacagtttttagacaacagaaataaatcagcattacttccgcttcctagaaggcacaaactctgaattcagactttctacttccaagccttgtgacttcaaacaaattatttattcattgagaaccacaacttccttatctttaaaagaggatactgacatcccttcaaagtaccttggtggagatttaatatcattctctatagcaattggaacagtattctatatagctcatattttcatacatcttatatacaaaccagtattttcttaaagttaaatgagaatgctaaatatggttaaatgacatatttttgaaatatatttttaaagacttacattgctttttattatttccttaacctatatagctttatttttaattaattaaaaaaatctaagaaatgaaaataagtcaatcttattaaagcaaaacaaatttaaacctcattgtgttattcaaacagtaaaaatgtaattagcaacttttcttgctacgtgtacatatataagtatatgcaaatatatgtatatagaataatcagcttattagccatatgtgtctcaaatacttgatcactagtatttttctgaaatgtatttttcctttttctgtataggcttatttatgttttaagtaaaattgccctaaatctccaaatttgcattttatgatattaatttgaaaagctgaatattttctatggatcataacattttcaattgagagaatgttctatatgtattgagatcccagagcctatagcaaattctgctgaggagaatattgtctttataaaatgtaaaatagaggtacccaaatattgtcatcaatattatcttttattctgtttaaataatctttctctcacaaatagtttctaaaatttgtcgagtaaattgttcatttttgatgatttgaccattgcaccacattaaatatcttttcaatttttttccattttagaatagaatataaatttagccaattagaaatgagtgtcatcaagagttattccaaaatctaattttagaattaaaagtaatcttgcatactatatgggtttttattgttgaaataatttagttcttccttgtttttggaggaatgaattccaatctctccctgtgtgcaaacttttctttttctcaaaaattgtaatttactaaaaagtttcaaaagctggttttcggtgctgtatttgttgaatattttgttaaagatttccagtaatatttttggagtgttactgcaaacaagaaaattgccaattttaagtgtatacttcaaaaagttttgtcaaaggtacacaataacaacaatcttttcctatgcttttgttcattcatatttcttcttatgtggactacatattgaagtctgtgtccatttatctctgtatattaaattgactgggttcaagacccagctctaaattttactgaatattttactttgaaaagtttgcttagattttcattattgtcattttcctatattaaaataagaataattttaataatacctgccttgctttgaagatctggtgttctaatacctggaagataactagaattgtgcctggtgtatagaaagcaagaaaataaatgttaactattactattactgaaaaatattcatgattttgagattcataataccttctcctttggtttattgagatggttaattaaataaattgcataatctttaagatgaagtatatgaggaaatttttgctttggtattcagaattttttgggttatgcattcatatatgataaattatctaacaaactcaaaagggtgaggaatatcacactatacttaaacttcacataaatatttctgcactagtacatatgaatattaactcaaggaaagataaattaacaatgtgagatagagctaactgtaattacagttatactagaaacactacactttgtaataccacaaagagcagcttagttcaggttatagttctcactaagaaactataaaaatctgggttttcaaagctttgttagattgagcttttaggtaagagattgtggttctgtatttcccatctggaataaaacaatgtttgctctcctgatagtgtttacctgaatgtactatgctctcctgacaatcattacctgaatatactatgtatataaggcactattttcacctgttaatatttttaaagaaaattacaataatagccacaagtgggattatttcccaggcagactgtatcagatattgatatctgtagtgctgggttgattaaatagagccagaaggttttcttctttatgctgcagaatagttaataatgcatgggaattatttgttctttaatcatctgtgaaatgttggcctggcatttttttttttggagaagttaacgttttggttttcttaatttctctgctatattagtttttctatctcttcataaattatgttttttattacatcatctgtagtgggctcaatggtgccccccaaaaagatatcagatcctaataactggaacctggtaactttttttacagaagtgaccaagttgatgattgatatcgattggaaccagtgacccctctctacattgcactttctttttgcgggaataggaatgcgtacaactgtgatactatgcttttttgccactgtattttgaaagcacataacttgttttctactttaacatgtccacaaatggagagatattttacctgaagatggatgatactaagtgtcatctgtatctgatttaggttatttacatgatgagctttgagacttggagctgaagatatttagatcagattttctacttaagttgatgacgtaaaggactgagccatttggggatatcaagaagaggtaaatgtattttgcacacagacatgaatctttgggggccagaggacagttagcagtgggatgactgtgatccctaaacatatcaggtcctaatctctagaaccttgaaatgttacctttgatggtaaaggtttttgaaaatatgattaataatttggtgatgagaagattatccaggtgggacgtaattcccttcacaatttccttatgagagagagacagagattagacaggaggagacgatgcgactacaaaggcagacattggagtggtgcagccacaacttaaagaatgctgaaagccaccagaagccaagagccacaagaaatgttttgttctccatcacctctggagggagcataaacctaggagcacctcgattttagtccaaggatattaaatttggatttatcatctcttgaactgtgagacaatacatttctgttgttataagtcaacaggtttgtggtaatttgttacagcaggcatgggaaacttatacttcatctgttcatgtagggtttttttttttttgagaaaaacattattctataatattttaattctttcttgaatccatggttattttgatcctcttaatttgaatttgcattatttttgtatttaacacacagtttagaatctataacttagcaaaaaggcataagagcacattagaataggcatagcaaagcctatatatatgtcaactccacaaagttgacacacaacaaccaaacagtaaaactctagaggtaaaaattgttgttttgaaaagaaggatttattttaacgcgacaatatagtgtagatgttttcccctctgaacatcatgttgaattgtggtacccagtgttggaggtggggcctcgtgggaggaaattagatcatgggggcagatttcttatgagtgcttcagcaccgtctccttggtgttgccacaatgggtgagttctcatgagatctggcttcctaaagtgtgtggcatctccccccacctcttgctcctgctattgccatgtgaggcacctgttgcccctttgctttccgccatgattgtaagcttcctcaggcttcaacagaagcttaagctggtgctatgcttgctgtacagtctgcagaaccttgagccaattaaatctcttttcttagaaattacccagcctcaggtgtttctttacagcaagcaagaatggcctaacacaccccagatagcactgctgagtatctatttaagattgtatgtgcgatctttagaaatataacacatcaagaattagacaataaaagttacatgtatcataaagaaaaagaaaggctatcattatttatacatgatataatgttatatacagcaaattcaaagaaataaactgaaatccacataaattgggagaagagtttaaagtttcccagatataggagtagtatataacaattagtggaattgacaacattaaaacaaagtaacagaaaaataataccatttacaatggcaaaagtaattataaatatataggtaaaaagtctgttaatctgagtcctatggggaaaaatgataattactgaaagacacacacacaccacacacacacacacacacacacacacacacacacacacaatcagtggagatacacactatcctgagttacaaagatttagggagttgatgttacagtgtctgaggaatgatacaagctcttctaaatgcgagcacaggtagcagcacctggactttactctgctagattgcattttttgtcttttagaactaatgctcatgaggtgtgtgtgtgtgtgtgtgtgtgtgtgtgtgtgtgattcgacaggaactcagatgcattatgatgcacatctgcaattttgcctgctgtgaatacttcagatggaacccattgtagatttctgttacttagttttggattacactgctggaacaaccagggcatttttctagaatgaaataacttagagacttggagaaatacatgattgagagcaagttaatgggatttagaataaagcaaatccctagagtaggatataggatttgctgaatggtacatgaaaattcaaaagcagattttaaatagggacacctggccgggtgcggtggctcacgcctgtaatcccagcactttgggagactgagacaggcagatcacttgagaccagcctggccaacatggtgaaaccccatctctactaaaaatacagaaaaaaaaaaatacccgggcatggtagtgggcacctgtaatcccagctactgggaggctgaggcaggagaatcatttgaacccaggaggcggaggttgcagtgggctaagactgcgccattgcactctggcctgggtaacaagaataaaactccatctcaaaaaaaaaaaaaaaatagggacacctttgtatgaaggtggctgcacccgtgagcaggttccaagtgaattatttaatttcttgggtatttgatattaggtgatggcaaaatttataattagaatccagttcaagttattaatctcaaactttacaatccacttcattcttttttttaaaaaataattattccataaagttggacatggtcatatcactcttgtgattatgttgcagagggcagtgatacctgggttatctgtgagataaggcctgccttacttcagcattttcccattgtccctcccattcaggaagggccccttgggaaagtagtagctatacactgggagaaggggcagcatcattgttccatcaaaaacagatggtggcctctaatctgaagaagtgccctattgtaattggaggaaagtttactctttttaaatgactaccaaaaagtctgtgggaaaccacataggatcatgcagaatactggggtaggtaaaacactcgtatgtccaaagggacaatgtgaggagctagttaccagacccagagggaaagagttatatagagaaaacggccttgggaggaaaagacatccagccccaggtgacattttcaccgaggtatccaggaacgtaagaacctgaaccctgctttatatcctctcatctactgtggggatctcaactggccaactccactagaagaaagagggcaagggaactttgctgtcttctatacaggacatttctcaggcagacagcagaacgaacaagggcagagagaatatctagagaggcaaacagaagcacccagaacacagggaccacagtccttgagattcaatgcttatggtagaatggagagctgtgtgtgcacagaagtctaaaaagcaccagtaccaaatctatggtaaagtattgacaattattaattaaggtgaccaccggagtatcagtataaattgttttatattttccactatacattatgcattaaacatttacatttaaacttcaacaatttagattaaaaatatttcattaaatctatagatttaatttaactgaagtaaaagattaatcttttgtcttattaaaattgatacgtagcatcacctttaaccttttcataatggcaagagtcatcttgttaagtaacacatgccacgtaccgtggtgggcagagtgtgtagggctattcactttccatgaaatgactccagactgccgagtggtagttgtgccttgtaatcgtttctggatttttaacttatttcctcttccaccacattagactgttaacattctaatatgttaaattctaacatgctgcaaacaacacgcctgtccctagcagtttcctccggtttgcttgattttaattttcatgtgttgaaaagaaatgaaaccttagaattttaaatttagaattgaccttaaataatgctcataggttagactagtaaagtggttttaaaaaagccaagatgaatctagaataggaccaataagcataaaaggagctggattaaatctctgtggacttctaccataagtgaatgttagtaattttctatgtgaactttaagttaatcattgtaactatttctaaatatttaattatgcctactgcctagatttccattttactccaaaaagtcaaagttcttaagaaaattccttttttttttttttttttggagacagaatctctccctgtcaccaaggctggagtgcagtggtgacattggctgcagtgcagtgcaatagctcactgcagccttgaactcctgggctccagtgatcctcttgccttgacccctcgagtaagctgggattacaggcattagctatcatgcctgactaacttttttttttttttctttagagatgagagatgaggtcaagctatgttgtccaggctactctccaactcctggcctcaagtgattctcctacttcagcctccaaaagtgttggaattaacaggtgtgaggcaatgtgcctggcaaaaatgacctttgacaaatcaattattattggaaataaaatatatttctcatctgctgtaaataaaaacttatgaacattgtaatggaatatgacaggattgaaagcaaatgtacaaatgattactatgagtctcaattccaaaacagaaacccatgactacagctagggaaccagatgaagagattttaattaagttttaataatcttactgagaatttctctaggttacaaatatttcatacagaagagttcatgaaattgggcagactaattcaaaatatgaaaaaaattgacctcagagaatctagagacaacttccaagaagagaatataaattataaatcccactcttgctctttcctgcgtacaatatgtagcattagcaatgccagaaaacgtctgtaatggtcttttcacataattaactgtaagcttcagaaacaaacttgtagaaagaataaacttactatacacttactataaccacagatatatcatttctgtgattaaaatgctcccttaaatacaaagtttcttctaccaagcaaattccagactcatttttaatggattaaagagatggaatttctctcaaggcgtttattttaaatctctagatttaggccaggtgcagtggctcacgcctgttatcccagcactttgggaggctgaggtgggcagatcacctgaggtcaggagttcgagaccaacatggtgaagccccatttccactaaaaaaaaaaaaaaaagtatatatataaaattagctcggtgtggtggcacgcacctgtagtcccagctactcgggaggctgaggcaggagaatcgcttgaactcaggaggaggagattgcagtgagccgagactgcgccactgcactccatccaaacggggtgacagagcaagactccgtctccaaaaaaaaacaaaaaaaaacaaaaaaaacccaacaacaacaacaacaacaacaaaaattattttctagaaatctaaacaacaaaaattaggtctagaaatctaaaatgaagaaaattgtaaagagcatacaatcagcaactgaattaaaagtgtaatccaacatgtcactgaagaaacaaatcatctgtgtcttaacatagaattaatctacttccctaagtgtcacctgacaagaaaatacttaacaaaaatctttactaagatgatcataggcctagaatatttcacaaactctgcctgtatctattgaataatgtagggttccagtgtgttttggtctccctctaatagaatccttatttcatagtttccattcctctttcccaattagaaaacaatgacaggtatataaacttatatagctaagatatttactataatcatttgattgagattttgaattgagaaatcaagtcaatgtaatatatttaaaactgttcatttcacagtaaattagatatttaactctgttttagtttctggaaaccctaagtgtttttgctgatatatattattttcaataatcaagatatctttctcagttaaggcacaaaggttgtatccatcaattacatttatatgtctcaggttgattggtcattacagtattcattcaatctgataaaagctgcaaatgtgttcagtgatttgatataatttccgaaaatctgcaaagaaagacttatcatctttgaatacccaagggtttgaaatgtgacagcataatacttaattttgcaaaataaatccaagtcaaaacctcatgtgcgtttgcaatcattaaactgaagtggggaatgaccaaagcggtatgagtggtcaccagtaacttgggatgagatgggagagtaagaggtagggatacaggcagcagtggagcctgaagtggacacaaaggaggaggggaaatgagatagaagaaaaatcatgtttactatctacaagtaggaatgagaatagatctcaaaggcgcgggaggatataagcctgcaattgaggctaaggggtcccttgagaattatactgggacagagagaagggagctggatagtgtggtggaaccagaactagaaataatataactttcacggcaaaagtctgaaagtaaggttctctataacattcattaactcaagaacgccaacagtatcgatgctgcaccaagaacagagtgcaaagtacaattatatagtttttaatcccatttaatttccttagtgagtcaatgaggtaaatattgttctagagaaaaagctgaaacttaattggtttacataactcagcaaaaatcaagttaaggtagccaaaacttaaaccagaatatatgtaactatatgtaaatagcacatagttacatagtctactatctcaaaaggctttagcttatgaattccaaagagaatcaagctttattataagaataatttccaaaatataattattttctttatacctgaaagacaattatcttaataatttggttaatttcaattagatatctcaaagtgacagcatagtttatttatttgcatctcatttcatctaggcagccacgtgcccagctaataaacaaatacattctgattttcctgggtacctttgtaactagaaatggttatctagacagaggtccattccacccttcattaccaccaccttactcacagaaatgtggatttaattcctgaaagttgaaaagggggacaaaaaggagtccagtcctttaaaacaacttgaagctgtcctactggctttgaactaacttcttccagttgtcctgggaaaagaagcctatgacttagaactttgttattgttccataaagccaattacgatcctaattgaaacaaaggtaatcatttattcagcgcttcattcctgtgagaacataaaattagggagtcagtgaattctgtaatggcgatttctacaaaatatttcactcaattatttttctttagagacaaaatgacaaaactttgtatttatatagagctgtgtgatttccaaaggattttctggtaaattattcattttgacctgattaattgtggtaattttttttttttaatgcagaaacaggagagatgctaatgtttgccctttagaaagaatagatctgagtttaaggggctttctagagattatgcagctccctagaagtgagaatgagtttagtctttaaactctcaatccatgactcatggtgctacttccatattgatatggtttggctgtgtccccacccaaatctcatcctgaattttagttcccataattcccatgtgttatgagagggagcagatgggagataatttaatcatgggggctttttcccctatattgtcctcatgtagtgaataaatctcatgagatctgatggttttttaaggggaaactcctttcacttggctctcatattctctctcttgtctgctgccatgtaagatgtgccttttaccttctgtcatgattgtgagatcttcccaggcacgtggaactgtgaatccattaaatctctttttctttataaattacccagtctcaggtatgtctttatttgcagcatggaaatggactaatacccatcttgtcaagcaatatggattactggataattcacttgatgttaattttcatgaagaaccacttctgcttttctctaaggtatttcatcatttattgttgctaatgccattagcatccaatatttcctaaaagaacacatattattcagaaatttagaggctgcttgtgtccataattctattcttaacataatggtaggttttatttaattaacgatttagttcctggaggatgttaaaaaacaaaatatcgttgattgattctttttaaatgataaataacatttgtcctcattctttgttctcaagaataatattattttaactgtcctttattgtaatcatagtaattaaagagaatcaaatcagtaaattaatagcttaaaaccatgagagactcataatttatctaacttgttagaaaaattgagtccaacatccctcagcaaaaatatctcatacctcagtgctacaaagaacattgtaaaaagtgactgcagaactcccataacactaaactagtatttgaaagagaatataggcctattacattatccttataaatgattaatttttaattcataaaagtttacagagataaaagtgttttgtttataatgtaatataaaaattaaaatctattgtgtatctagaaaaaaattctagacataaaacctataaggggaaattgctcctgttaatctttgcttttattaccccaaaacagggctataactagtctattgaggactttcctatgggcagtagagaaaggaacaataatgtgaacaggttttatgtactgcagaaggatcaaatcttgttgagggagtgaggaggtagctattgtctagggtggggggtgatggctggagttgaaagccctgagggaaaatttaaaaataccaataaaagaacatatataagatattgcattggtggcacttaaaatatttgctcatgtttttccaacctaaaaacaaaggtctagtcttcatgcaaggaaaattatccatattttggattgtttgaagaaaagaaaatacaattgacacatttgttagtgaggtacagcttacagggattcacagaattaatgggtattagatgtaatactttaatctctgttttctgcaaatcatgaacccccgccatgatgggtttctacagttctagacctgatgtatttctaggtctgacctttatgccaccataaagtaatttaacaaacacctctaaaaataaaagacatggttcacctcaaaaataataagggccaagaaatttaaatccttttgatagcttacattcaatagcaataacaactcaatacaattacacatttaaagtacatgacaaaaaagggttaaactttaatggattgaaagaaatattttaattatactgtttgtaggctgtcataaatagtaatagccatagtcaaattttgcaaacatggaactatccctgtatgcttacatagacataaccatttttcaatacatctactttgaatgcttaatctatgcaaactttcagaggcatatttgcctagtgttagtatttctgataaaatagttttatgttagtttccagcaaaatggttctctaattaggcaagtatatgtggtcaattatgtttatttgaataaactatggattgaaaatggagttttatgttctactctgctatttgaagactaaaaggaagagatggtgatgcttgatgaaacaatggatgctaataccatgttttccccttatctacagggtatacattctaagactctcagtagatgcctgaaactgcagatagtacagaaccgtgtatataagtatatatatggttttcccttacatatgtacatacctatgataaagtttaaattagaaattaggtacagtaaataataacaataactaataataaaatagaacaattatcacatatactgtaataaaagttacgtgaatgtggtgtttatctctcccaaaatattttcttgtactgtagtcaccctacttcttgggatgaaacaagatgatatgaagcttacaggatgagacaaagtgaagtgaataggcactgtgaatgtagcattaggctacgagtgacctaagtggcaggtagcatattcaacgtggattccctggacaaagggatgattcaagacctgggtggggaggtccagggacggtccaagatttcatcatgctactagaacagtgtgcaatttaaaacatataaattgtttatttctggaatatttgattaatatttcagactatggttgactgcagtaactgaaaccgtggaaagcacaaccacagataaaggggactactgtaatattaagcattctacatttctggacttatccagcatgtaaacttctcacatataaaaaagtcatcataaaataccatggctatcatggtatcatacacacacacacacacacacacacacacacacacacatctatgtacacatcatagcaattaaactgaaatgtgatgttaatcatatgccatatccaatataaaatctataattacatgtatggccaaaatgctccacgttattttggcaccgatgtattagcttcaatgtttcaagctctttgaaggtttaaaatatatgaaaatgctctgcatattaaattcttttaaaggcccccttgttcaggaaagtacataatcaaaatatattgtcttatggaagtattccttaaaagagtatattttctatgatattaacttagtagtcaagtattagtattagttcatttcttatctagcattttatcttttatattcatatagtattttaattttagaattttataaaatgagattttagatgcctaacaaaatgtataagcatcttgagacaatctacacttagtgattcaaacgggacacttttttctgtattgtgctaatcttaatttgtgaccctacccaccaaaagaaataaaaagcagtctttgcaaatataagaatacaaatttagcctaccatttttcatcttttcaaataagcagtatttatgggttaaccacacttatggcttaatatggcattcacttattaagaatgataaccaccttaaattagtctcacaaacaaaatattatgggacaccttgtattgcaatgttttgccaggcaaaaacatcactcattctctgacatcaaatatgcaaagtgaatagaaggttgaaagcgcctatgactttttaaaggtattcaaaattacacatttgtaaaacactgctttgcttccatgatttagttaaatcattttatgtatttcaaattgtatgtctttgtttcactctaacgtgaaatttaaaaaaatacatacacttgaccagtatctagtcctactaatatatacaatccacgtggatctgcatgttatatggcttcatgataaaacagtaaactatcttcacaagattagtaatactattttttaaatgtcttcaagaaagacaaaggtttaataggctaaatttgatagtattgttgatatccagcagaatcaaattatttattttctgttgcttaaatgaaaagtacaaatatattcctattgtatttcaagttgacccatgattctctagatgtagtccccactaatcagtggcaccactgaattcagagacaaatccttcctgatacacacaatggaaaatactttaataagtgaacacataagaatctataatactattgcacaaagagaataatggtcaacaaatggctcttttaaaatgcattatttgtcactaaatacactgccattataacaagaaaccttttgtgctttaaaagggtatgtttctcagtaaaatatttatgcttttagaaattaccagactatatagcccctgcacaacaatttcactgttattacacaaaattgtaaattatttctttttaaattattaatgcaattgaaaaaagaagttttcaggcttatagtcttttgaaaggacagcaaaatagacgaaacaaaaccaagatgacaatttcagcatttaaaatctacacatgataattcaaacaaatgttatgacatttaagataatgaaacccttcatttattctactatctggtatgagttttatttcacatataaggagtcagaacagatgtccaaatattgtaatgccaaaagaaagttagggcatatcttgattaataccctcagagctgcctgtagtgtctctttaaaactggcatggtttacttcaaaacaactattcaaaatccattctaggaagcctagctagacaaagattcccaagacaaaacgaaaacaataaagcttagtataacccttttagcaatgtgagttgcgtattattgacagaacattcattgcaatcagtaaatgattaattgcaaatttgttgctaaattgaccacacaaaaaaaagagacaagcttcaggctactgttaaagaggaaaaacttatgttaaaaattattggaggcttcttgtagtgaattaattctaatcaatatactttttgactacacagtggaataatgacttccttaaatatcagaggtacccattattgtagacattcaaattaataattaacatactgacttgcatttttaaaaaatttacggaagtagctttttcttttgccttacctttaacaaataaatagttcatgtttcatcaaacatgtgcataagatttgtttttgaatttcaaatgtagattgtagaagtaatgcccatatggtcaaacttataataattgcctgaagcaatttgttcttgggtttttatgaagataaacctcagtggcatattaaaaatataaaagtttaaaaggtggtaagatagatggatgggtatttgtttctcagttacaaatggctatgctttacaaaaatggtgccttttgggttcttttattcatatcagaatgatcaagcaaaaatgagtggtataagggtacaatataatattttgcacaaaagcaacattttcatcaaaataacctgcaaagtcattttcagaatatttattgagcacctattgtatgccaaacactgtgctaggttctgaaaagacaaaaattaaataaaacatagaacttctgttaggcaaataatatttgtaaatctcttcttcccttaactactcatttttctttgaaacttattggaaatgcatcagtgacaaagaggcagaaacattattctaaagtttttgaaaacagaagcaataacttttgctacaaagatgaaaacagaggataaataaagctgcttcagatatttataataatttgatgactaaaaaattatgtcagtgattatgtagtcctatttctaggtaaggtatccaaagtcactacagctaataaggatatatttctaaaaattatgtgagggtgcttcaaggtctatattgaaggaggtggggaagtggtaagaaaagtgcacatctttaaaatgtggtataatatatacaatggaatactactcagccataaacaaatgaaataatgtcttttgcagcaacttggatggaactgcaggccactattctaagtgaagtaactcagaaatcaaaaaccaaatacgcatgttcttatttataagtgggaggtaagctatgggtacacaaaggcatacagagtagtatattggacattggagactcagaagcggggagaaagaaagggggaaaaggaatgaaaaaatgcctattgcatatgatgtaaactattagggtgatgggtgcactaaaatcctagacttcaccactgtacaattcacccacataacgaaaaactacttgtacttctaaagagattaaaataaaaattttaaaataaaacataagaaatgttttaaaaaaagaaaagtgaacatctttggtttctacagtagccctctatattgagactgtgttatacttttgggatgactttacaaagaactatgaagtccatccccccatatcataagatgccttccttagctctatgttcctaggctctcctaatggtattaaacaatcatgtccctatattcctcagtgtgctttcagccaggcataaatgaccataaatagcctctgctgcataatccagagcaccaaatggcctggagctagcagacaagaattcgaactttgctgcatcaccccaaataacaataattcactaagttattgaatgttgtatgttattatgcagagagtgaacaaactgacattcagcaatgctagataatttgtgcaatactgcaaaaccaataggtgggttcagctggtatttgaacacagctcaattgcttccttctgttctaggagatggcttgttatcttatttccacaatacccactgaatattgaaaaaaattcctttatataaccaagtgacactcatggaaggacagctcattttctagcactcaaagcatacgttttgttgtacatttaactttattgacacaaagatgcatttaatatattcttatttatggattatgttccatttttgagttagattcttaactgttataatacatggggaatatccatgctttattgtatctgagagttttaagtatagaaatatttttcacttaaaaaggtatgtaatttatatctatttctgcttaatttgtgaaaacaatcttttaaagcaaacaataattgtcctagtgaagcaaatttgccaccttacacattctccttaatagcatttgttgatttgttgaagatgcttaccttgctcaaatctgtttaaatctcattaaaatatattcacaaacaagtgctccatttttaaaattgctctgctaaggatacattaatacagtcaacttaattaacacaaagtattatacaatcataatgatacaaatttaaaaggaaaatggaataggtaaaaagtcatcaaattttaaaaacttgagtgatctgtagaaagtcaagaccagagattcagagaataaaataacctgtctaaatgttaatgctgaacaggagtagaactaaagtgttctgaattaaaatgcaggcatccttttcgattttatgattaatcatcagaattaaagtcaattgaaggtaattttggggaattgctaatttagttgatttttttgccttgaagtttacagcattctgtcaaagcatgctataatgtatccagtagtagtagtacactttttgttaggaaggaaaagagaatccaactaatttgtattttgcaatgagtaaatattaattccaacagaataacaatgtcaaaattaccaattaccttatacagcaatatagtttatttacttgcggtaagtttaccaattgctcacataagggaaatagattatatttggtaaggaaggtcaagagagaggaatcacttggagatgggctggaaactgggttttgaggatgaagaaaagacattgtgtgtaaacatgaaggattttgaaagtatgaaggtaaagagttttaatttcatttcattgggaagtttagtcctctgaattaaaaattcttgaacagaggtagagaaaaggtgtttcttagagatgggcatcattctaaaaagataactctgtggttcggtttttgagttattattattattttataaatgataaattttgcactggttgcttgagtagtaaaatgtagcaaatagtcccaaacttctatatgtttaaaattattttctgccccttttactgctttttgcccagaaagataactaagtttgttctgggctggtatctaggagttaatatcatttattattattgcttgaggctgagacttaacaactttggcaggaagcaagtcttcatttgatttgaaaaatatggttaattttgcagtatgttttgctcattcagaataattcttcaaaagaaatatgggtgagtatttgctagcatgatccacaaaaacattattggctatcacccccgaaagattagttttggtttgatttctctcccttctggcttaagtcttcttgaataccaaaagttagaaggaagacatggcagatcagtgatagattatcataatcataaaatcacaaaggtggagcctcacagatcatcttgtttgaaaattctttttacaagcaaggaaactgaggcaacaccttaaatggaatgatttacaaataatgagctggtggcagagctatggctcatgattcctagtacataacctttatactacataaactaacgttaatatcaagtagtggagaaatcaaatattcttctgaaacgtaaatgacagaaattgctcaaagcatagcctagtgtagtaagataaaggaaagaatgattaaatattttccaaatgtggaaacaaaaaacataagaactgtcatagtgaatcagacccgtggctcatcccagcgttttcttttaggcattggctttgagaagagaatacatttcttttcccacaggtcaacttcaaatgttagaaattcaaataagttgaaccaggactactataacctaaacaggttattttcccttgtggagttaatattcacaaattcgttctggcctttttcaatactttacatatttttatgttccctaattttatatgctccataacattttaaaacttttaaatattttatttgctgtaaatccatgctaacttttaaaaataaaacaatatcctccttttctcgtagtctaaattttattaacatctttgccctttaactgtattgatccagactataagttttcttaaacttcacctttttgataaaagaacaaagtgttttcaaattatttttattgatcagccttttaaataaaattattttacctttatcagcatttaaaaataggtattttttattatgaatttgtttattcattgaacccttattctatgtttagtactggagtaagggtttaagataagaaaatgaaccaaactaaaaagtttctttatttttttttttgctatcatctttcctaaaatagtacaatcaagagtacaagtttatttcaagtagcatttccatatatttggtaaaaatctttctacctccatgtttttaatttcactattattattaaccataaaaaataaaaagtaaataatacctacaggtattactcctacaggtaagcagtctcgtggtgttttaagcatggtgcctggtagttgggtgtgaaattggattcggtactaggtgattgatagaagctcaaaggaccttatggagtctactggtgaagatttgaaggacagtgagaaaagtgttatcgagggctagaagaaacaggacaactgttgtatagcggtgaaatatttagcaacattcttgcttctttttacatgaaaaatataaaagatatctataaatatgacaacggctgtaaacatttctaggcaaaatgtagaaaagtgttcagacatattctagctgcatataataataaacgggacaagaataaaggaatttaaagttttaaggcaaaatttacagaaaatattaataagcttgatgagtttgaggataaaactatttctcatcctgagatactcccagaaaaaatattctcaagataagaattggcttcagggaaaaaatcaaatccagtgtactaccaataacatggtgggatctagggttataggaatcacaaggttgtgactgtatgatttttgttaaaaccttaaaaatatttaagggcctgcccaggaaggcttctagaactcttaagagaatgctttatagacggattcaattaatagggatcttcttaaggacagtgtcccaaagtagcatctcaagttaaagaaatatcatcaggaggaggtatatggttatggcttttgtctgattgagcaacttataatttaatacataagaaacatacaaagtttttaaaggaatgcttatagtttggctaaaagtgatagaaacagtacaaaatgaaaagaggttgttgaacctccaacctactgtgagaaggcagcaggtggagaaacttgcttaatgaaaaacacaaatatgtgtctctggaaaagaggtaatgactcaaacagaagaatcaagagctcagagaatcatctccaggaagctgaactgagttaaaaacaagaaactggcaatacgtgttctgctggatttcataattgctatgaacaaatgactgctgtgtattttgtgtttccttacttttcgaatgggagtgtctattgccattatcctatgtcattttatgttggatgtatatatggggtgcagataatttgtttctttagttaataggtttttatttcaagatgaactatattcaaggagctgtacctgaggaagtacactcaggaaccccatctatatcctgacccgatttaaataatggggtctggacttcgaacaaataccataatgggatgaggtttttgagggtcttggaagatggtgagtatattttgcatgtgggattgcaatatatttttgggttaagagggtggacattgtagcttgtctcaatagtagctgccattatttttttccctacttgttcacacatgtcataccccagtgaaagaggaagtctatttatcttaatgtcttggatgtgggcttgactaacagaatgtgatgaaagtgacattctaggcattgaagctttcacctgtttctcttggaaagcttgttttggaaaaaaccagctttcacataagaagtccaactaatctgttaccttcatgttttgagatgagaaagaagccttctcctggagagagagaagtcaggtagaaccaaggtactaggcatgtgagttaagaaaatattttagaattttatccccaaccccagctgccagagctaatgcccatgaatcaaagaaaaaaacatccagctatgcactttccaaattctccccctacaaaattgtgagtaaaataaaatggctgtttaaagccattacactttgaagtcacatgttacacaatatacaactcttaagtaaaccaaacacaactatactatcatttcaggattcatttataattctgaagtacttttggcaataattagttttctggtgggaaaatattatgtttacaagttggagtcttaaatgtagttgatagaaatatagagatcgcaaattttgacattagattggaaacttaaattgaggcctgatttagattatacataaagtatctatatgcataatccttaaaaatatgatgtaatctatataacactattctcttcacagagcaccccaactgcaaaagcactcttgctgtatgcactgatcattcaaatcccatcacaatttctatctcctttgaaataaacatagctaggattctggctttcaacattcctttcccattcacctactcctctcatcttcaacactttccaatcttcccctaaaggatcagtttacttacagaaaactggaatcaacaaaagaaccactagacagcttaacatttgagaggactagctctttctttgactttctgccttcactccagtaactgtttttctcccttgtgatttatgcctctccagaatctaatttctgtaaaatatctgcgtgcttgtgcttctaccattttttgttgctcaattgctcaaaaaatatgtttcttacctatttcaacatgtgtgtaagatctactgctgaatctacctgatattaatttttcttacagagacaataaagctttaagtttgtaagtttttagacagtttggtaagacgttattcttaaaactcttttgaaaaactaactccacatttgtgtgtctgtcatctccaagactagtcaatccctgcctatcacattttcccaaagaggagatggtcatttgaacagactgctttctctcttctataacactgcatgaattacttctattaccttattttttacctattttaaatttatatcatgatctatattttgactcatctttacttaatataaaatgttaatcatttaattatattgggagtacccttgaggcaataatagattcttatctttttatggaagtggttttaaaaaattgtagaaataaaaaggtggttttcaacaaatagtataaataagattaactccgagatttattctatgggtctgagatgaggctaagaatctgcatttcacttactttaggattccaattgtttctggtgcagatggccaaagactatacaacaaaatgctgctttagacaatagggatgtgatttaagacaatttcctatagtaatgtaaggcagcgagtgactaaagggcagagtccagttagaaaacctttgcagaagtccagagaagatatcaggagagggctgatctacacagaagcattagcaatagaaaggaggggacagatggaagctaaactagctattaacaagttcctgaaactgttttctattaaagctgccttagaaaatgaaaatgtactgtgtaagcactaaaacaaacacaaccaaaaagatgttttcttaactgggaaattatgatgtgcagttatgtttggtatctaaatgcaaattttgcatgtaggctgcatttatggaagaactgaaaacaaccacaatacactatatcatagtagaaacaaaacagactagctgtacttggcatagtaatgataagccctttaaattaaatctttatgcagattctattttatactccaaacttttcatggagccttgtgtaattctgatgtgtaaaccaacaaacagagaggctctgtgtatggagtagctggtttggataccagctggcttggctgtgcgcctttctaatggtaatgaagtcacacagctgctaggacaatcagctggagttcagattgtcactagctaaatggatatccattgactagcttcttatccggactcattaaagtttagtattgacaaatagtggctggaggtttacaactaagaggcatgtagaaatgaacttgttgactattttttccctatagcttttgctttgtgattcacagaatgtcattcatctgcttgagatgcatgattactaatgcactgtaaaattttaagcactcttctgcttataattttcaaagtgaatgaatgttctgaagcaagtagtcacaggcatcaataagttgtcagtatatgaaaacacaaagaacaatcagaaagtactatttttctttaaaacaaataaaaagaaggtatgatttgcacaaaaagtttataacttgaggttgatttttattttaaatattcttataggtattttactggataatttctaagagttgactgcatctacactagtcaacatgccactaaatactagatgatttcttttaaccaagcaaattggatagataagaatagtcactggtaattttgttaattcgatagtcatctcttgaacatgctaacacttttccaaatcctcaaaggaacaagagccagaaatcaacacctgttgggtcagaagtgaagaataagccttcatgttgataaagctctacggtgctatctcttaacccctggcctcactgaaggcatagagcttagatataatgttccattccttgtcctcatatcctatgcagtttgtgttcttaagaacatgttttgtcttgtttcaagaatagactaaacttggccagctgcagtggcttacacctgtaatcctaccactttggtaggccaaggctggcagatcaactgaaatcaggagtttgagactagcctggccaacacagtgaaaccccatctctactaaaaatacaaaaattagctgggcgtgttggcacacatgctaatcccagctactcaggaggctgaggccagagaattggttgagcccaggaggcagaggttgcagtgagcagagattgtgccactgcagcccagtctgggagacagagtgagactccgtctcgaaaaaaaaaaaaagaaaaagaaaaaataaattcaaacttacttccccactcattgtcattacagactcacttctacctttcacaactttgctgccttgtgaaggttttgaaaacactggatccatgctacccatgttttgcctccaaagaccaatgtaaaattgcctcctgactgtgtgtgtgtataattatctgccttagactatgatgacacctttaggctctttgtgaactagaaaaataaaaagttagcagaccttcctcaagaagatatggaagtagaaaatgctagagcaatacaaaatgtgaatgacgctcaaacgccagtaatttgcttctttaccatgtcctcatgtgtaaattctctttccctttccttgatctacaggacacttgcttactttccaggtctctttcctgtggattccaaaggcagggcaacattcttccattgtcagtagtgtaataaaaaatgttctcatttttattcatacccagatttttttttataattctgcctaatatcgtcaagtgtaagtaatacaaagcaggcctatggcattcattgttaaatgtatactctctagctcacaatgtgaaccacaaaaaataatccagttgtggattccagctgtttctagtgcaaatggccaaagactacaacaaaacacttcactagacacgatgactaaccactcttcctggtaactcagaataaagattttggcaaaattttctgattagagtataaaatttcatgcctcccacaaatcaatagatgtaaactcacccacataaaggatgttgtcttgactcaacagagcaagcttagtgcaagtccagaccttcatatgatgtaaaagtttttgtaaggcaaaatggaaaattcctacagttaaaaacttttgcttaatcatgttttaaacttcttaaagagaaaaaaatagactatgtagctataaaacatttattaaaaaaaggtagacaatatgcaaataaagtttctgtacactggcagagaactgtaccaggatttagacggcctggctaactctgggaactcaagcaagtcatttaatctctcttgatttgataagcaaaataagagttttgatttcatgaattcattcattcattcacaaaacaaagatgtgccatagattcagcaaggcactggaaaattggagagccacgcactaacctctgagggcagcatacctggaatccctagagtccctgccagtccaggatactataagtgggtgaatagagatatcattccttggaattttccacacaaaaaagaacaatgactgctgatattctctgctatggctaaggctgctggtactccttgataccctgtaatttgctgtcttttccagcaagttgaccattgattagctctggccagtggattgtaagtagaagtcatatatatcaattctggcccacagtagttatgtatcaagagttccattttttgccctcttttctattccatgtgcaggctggatgatgccaaggtgacatacaaatttgtattcacattgtgaggacaaatatggcagaggcactagctgcaagtgcctgatgtctgggttatttaaaagagagcagcctgactgatagacaagatataacacaataacttctattgtgttaagccatagagatttgaaggcctgcttgttgttgcagcataacctagcctagtgtgcttaactcaaacaactatatattattataaacctcactcaatgacatctaaaattaagagcaatgtattttttgatgctttttatggcaattcagaatctagtatcttattcactgggcatcataaattaaaattagtatttagattctgatattttctatagggcatattgccagttttaatgaaatacttaactcccctgagcatactgtcagaaatgctccaaaaattctttaatgtgccgtgtgaaagtctcaatggtctcttactaatcaacattataatggaaaatacacatactagttaataattaaatatgtcaaaccataaagtatatgaagatattttcattttgtattacactttgcacagaaaatttcacagtgttctcattttttactgctgttaggaggtatctgtgatttccatttcttctttcaccctttcttttcaggtatccagggagggccatatgttgaaccaatgtgataccccctgaagcaggctttcctcattagtatgctacgtcttgcagcattctatgtactatctatcgaaattccactatgttggcacaggtctgaccaacttgcaagtaggcacaatgccaaacatgcagatggcaggaggggaaagagccaaaaaaacacgtgagtcaactgtgggtactgatggcaaaattcccagaaatgcaggtccaaacacttgtccatcctaagcttatagtacatacttacagagacacagatttgtcaacaataatctagcactgagttagatcaattatttaaaatattttaaatctacttttggctactgtgggtaacaacaaggcaatgattcaacaaaggttggtgtttagtctttcgtctttacccagatgacttctcaatagacaatcaggcggcatatttaaacaattatttctacctatattagttatgaataaaggagaaacgtgcatcttgtctttatttatataaactatataattaaaacacaagaaaaatattaagacactatacactgagactaaatactgttagcacagtagggctcaaattgtggctctattaaatattcttccttgacctcttctgcctgcttgatcaaaaaaatttattgtgttttataaactagtaaacttcattatcaggactggatctgtgaacgcataaaatgaatagtacctgatttgaagatctttaaaaggctcattcatttaaataacccattttctgctgttttggcagtttgcctgaaatgtctcaaattattgccacttaggttaagctattgtatctcctgaaggtgttgattttagaaggaaaacattttattgagaaaagaataaaattaggttttgaatatataggtaggatgaagtttaatcattgcagtaaatgctccttagcaactactgtaaaaggctcccagaatctctacaccttacttttgagctttaataaggacaattcctattaaatcagttttagggagagcatctgttagataagttgatactgaacttctagaggtaaggttgaaaatactttgaaaattaatttgtggtatagatgacctatttaatatgtttctcaatgagtcatataatttagtcatgtctcttgaccccagatctagtgtttttgttactatactatcattctgacgttttacagaattgaattggttcatttatataagcattttcagtttaaggtatatgtaggaacatcacattcattcttcaagtgagtattttatgaacaatgtcatataaatttagaattttaatctagcatgaagaaaacaatttgccctttcaaaagtgagtctttacatcctgccacatttccagaaattacttaaattccagcatttagtacacatgacatttggtctctcttttgattggacaccatactgccatttatgttttgattcctggtcaatttatgtctattgcctacaggtatagcttgtataccaaacactgaaggcatataggaatacctcagagatattgagggttcagttctagaacaccacaataaagctaatactgtgggaaagagagtttctggggtgccagttgagttggtctcccctgtgtgagacacccatggggagccatgggtggcctctgaagagaaaagtctccctattgccttcatgtctttatgcccggagagaataaccactcagcggcatgccacaggttgctcagggagataacactcccttgaagcagtggagtataatcaaacatcttggctcctcctgaaacccactcccacccatttcagtcctgataagttaaagatcttaagtagtttagacacatgcctttgctcaaggaaattcacagaaaccgccactgctatacatcttattgaatgactcacgagttctccttcacatattaatccttttcctcatcggttcctccccctctcatctgccctaagaacaaagggcttataaaccaataaatcgggcagagcccgagagctctgggccgtgagcaagcctccgacgctctggtcccctggacccgccttttaaaagcttattctgtctctttctaactcctttgtctccgccagactcggggtacctgctgggtggtgtggggctggtttccccaacaaatccagtaggaaagtgagtcacacaaaattttctatttcccactgcaaataaaagttataatcacttggccaggcatggtggctcgcctataatccccgcacattgggaggccgaggcgggctggtcatgaggtcaggagatggagaccatcctggctgacacggtgaaaccccgtctctactaaaaaatagaaaaaattagcccggcgtggcggcgggcgcctgtagtcccagctactcgggaggctgaggcggggatcttgtctcaatgctgaggctgttgaccaatcagggtggtggttgctgaaggctggggtggctgtggcaatttcttaaagtaagacaacaatcaagtttgccacatccattgccacctcctttcaaaaatgatttctctgcagcatttgatgctgtgtgatagcattttatccacaggagatctttcaaaactggggtcagtcttcttaaatcttgctgctgctttaccaactaagttttcgtaatagtctacatcctttgttggcatttcaacaatgttcacagtatctttactaggagtgcattccatcccaagaaaccactttttttggctcatccataagaaccaactccccattcattcattttttcatgacattgcagttattcagtcacatcttcaggctccatttcttattcttgctatttctaccacgtatgcagttacttcctccactgaagtcttgagcccctcagagtcatacatgagggttggcatcaacttcttacaaactcctgttactgtcagtattttgacctcctcccaagaatcataaatgtccttaatagcatctagaatggcaaatcctttccagaaaggtgtacttttcccaggtccatttgatgaatcactatctatgacagctatagccttacaaaatgtatttcttaaataataagatgtgaaagtaaaattactccttgatccatggcttgcagaatgaatgttgtgttagcaggcataaaaacattaatctccttgtatacctccatcagagctcttgggtaactaggtacattgcaaatgaatcataatattttgaaaggaatcttattttctgagcagtaggtctcaacagtaggatgaaaatattcagtaaacaatgctgtaaacaaacgtgcttctattctggctttgttattccatttatattgcacagttagagtagattttgagatgattattaagggtcctaggatcttcagaatggtcaatgagcactggcttcatcttaaagtcaccaactgcattagctcctaacaaaagtcagccagtcctttgaagctttgaagccatgtactggcctcttttctctagccatgaaagtcctagatagcatcttcttcagtaaaagtctgttttgtctacattgaaaatctgttgcttagtgtacaccttcatcaatttagctaaatcgccaaatcttctggataacttgctgcagcttctctgtcagcacttgcttgctgtgtcaccttgtactttaaagctctggagatggcttctttccttaaaactcaagaaccaacctatgctagcttccaacttttcttctgcagcttcctcacctctcttagccttcatagaactgaagagagttagggtcttgctctgaattaggatttgacttaaggaaatgtagctagtttgatcttctgtccagaccactaaaacttgctccatatcagtaataaggctgtttcactttcacttcatagttcatgggagtaacccttttaattcctttcaagaacatttccttttcattcacaacttgaataactgtttggctcaagcggcttagctttcagtatctcttggctttcaaaatgccttcctcactcagcttaatcatttttagcttttgatagaaagtgacagatatgcaactcttcctttcacttgaatacttagaggccacggtagggttattaatagcctaatttcaatattgtgtctcagggaacagggaggcccgagaagaaggcgaaacagaggaatggctgcagcttctccatcagcagtcagcgaagaagtcagaatgcagaattgatgaggttcactctcttttatgggtgcatttgtggtattcccaaacaatgacaacagtaacatcaaagattacttatcacaaatcaccaaagcagatataataatgaaaatatttgaaatattgcaagaattaccaaaaagtgacagaaacataaagtgatcacatgcatttaaaaaaatggtgctgatagatttgctcaaaatagggttgccatagaccttcaatttataaaaagcacagtgtctgtaaagtgcaataaagcagagcacaataaaatgaggtatgcttgtacttcagaacaacaccagcatacttatgtttgcaaaacatgaaacacaatcatagaagctgatgtttgagaaatccacgttatttttaccttctttacaagatggaattattgggtttcatttgattaccaagaaggattttaataagttatacataatcaatgactatccaaagagtagaattttctctatcagaactatgtttttcttgtagtatattaacatgttaagagatagccttactcttaaagttcaacttgtacatcagatagattaaaatgtcattagcttgctggaatgctctttctataatctcttcctgacaactcagtcttttattttcttttttaatttttcttaaatcattcctatagacgtctcaggttttagaatctgacttccagccattgagaaaacaaagaaactagtatggtagtgtatggttttctcaaattataattaaggtgtacatataaaaattttaacacctttttttctctactaaatgtgattagaaggctccctgtcccttatatattatagaactcaattataacacagcttattattatacaggttttgaaacaccagaaattataaaatctccctcagacaaagtttacacaccaaaacctgaaagagcttatttgaactaaacgaggaggttttgctttatgatcattcattttactctcttctatattccttccttccttcaatcatgtggtcatttattcattcaccaagtaattgttgaaaatttactacatgtcaagaactggggcagatacaaagaagatatggcatgtagccaaaagaaaattcctccttggtacaaggttcagaattgaaaagattatataatttctgtaatgaatacgtgaaaggagatgaggttttcattcaaggtagaaaatgacatccattataaaagtgctattaataacagccttttaatatttaaaagagaagagtgattaagacagaacccatactttattattctatcttctacatgtattaagtaggtttgaccatattcaggtgtattacatataattaagaataaagctaaaagttctctttttttaatccatatgggacacagtagatggctgtgcctattttaagctatcatatttatgtaaacagcttaacttgccttttctgagtgtaaatttgttgtgtattttgcactttctcatcaaattaaaatgacttagttatgtgagctcaatcacataatacctttgagagtttattcattcaactttaagacagtcaaacagtctcattctgggagcaattagcactcagataattattacctatattttcatactatgtcaacagaatgattttattaaaacaaaattttttaatacatctattgcattttgggcactatagttgaaggtcatttttaaacaagagcagtgtcaaattttacactaaaatataaataaaacaatattttattactagattgtgaatgtctttatatgtaggaactatatgttgttcatctttgtatactccctaggatgtagaataatgtttagttaaagcagaaagttaaaaagtgtagaattaaattaaaataatgagcatatggattgttttctaaatataaaaatgttttatctagttgtaatgttctactagttactaactagttaaaatgttctaccttttattttataccaaaatttgctggtattgcttttggtctactgacatttctagcatttaattaccacaaaagcaatctgattcttttttaacatgttactttttttatcaatgtaaattaaaatcttaaaatccataagataaatgataaatgttaaacatctataaaatgccaatggaaaccctactaattaacttgagaactgatttgattttgggtaccacttaaatcacaaggcttttatagttctatccaatgaaattatttttataatctctttctaaattgtgatatacatttttaaaaatatttgattttcttgttgaaccatgatgatacatttccccccaaaatacataaaaagttgaatagactgctgtcttcaaaattaaacatttagttcagaattgacaatgaaagcatatatatgaggatcatttttccaccttgaaataatcttttgaaaaataggatattaacttgactttcctcaaagctacttacaagtagaactctagaataatcagttgcattatttggacaatatgtagatattttcagcttttacttttacttgcacccaatagaattttattgtaactgcaaataattgtttattgacagatttgaatatataatttaatatggatgggtaacttaattataaaaccagcatggaattaaatatttctgttattaagacagatgctcatcagaatcacatatattgagatcttatttgtatcaaatacagatatttttatttttatcttgtatcaaatatagtaataaaatgaatgttctcaattaattgtttcaacaaccttatgagaaagatgccattagtgtcccattttaaaaaaaggaggccaggtacagtggctcacacctgtaatctcaacacattgggaggctgagacaggaggactgcttgagcccaggagtttaagatcagcctgagcaacatagggagaccacaactctagggaaaaaaagaaattggccagtggtagtccgcagtcctagttactcaggagcctgaggtgggaggatcacttgaacccaggaggtcaaggctatagtgagcctgcatgacagagtgagaacctgtctcaaaacaaaaacaaaaacaaataacaaataaaagaaaaggaaactaagggttagtggcctcaagatctccaactcagagctgagacgttctctgaataatgcatatttcttaactaacaattgttaggtttagagggttagaaagagttgattaacaaatatcaaaatcaaataaaaataaaaagtagaaacacattatgacatcaatatattatttcattatttttcctaaattagcaattgtagaaaaattacacaatatctctgaggaaatggattatggcagattctgtgattatttgccaggaaaacatgaaatcagtgataactgtatttgagatctcataataaggaaaaaagttgtttgcattgagatggattgtatctctgatgtccttgactggcagaccaaacactttttccctgctgttacaaataagtcagaaactgaatcaaacaatctaacatgtttaataattaaaatatattaaactacgttttcatttgcctactaaagttggatatcaacagatttcaaaaagagatttaggcacctcatccaaaaatgtataaatcaaggaaaagaaaaaatcaataaatttcacattttaagtgttcaataccaaagtatttattcagcactgttgtaatctgacaaactcaaccttctgtctttgtcatctagaaatagaaccttcatcactaaattatttgaataatcaccttgactatttttcttaaaactacttggattatacgtaaataatgtagttattacagaactataagaggacttctcattccaaattgctactttagaagagttagattttatttattttttgagagaaaggtcttgctctgttgcctaggctggagtgcagtggcaagctcatgactctctgcagccttgacctcctaagctcaagcgatcctcctgcctcagcctcttcagtagctggaactacaggtatgtaccaccaccaccacctggctaatttgtttatttttggggggatggggttttgccatgttgcccaggctggtctcatactcctgagctcaagcaatctgcccaccttggcctcccaaagtgctaggattacaggcatgagccactgtgctcagccatatttttaaagaaaaacaatttttcatatctcaagtaaactaaacaatgtattactctagttatgagtaatatgttgttggaattctcagcaaatgaaacaaaaaagtaaactttaaagaagtacatatttaaacaaagtcattgaacaaagacaaaaaatatgtctataaaaatcaaatatccactctctcccagtgccatttgtaacaatactgttaatactttcttgcctagttgaagggttcaatgtactttccaaaatctgtaatttgcattcataatttggaattaagttgaagatctgatctggaataagccattcacatagtaaagatgagtgaagaaagctgtgtggttcagaggcacactgaagaagagcccatcctctctcaagggaaatctggtgccctgcttcagttcaacactgccatgcaagaaagatgtgagggaagttatatttctaggcattttattctttttgtggccattatgaatgggattgcattcttgatttggcttcagcttgaacgttgttggtgtatgggaatgctactaatttttatacattgattttgtatcctgaaacttagccgaagtagtatatcagatcaaggagcttttaggcagagactatgcaatggaaatcacacaatactgctcaaagaaatcagagataacacatccatgctcatggacaggaagagacaatattgttcagatggccatactgcccaaagcaacttacagattcaatactattcctatcaaactaactatgaattcttcatggaattagaaaaaaaaaattttaaattcatacagaaccaaaaaagaaccttaatagtcaagttgatcctaagcaaaaggaacaaagctggaggtgtcacattacccaactttaaactattctacaaagccacagtaacccaatccgcatggtactgctacaaaaacgaacacatatagaaatggaatgaaaatagagatctcagaaataaggccatgcacctacaaccgtctgatcttcaacaaagctgacaaaaacaagcgatagggaaagaattccccattcaataaatggtgctggaataactgactagccatatgcagaagatcgaaactggaccctttccttataccacatacaaaaatcaactcaagatagattaaagacttaaatgcaaaacctaaaactataaaaaccatggaagacagcctagggaataccattctggacataagatttggcaaagatttcacaacgaagacaccacaagcaattgcaaaaagaaaaaaaaaacccaaaaattaacaaatgggacctaatcaaactaaagagcttctgcacagcaaaagaaactatcaatagagtaacaacctacagattggaaaaagcttttgtaaactatgcatctgaaaaaagtctaatttccagaatctaccagaaatttaaacaaatttacaaggaaaaaacaaaacacctcattaaaaagtgggcaaaaaacatgaatggacactgcaaaagaagacatacacacagccaacaagcatataaaaaaggcccaaaatcaataatcattaaagaaatgaaaatcaaaatcacaatgagataccatcccataccagtcagaatggctatcattaaaaagtaaaaaaaagtaacagatgctggcgaggttgtggagaaaagggaacacttatacactgcaggtgggaatgtaaatgagttcagccattgtggaaagcagtttggcaatttctaaaagaacttaaagcagaattatcacttgacccagcaatcccattctggggtatacgcccaaagggatattaataattctgccataaagacacatgcacgcatatgttcattacagcactattcacaatagcaaagacatggaatcaacctaaatgcctatcagtggtagtctgggtaaacaaaatgtggtacatatacactatggaatactatgcagccataaaaaagaatgggattatgtcctttgcagcagcatggatggaactagaggccattatcctcagcaaactaacacatgaccagaaaacaaaataatgcttgttttcacttataagtgggactaaacatcaagtacgtatgaacacagagaaaagaataacagacactgggaactctttgagggtgaagattaagaggagggtaaggatcgcaaaactacctattgggtactgtgcttattacctgggtagcaaaataatctgtatatcaaacccccatgacacacaacacataatttacctatatagcaaacctgcccatgtacccctgaacctaaaagttaaaaaaaaaagatgagaggagtactgccacatcttgtgattctttaagagatacgtgaactttaaaactttgtgtgtaatatataatacttctatttaaaaatatttgccaatctcacattaaaaaataagtttttggcttctgaggactcaggagataagagttgttccccagaaaagagagaattctactactataggaatttataggaatgtggctcttaaattttagcatatacctccatcacccagggcatttggctcctggggactcaggagataagaattgttcccaagaacagagagaattctattactataggaatttataggaatgtggctcttcaattttagcacataccacaatcacccagagcttgttaaaatacagattctttgggtcctttccttgacatttggattcagtaggtatgggatagggtcagagaatttgcatttccaagttcccaggtgattgtgatgctgctgttccaggggccatactttgagaatcactgacccactttggtcataatttgaaaaaccctacacacggagttttttcatttaaataaaaggaataaattatgagccactattaactttttaaacaattttattgatgttaatgtatgtatcataaaattcactcattgaaaatacacaattcaatattttttggtaaatattttatagagttgtgtaactataccaaaattccattttagagctaaaattcagagctacaattttttttccaaatctgtttgcaatcaatctctcctctgaccaccagcctcaggcaacctctgatataaatttttttctgtataaatgggtttgttctgctttgttttacataaatggaacatacatgcaatctttccatccagcttccttcacttactatgatgcttgtgaggttctaccatgttatagcacatagcaatattttgtttcttttaactgcaaactaaattttacaggtaaactgcattttgtttgtccattcaccagtttatgggcttatgaattttcccagtttttggctataaagaataatgtcgatatgaatattacatacaactatttcaatgagcataaattttcatttttgggaggtatatttctaggtgtagaattaacttcttaagaaacttccaaactgctaaagtagttgtttcattttatctactggaaactagtggaggttccaggtattggacatactcaccaacactgggtactgtatggttttttgattacagccttctcagtgggcatgtagtgatatatctttgtaattttaatttgcatttctttaattattaataatgttgatcacatcttcattttcttattagcatttataaaaaatcttttgtgaaatgtctgtttaagtaattagtctactttttaaattggattgtttctcattattattattggagagagatatttatataatctgggttcaagtcctttatcagatatatgatttacaaatacttttccactctggcttatctttccattttcttaatggtatcttttaaagaacaaatagttttaattttatcagattccaatttatcttattttttatttatgggtctttcaatataatgtctaaagacaccccgcctaacccaaagacacaaaagatttcctcatattttttccagaagtgttatagttttagaacttattagtattattgacttttatcttttttcctattttttttttttttttgcaggaggcagcctaactggattttgtcggttttcttatcttataaaaaaactagtctttggtttcattcattttctctactatttttcaactttatatttcattgatttgtgttctaatgtttattattttcttccttctgctttagatttagtttgcttttctttttatgatttttaaggtataaacttaggttactaaggcctttttttctcttctactacaggcatttacatctataaatgttcctctaaaccctgctttagctaccttgcataaagttttgtatgttagagttaaattttcattcaggtaaaaatatgttttattcttctttgtggttttttttgatccatgagagattcaaagtatatttatttaatttttactctttgttgttttcccagatttttttctgttgtgaatttttaataaaattttgtcatggtcagagcaacacctagtatgatgtcagtctttttatattcattgagacttgttttgtgaaacagtaaatggtttctaatagaaaatgttccacaagtgcttgaacagaatgtgcgttctgcattcatttggtagggtgtttaatagaagtcgataaatgccagcaatggaatatttgtcattttttaatctgggaaggtctgtcctcagagatcttcattattaaatgattctattgatgaccacactattatgttcatccaatttcatcatcattagaccataatattgctgaacatactattcctatatgagaggggttttttctttcagccctttgaatatgttattccactatcttttggcctttgttgtttctgattagatgtcaggaatttttttgtattgtcctttacctgtatgtaaagagttatttttatgttgctgccttcaaactctgtgtgttgtatgtaatattttcgtttaacaacatttgccaaatgcacattaaaacaatgtactggtacaaaaatagaagcatagaccaatggaacagaatagagagcccagaagtaaggctgcacacctacaaccatttgacctttacaaaaattgacaaaaacaagcaatagagaaacaactcactattcaaaaaatggtgctggaataactggctagccattttcactttctctttgtctttccacagtttgactcagcgtatcctggtgcagatcacttgatatttatcttatttgtggttggttgattttagagtgctgtagattaatgtattacatcaagtttgagaaactttcaaacattatattctttttttctgacaccgcagacctgctgttgagccactctagtgaatttttatatttttccgttattgtactttttcatttccataattcccagttgtttaatttaaagtaattgttatatcttttttgaaattatctcttcagtgagttattttcatggatccctttaattctttgaacaatttttatttttaaaacacatttataatgactgttttgataacaacatctatgttttaacatctgggaaaattcagaaactatttatactgactgcttttgttcctcagtatgagtcacacgttcttatttctttgcatatctcataattttctgttgaatattgaactttttatgcaacataacaactcttgatttttactttctcttcttaagatgtatattttttttggcttgttatttattttgtaattttgcctggactaaatctgtgaagtctgccttttcactgtgtatgacctgcaatgcagacctcttctacttttgctttttcttattctttatttttaagctttgcgtcctaagggtgtggtagtgtgttgctgttacacatagcttagcgttcacccaaagattggtcagagttgtgcttaccaccttggttattaagtgtttcattttttgctgatagatatatatgtggcctaaacagaacatttacattttagattacatttgaagtttttccaggcttttactttacataaggctttctgacatctttgtcgcacatgcatagataggctttaaaggcccaggaggtgtgggtagcttgggcctgttgtgttctctgttgttcatgcacataaactccagtcaacctgagatatatgcggcgtttatcaagccatctttgactgtccaacctcccaaaaatgtctgtcaaatccttggctagtccactgatgcactgaatgcaccatataaatgtgcacactcatactaacgaaattgccacccttcctgttctcttgcaactgagatggccacttaaactggtgatactccaaatcaaacgagccctttcggcagtggcagcaagccctgccctgtcctggttgaactaccatattgacacaactggaaagggggtggatgggagcatgcccaggaaaaaatgccatggtcttacaactgaagttcatgcattttattcataaacacttagttggttttatgcctttggttgaattctggagcaaagaattacttgtttttgacaagtttgtccagctttacagttttttggggaaagaatttgtcagcttctcactttgtcatgccttccattgactttcgactgcttgatttatacaaaattatttaaaaataacaaaagtttagatagagaaatatatggtattcttatacagataaaagaactgagacaagaaagcatacggaattggcctagtttttcactaaaagttaatgaccaagttgaatgtaaacccaactttttgattaacagtcccatattatctatggcctgatattttctgaggccagaggattcaaaagtatacttcacagttcatagctgttggttataaaataaaaggtaaatattaataacaggaagctgtgaaccaagattaaatggatgttagatatatttttaaactatggttttaagtagatttccttcctaaataataacttctctttgaaagcatatttaaaagtgaaaacttttctcggcagtcataatttatctaaaaaccactttattttgacaccatctcctttgaagaaggcatcatggagaccacctatgaaaagagactaccttttccttgttcatgaaagctgtttcaaaatgaaatgactacattatttccaatagctggtatgagccatagccatgcatgctccctcaggtgcagccttcttaactggctgaaaaataggtcagtgctctacattgaagaactgtttccttcttatagttcagtcaacagcctacagtatagtcttccatacagtaagctcaggatctcaggatatttgtgctaaaattatactccaatcaaggccacacataaaacataaatgcttttatattgtaacataatctgaataatatcaataaaatagtcatatattatcttgtttggaaattgttatataatacaaacgtatataatacaatgtattctattataaatataatattatctgtaaacaataatgaggtatatggaatcaaattgctgctgaatatgtttcatggggaacattgtgtgttgtagtagaaagagcttaagttttagagtcagacatatcagtgtttgaatcctaactctattacttaatagctatgtgatttaatgttatttactctctctttgctaaaccctagtcatcttattgaggggttacagtgttatgtttctgcaatgactaaatggttatactatatagagaacaccaatctgacctatagaccagtgctaatactgctcattgctgtgcatttcccagctctggatcgagacacacgggcatatcaaatcagctgataattttggatcttctccaactgatgttttagaaatgtttgtttaacatatatttaacgaatactgagaaactcattgtctaatgtttgtattttatatttattgtgttatattcagaatataagacatatttcatattctaaaaatttcttagatgatacaccaagagtttaaatttgaaaaaaaaatctactgctcctggaaaagagtattcataaggaattggtttcagcttctttctctctccgggattaggtaactgctaccattccttgcttcagatcaatagagtggtagaagaataccttttcctagatacttgccaggctactgaactatcccccgtctcttgggctatcttcaaaccctgcttacaccttgagacatagtctgttcattaaactattctttaaataatcctaattcaggccaggcgcagtggctcatgcctgtaatcccaggactttgggaggccaaggcgggtggagcacctgaggtcaggagtttgagaccagcctgaacaatatgacaaaaccctgtccctactaaaaatagaaaagtcagctgggcatggtggtatgtgcctgtagtcccagccattcgggaggctgaggtggtagaatctcttgagcctgggaggcagaagttgcagtgagtggagatcgcaccactgcactccagcatggatgacagagtgaagactctgtctcaaaaaaaaaaaaaaaaagattctaatttaaatgtgccatctctttcctgataagaccacgaaaatactaaaaaattactgttaattttgtgagatatgatgaaagatggtcatatatcatgtataatgaataaaaagccccatcactgaaatacatacacactaaaatatttgtaggaaaaatggcctaatttctgcaatatatataaaaacttggggtgggaagaataaaattgacacactgttgatcatgattgaagctgtgtgatgagtacatgtagtcatcctagatttctctccatcttgtggcatcattgaaggcttccataataaaaagtttgggatttttttttgaactattggtactttgaacccctttgataaattatttttaattatgatctctggtttggtaaccctgtcatgaacccaaatggaacaaccatttctacgataagtaagtcactgttttctcttttatccattctgtagccctgatctgaacaatgctctccctattccagttgaaaacttctttgtgcatgatcccaaacttcatcttcatttgtcccagggaagctgaaagatgcatatgtgaccttagttgcagattaaaaatgaaatattcttagtttgagttagacttttctggaaacaagaatgactgttctggaaattatactcttttgtcatatttataccatcttgaaaagagtgttatcaagttgtccccactaagcagcaaggaaagaatcattctgcccaacaagggattctctcttgttagactaatgattgggtacatgtccttagcaggtcacttaagtaacttgctctaatgacctttaaattagagacataacactgttgacagtagtcaagatatgatgatccagttactgacaattaaatacttgacaagtagtcaagatatgatgccagttacattgacaataaaaaaaaagtagaaaaagtaaaagttttatttgtgtaatagaaaaattttgttttggtcttttttattatttgttcgggtaactagaaattcaaaatattttccagtacttattaatgcgttgtcatcattacattggacccacaaagttaaattgtgaagtaaaggaacaatatttgaagaaatatagcattggaaatggaaggcttaaaatttttaagtcagtaatgatttagtatgacattttacatatgctgaaaaatatgtgcacattctcaaaaagctaaacaaactaatttctatattatattttatgtaacattagtttttcaaattcaatcacatgtaaatattttcccaaaagagtattttcttcacttgtctgtggtttaaataatttcaaggaaaaaaatgaacattctactggaattccatgtgattaattatatactatcaaggtcaattcagtgtgcactcattcatttaaatcaggttttttaaaacctcactgcaatggacagtctgagccggattcttcgttgttgtggggggctatacagtattgcacattacaagatgtttggcaatatccctggtctgtactcataagataccagtagcactcccaccctcaagttgtgacaataaaaaatgtctctgaacattgccagagatctccctgggggcgaaatcaactccactgagaacctgtgtttcaaagcaatgagttctgtattacatctgcctaaattttaattactttccaaaagattacagctcaaacaatgggaagagtcaacaaataaaaagaaataaaagattttgagaaaggcattgtgataagagatagcttttccaaataaaaacacctttaagagtaaatattttaaaaaataatatgtggttaatgtaaagatatgtaagagagtgccatagtgaactgatatttaaaaactcaagttgcttacaaaatcgtggacatgataggatatcaaacaatgcattttcatcagactgattttgatctgtgcatctaatgcagttcgtaatagagaaagaatgaattctaaacctccatacatacaaaccaaaattacacacacgccacacacagacacacacacattgatgtgagtgtgtgaacttagcagttcacctatttcggccaccattttccatcaaatcttcatgttaaatctggttgtgtgaagatctaattgggtttacacctatatgcttacaaatcctactagtaatatgtttaattcatttatttagctttcaggaacctctattttatgctaaatatcctcagcatttatattcaatggtggtgtaacactactttgaatttactgtcatatttcagcatcgatttctggttgctttctttcatctctgcaactgcatagttagtccagttgggtcaccaggtcttgcctactattaagtgttatgcctataattgaaaagtcattaaagcaagttacttaaatgatttgccaaggatatgtatccaatcattagtccaatgacagataatcttttattggaaacagttcatgggttggcattatccactgtatacagaacagaattgggaatttatttagtaatttgtttagtaaacctagataaatatttgaaaacttatattgagctttcctctgttttgtggtcattttggtagctctatcaaaagctgtgggtattatttttctcattcactggtgaaaaaaggagaaaaatagaataaacatccaaatttctggcataatagcaattctgcaattattatactgaagaacacaccaagaacattagagttagaatggatttcaactgaaaatattctccagatccttatgcatacttgactctatataaatcatttttggaaggttcaaaagaagtgtaggataagattatcctgaagagctataatttttgtcgggtttaagatctatttttccctgttaacatgaatacttccaattttttaatgaaatagaattataatgtttataaaatacaacattgtagaatgaaattacatattttagtaggaaaatagaatcacagaaaaatgatttctaaagcagcaacttttatttaactcccagagtaaaaaactatcaattcttgccatgcaacaactcaataaaaagaaaacgcgctaactatgatcttttgtggaggtgccgagtactggcactaaaaacttctgctatatggaagtaagatggaaatttttagtgtgtgaaccctataccatgtaattttaaatggtttgttagtacccaaaaaagcatctttgggtaaagtgaaataaataccttagagaaaaataacttgctgaaaagtacaagttgatgaatttcataaaatttcaacagtcaatgtaagctctggatcttctgtttttatacatattttgtattcatttgccaagtcaaaaatcttaaaagccagtcaccacaacctccatctaacaggtctttccactgcactgacagctgctctcacctttataaaatagcccattctctcatggagtttttgccctgatgcagactgcagtgacctttctataactgagtcatgaatccctaaacacagagacgaaatcacccacgatgccttacatatggtggtgtgaatgtctacaataattgctctgtaattacatggtaattattgaccatttaagtacatttaagaacagggtgactatgtaatcaaagactaattatctgattatttctgtcttttaaactgtgggcttataagatataaaaattgcaagtaacatggtgattagtcattgaactacatagtaacttgcagcagaattatgaagtaatctgtagaaaatgtatttgtattgtcgtactcctggacagtaattgaagagtagttatatggtaatacacattctatggagtgaaaacagaaaaaaaactatcaagacattatgctaatagagcataaatatgttaaccaaaatattacatgattcattagagcaatatatgaatgggatatatctttcgcaagacaggtaattggtaccttaaattagaatttctatggtttctctataaaatacagaagtgccactgtgccttttaatagttcttataaaattccgttgcatatttctttaaaaaattgctgtgatatgacaaataacttgggcacggacagataaaaggaaggtcaaaaaagatggagttcagaatttggtctactgcactgggattcagtggctaaacccaatcaagggggtagtttaacttcattagcaattactgggacccaagttggagtcgtttacaaaccctcaacattttcttcctaaaataatgaagtaacatgagaagtatatgggtaagtatttacaatgattctgaaacacactaaaaatatttacctaaaatattttaaaagcttctactttaaattagaaaaggagataataaagaagtttcccctaagaattcatttgatgtaggctgaatgtagaaatttcctgaagaaatacagaaatggtggagttttgaagatgggcaagaagagaagggtttggagaaactatggcttaacatgtgtttgttataaaagttgaaaatcaactattttgttgagcagtgatgctaaaaatgagtaacctttaatctttaaagtctatttaaataaataactacttttttcttggtaatatgattaaaaacattaatatgagccctgaaataaagatcatgttgattccatcatgaagtaattataataatattttgtacataataaaggtatggaactctaaaatgaaaaatggattctacatgaaaaatatatcactctacatgaaaaatgtattggagcaatagttataaatcccttacctaaggaatatgaataatttgaccacatctaaagaaatgataatgctctcaaaactaaacttgattactttcaaattctgattatttgacatagtgttaatatcataattttttagtgattttctactttctccaacaggtccatgaaacaaaatacacttttgagtattgttgcatggcttattttggattgtcaatttacattgtttgcctggtatgttccttctctttggaattctacactataataaagtatgaaatcttctcaaatattctcttgtccaattagttagatacaaatacttagtcaagtgaaatgctataagtagtaacttataaagttgttactcttttgacctgagcagctactcataaagtgaaatcaaaatggactggagtagatttatttgatcaggatcgattaattcatgtatcattactgaagtatttcctttgattgagagctcattaaaggtgtctgctttacatcaaaatgtcaataatgcttctaaaatggaaatgccattttattaaggctgtgttttttaaagtaataacttaaaattatttacaattgcttttcaaaaaataaaatttacagtcctaatttttttaaaaaaattatatacactgttttacgaagcatacaaaaagagaaaataatgaaaaactatcatgttctgagttatgcctttggtcatcctgagaaaaggagttaataagtaattaacaaggcttgtcattctgtatatacaataactcatctcaaattgccttctcccttgatcccttttcagaaaaaaaccctgtatggaagtatgattgacctataaatagttttacatgcctcccttgatttcttcttaacttatataaccttcaatttaaaatttatacctcctttataaagaggtgaggcttgaaaattggatcacatatattaaacatgaaacaatgttttaattgagtttaccatacgatattgggatttccatgaaaatacagatgagataaagctacccattatatcgaattcctgaggagatatgtgccatatacaagatatagcaaggtagttcaaactgacttcttgccaatctcacaaagaataattcatgtaacttacaattagactaaatctttcctttgtctctcatttctcccactaattcgttgttcttgtatagaatgtcattttctataagacaaagatgctagcagaaaatgtcatgaatgaatacaaactttatttcccggttcattttatctaggctattttctttacaaaataacttcagaatatatacaatgtaatcaaataacttaaatttaaaccaaaaaaatctataaaatatgaaataccatgataactttagaccatttaatatcatctccaaatattgtcacagacatgttataattacttctacatttctatattagaaaatacacataaagtgcagcttgtttctccaaatacacttatctattccttaaaaatctggtacaccaaagggaatgctgacttttaccacatataatcagtctttcagtagaggctatttcattggacgctataactaaagcaataaagaaaaagagaaataaactgaaagtatctaaattgaaagagaagaaaaaaaacaatgttttctttgaagacaaaaatgatcttgtgtgtagaatattccaattttagagcccaacaaaaacatcactggaatttataaataagtttggcaagggcacaagattcaaaatcaatacagaaaaattaactatttctatatactagcaagtaataatcatacagtaaagtcaaaaaattattccacgtatggtagtttctaagactaaaatatttagaaatgcatttaaccaaagaatggaaacttgcattataagaactaagaaacgttgctgcgagtattgaagaaggactaaatgaagtaagagacagtttatgttcatagattggaaaataaaaatgccaagatagtaattgtgaaaaataaatgtaataaaatccttatcaaaatgacagcagattttttttttgagaaatcaacaagatgattctatgtggagagaaagaacccagaaaagccaaaagattttgaaaaggaagaagaaaattggaaaagttacactatctgatttagaaactttctacagaagctatagaaatcaggattgtggtattggtataagaataggcatataaataaatgaaaaattaaagaaaaaatactcaatatttatggtcaatagatttttgagaagggcatcaaacaattcaatagagaaaataatagaacttttatcatgctagtgagataattagataccaatatgcaaaaaaaaaatgaagttaggccttccctttaaaccatatacaaaaattgcaatgaatcctacatccaaataaatggatcatgttctcagaactatatccatatcgttctcataactcagaacactgtagtacttttagaataaaatataggagaaattcttcacgacctttgggttagggaaaatgttcccagatataacaccaaaagaatagctcagaaaaataaattaaacttcacaaggaacaacaagaaacctaaaatgtcatgagacctacaaaaaaaaaaagacaaaatggtagatggaaaaccaaccatatcaataatttcataaatatgaatggactaacacatgaatcaaatgtcagagattgtcagctaggatacaaaacaagatctaactatacatactgtctacaagaattatgctttagaaccaaatatatatatggattaagtgtgaaagactggaaaacagctattccacataaatagtaaaactaagagagctggagtggatttattaatatatgagaaaataaactttaagtaaaaatagtgttagagatgcacagttatgtttcatattgataaaacagtgaatatataagaaatacataataataataaatgtatatacatatagcaataaatcaccaaaatgcatgaagtgaaaagtgacaaaattgaaatgaaaaatagacaatttaacacatatgcagatgtataaatgccattctcttaatatttgataagaccgttagaaaatcggtaaagacatggagtcctaaacattatcaagcatatacactagaactgacatagaacaccccacctaccaacaggagctacatgctgttttagagtgtccatagaatattaccaaggaaataaaatatattaggcaattaaaattataagtgaaagtctttccttgacaaagtcagtctgtaaactattctgcaaatgggcagacaccattgcaagaataaaaggatcacaaagaataagggttacatgacactactaaaggaaactaataaaattcccataaccaactctaacgaaatgaaagtctacaaagtacctgtcaaagaattcaaactaattatctttaataaactcagtgaactaaaagagaacacagatagacaactaaacaactgactataaacagaaagttcagcaaataaacataaaccataaaatatagaaatcctacagctgaagaagacaataagtcaactaaaactttcaacagacagcctctatagtagactcagtcaatagtagattcaatcagaacaaagaacagtagattcaattaatcaggtgaatgaatgaacttgaaaacaggtcatttgaaattctccgatcataaaagcaaaaagaacaagaataaatagactgaataaagcttacaagacttttgagataccaccgtgtgaaacaatatatgcattatataagtttcaaaatgagaagagataagaaaagggaagaaaacttatttaaaagttattatttttaaaagttattatttaaaaaaataatagctaaaaactttctaattctgggaatggaaatggacatccagattcatgatccacaagtaaccgaaatagttttaaacctaaagaagtctacaatgagaaacattataattaaattgtgaaaaggcaaagacaaagagagaattttgaaagcaataactcatcacagaaaaaaggcaacacctataaactatcagcagatttctcagcagaaatgtttcagtccaggagcgggtggagtgatacattcaaagtactgaaagcaaaaaattgtcaaccaaaagtactcagcaaaactgtccttcaaaaatcaaagatagataatttcccagataaacaataactaagggaaatccttatcactagatatatcctgcaagaagtactaaggaagttcttcaagttcaaatgaatacatgctattcagcaacatgaaagcctatgatagtacaaatctcacttgtaaaggtaaatatgtaggcaaatatacaatgttctaatactgaaatgttatataaatcattttaaatactagtaaaaaattaagagacaaaattattacttataactatcaccacaaattttgtttaataaataaacaatagaaaaataataagtaaactctgataacaataacaaactacacgtggaggagaataaaagtatagagggctcatatacagttaaagaaaagttgttatcagctaaaagtagactgttataattacaagaggttagtccaggcttatggtaactataaaataaacaaaggtagtagatatgcaaaagacaaagaggaaaaaatcaaagcataccactacaataaaattaccaaaccacaaagaaagccaggagaagaggaggggaacaatataactacaaaacagacaaaaaacaatggacaaagtgggaacagtaaaaccttagccaacaatattcactttaaatgtaaatgaattaaacggtttaatcaaaagacatagagtagatgaatggacaaaaacaaagaaccaactagatgctttctcccaaaacaggacccaactagattctctctataagagactcaccttagatttgaagacacacataggctgaaagtgaatcaatagaagaaagataatcttggaaatggaaaccaaaagagttgggatgactatacttagacaaaaatagacaaagtaaaaaaaagaaaaaatacaagagacaaaaagtagaatacattttcttttaaagcacacacagaatattctctgggataaagcacatattagtcacgaaacaaatctgaaaatttaagaagattgattatttcaagtatgtttcctgaccataaaggaacaaatatagaaatcaattgcagaaagaaaactgaacaatcacaaatgcatgtgaataaaataaactctcgaaaagtcactgggtgagaaaagaaatcaaaaaggaaattagagaatatcatgagacaaaaatgaaaacaacatatcaaagcttatgggatacagcaaaagcagtatgaagagggaagtttatggcaataaatatctcttttaaaaagaataaatggcaaggcacagtggctcacacttgtaatcccaaaattttggaaggccaaagtagcaggattgttaagacaaggagttcaagattagccttgtcaacacagtgagaactgtctcaacaaaaaaacaaaataattagccaggcatgatcgtgtgagtctgtagttccagctactcaggaggctgaggcagcaggattgcttgagcctaggagttcaaggcagtagcaagctatgaatgtgccataaaactctggcctgggtgacagagtaaggccctgtctcttaaaaaaagaaaaaaaaaaaaaaaagaaagaaagaaagaaaaattaaaaagaagaagtatctcaaatcaacaacctaactttatacctcaagtaactacaaaaagaacacgctaaagccatagttagcagaagaaagaaaatgctgaagattagaacagaaaaaaatgaaataaagaatagaaaatgatcaacaaaactaagagttgctttttatttattttttaaaattcatttggagacggagtcttgctctgtcacccaggctggcgtgcaatggtgtgatctcagcttactgcaacctccgcctcccatgttcaagcaattctcctgcctcagcctcctgagtaactgggattacaggcacccgccaccacgcccagctgattttaatatttttagtagagacggggtttcaccatgttggcaggatggtctcgaactcttgccctcgtgatccacccccctcagcctcccatcgtactgggattataggcatgagccactgcacctggcctgttttttttaagataaacaaaattgatgaattcttatcgatagacgtactaagaaaaaaagagagaagacccaaataatgaaacaggagtgaatacaaccaacgccacagaaataaaaataacaaaaaggactgttatgaacaattatatgctaacaaattggacaatcaagaaatgaataaatccataggaatatacaagctactaagacagaaagaagaaatagaaacactttaaagatcggtaatgaataaagagttccaattagcaataaaaacctatcaataaagaaaatctcaggaccagatggcttcacaggtgaattttaccaaacatttaaaaaagaattaataccaatccttttaaaagtcttccaaaaatatagaagggataaggaatacttccaaactcatatgaggtcagcatcaccttgataacaaagtaatgacactacaagaaaagaaaatcatatccctgatgaacatgaatgcaatatccctaattaacctggatgcaaaaatcatcaataaaatatttagcaaatcaagttcaacagcatattaaaacaattttgtaccatgaccaagtgatatttatctctgggatgcaaggacaatttaacacatgcaaatcaattaatgggatacatgaccttagcaaacaaaagaaggagaataaccacaaaacaatctcaaaagatgttggaaaagcatttgataaaattcaacactctctcatgctaaaccactcaacaaattagttatatattagatatagaaggaagctgtctcaacacaataatggtcacatatgaatatcctacaactaaaatcatactcaacagagaaatgctgaaagcttttcctctaagatgtgaaagaaggcaaggatgctcattctcaccacttctattcagcatagtcctggaagtgccagcaagagcaattaagaaaggaaaaaaacaacaacaaggcatccaaattagataagaagaaataaaataatatctgtttgctggtggcattatataagaaaactgtaaaaacctcaaaactgagggaattaaaaatcaaaatgaatcaagttacaagataggtagtaaacacagaaaaagcagttgcatttctatccacaaactatgaactatcccaaaatgaaatcagaaataccgtcccatttacaatatcaccaaaaagaaaaatacacccaagaataaatataaccaagaaggtgaaagactagtaagttgaaaaatttaaaaccctcataaaagaaataaaacaagacacaaacaaatggatagtgatccttgagtatggattggaaaatttaatattattaaaatattcattctagctaaaattcatctatatattcagtgcaatccctatcaaaatatcaaagatatttttatacagaaatagaaaaataattctaaaattcatacagaaccacaaaagaccacaaatagccagagcaattttgaacaaagctgaaggaatcacacttcctacagtaatcacgatagtctagtactgacataaagacagatctatagagcaatggaacacaatagagagcccagaagtgaagccacaaatatacagtcaactgatatttgatgaagatgccaagaatacacaacagagtaaagagagtatcttcaatacatggtgtttgtaaaattagatatccccctccaaaagaatgaaatcagacacttatcccatagacaaaaattaactcaaaacggattaaagacttaaatgcacaatttgaaacaacaacaacaaaacaaaactttcagaagaaaacataggtaaaaaccttgttaacattgatcttgacaatgattacttcgatgtggcaccaaaagcacaggcaacaaaaacaaaaataaatacgtgggactgggctgggcgcggtggctcacgcctgtaatcccagcactttgggaggccaaggcgggtggatcacctgaggttggaagtttgagaccaggctgaccaacatggagaaaccccgtctctactaataatacaaaattagccaggcgtggcggcgcatgcctgtaataccagctactcaggaggctgaggcaggagaatcccttgaacctagaaggcggagtttgtggtgagctgagatcatgcgtttgctggaagctccagtctgggcaacaagagcaaatctctgtctcaaaaaaaaaaaaaaaaaaaaaaaaaatgggactacatcaaaccaaaaagcttctgcacaacaaagaaacaagcaacaaaatgaaatggtactctatgcagtgggagaaaacatttgcaaaccatgtatttgaaaagtggttaatttccaaaatatataaggaactcctacacctcaatagcaaaacaaaacaaaataaacaaaaaacaacaaaataacccagttacaaaatggggaaaggacttgaacagacatttttccaaaaaagatacaatgatgctcaacagttgtataaaaagatgctcaatattgctaaccctcaaggaaatgcaaatcaaagccacaatgagatatcgccttattcctgtcaggatggctatcacccaaaaacataagataataactgttggtaaagttatggagaaatcggaatgcttgtatacttttggtaagaatgaaaatgttgcagccactatgataaaatagtatagagattcctcaaaaaaaaaattgaactaccatatgttctagtgatcccacttttgaatatgtatctgaaataatggaaatcagaatgtcaaagacatatcttaacaccatgtttattgcagcattattcacaatagccaagacatgaaaacaacccaaatcttcatcagcagatgaatggataaagaaaatttggcattttatgcattggaaggttattcaccctttaaaaagatggaaatcctagcatttgtgacaacacggatggacctggacattatactaagtgaaataagccagtcacagaaggacaaacactgcatgattcctcttacatgatgcatctgaaacagtctcatgtatagaaatagatagtaaaatggtagttaccaagcaacggtggaggtgggatatggggagctgttgcttagtgagtgtaaagtttgttatacaaaatgagtaaatcattttgtaattggaccaattacaaaattgagcactatggtgctcatagttaataataaattactcacacttaaaaattgatcagagtagatatcctgttaattgttcttactccaaaacaaaaacaaaacaaagggacaccagggaacttttggatgtaatgtatatgtttgttaccttgattatggtgatagtagtgagaatgtatacatatgtctaaactcaccaaatttcattaattatgtgtggtttcatatttttgtataccaattattcctcaaagctggggaaaaataatgaaccaaatcccacactgtcatgttttccttgcactaatacatgaaataagatacatgaagtattgtaaagatgaataaagcttaatcaatatggcaaaaataaaatagcattcataaaagtgattgtataacttcataaatttactaaaaacatcaataaacttcacccctagaatgggttaatcatgtggtatgcaaattatatttcctaaccctgttttaatgctgaaacatgaaagttaagcaagggtttttaaaaatctcatttgtaatttcaaatcttacataacatacagtcttcttgatagccatgttaactcagtaatgaaaagcacagtcctagaatggctattcagttcctcagacagcacactataaaggcttacacttagtatatgacctttgctcaccttcacattgttgatttgctttaattcttaatcaaaatccagaggtgtgtattttatcacaaactaaatattcatagtatgtggactgacttccaggggtaaccacttcagggtataatactcaggtttttattactgatcacaatataccttttttattctctataataatttgaaaaataattttaattaatctcgtgtagcatgaattttcatgtgatatgcagaaaaacatcattgagcatgtttttctcatttatatactactcatttgtggacttatcacatcatttatttaatatttcacttaagtaaaatatttattaacatgcacagaccctgtacttagtcttccaaggaagaagctaatgatattatgccagaatcaatagtatcatttaataaaggaacattcccatacatcattttgggaggtataatatttgttattaactttgcaattgttgctataatactatcagcaaacatgtgacatatttactataaagatgcaattttaatgatgccttggaagcgctggtcttttccttgcctttggcaaaaataataataatttatattgtaaacattgtattatgtatgttctgacataactcaattggtttaccagagaggtgattgtgctttgtttgaaaattaaacaaaagttcatggcccaaattggcagggatgtctaacctaaaaagctctggggtaagttaaaaaaatcatcaatccaattaaatctcattttaaaagacttttatcttcataattcctatcatacttttctgttttgactgcttgtgcaaagtcatcacagttgctaattcgtttatctgagaatatacagatttaccttctacattggtaatatagtttagtttactatttgagttacaaatttatgagtggttttattttttcattactttcctattgcagtgatttatttcaagttttgtttcattttctacaaattgtggaaagaactcaacgtaatagtaacaatgccaactacatatttaaaacacataagcagtaacaggcaaatgatatgaatatattggctgaggggaaatgtagcctgttagctgaacatgttctgagacaaactgatcaacactgtcttctttttagccttgatagaaccttttgaattcaatgatttatagtatggtaggatatctatgaaaatggtaatcttccttttcaaatgtatgcaatgtatatgaatgcaactatttcattgtggctgcatctgaagccaccagactccttcttgatagaccacaatgatccactagtagcaggtagttgacaccttgagaaacactgcattaagaatattgttggtctccttttttttttttctagacacattcatatgacaagtgatgccatgtccaaagatctgtgggattccttcactagtgggagcagagaatagcccaagcaagtggcagctgtagtattatggttatacaaatgatgctacactaataaaaatgaaaataaacatcatttacaaacattaggtcagctatcaatatcacttcatttgtgagcacactgaagtgcttctaaactgcatgaaaatatttggcaatgcgaaagaaccaaaaagaaaaagtggttttgtagttgatacagcctgctctcacgtagcacagcaaatggaacaggaatgaactgagcctattgagaataagcaagtcataaacagataaaatatcactgaaatgccaccacaaacacctgtatagaacagcacatctaaaagttaatttctctgtttatattggatcacatacataggtcatatttagaaacaatagattgatagttatttttagagaaccacatagaagcaacctaatccaaaaccttcccaaagcatattgtgactaattcactatgtcctaggctatgccattgtaccttctataggcttttctgagcaatcacatccacatcaatctactccttaatttttactgctgaaaccctttcttccatgttccagacctgcattcccaatttgacgtcagtaagtcagacaatgttgtaatgtaataatattttaatagagatttcaatttcaatgccaaattcattaccagatgctatcaatagtctcttttgttctcagcacatttagatttctagtatttccatcccagttatcctacccaatttccttacatatcatctcatagcattgtgattgtgctagactccatacttgttattggcctccctgccttcatttttgtcaaatgtaaatagattttttgtctgcagtcagagtactcttcttaaaacaccattccttttaagtgatcaattgcctttacaaaattctacaatggttcctcatgggccattcttaacctccacactctttttaaataaattaatatatctatttattatcattattattattatttgtagaaacacagtcttgctagttgcccaggctggtctcaaactcttggcctcaagtgatcacatcatcctgtctcgtctttccaaagtgctggtgcaagccaggtgctccctgctgctttttcctaacttttaggatcatctccttctcctctgcatctacttatcttctgttaagccacaacagtcaccttccctaaacatgacttgtactacccgtattctctactttaaagctttactcacaacattcttcttgtccagaaaactctcacacattagattttcctatttaatccctacactcccttacatgatcctagagaagaagattttctatataatttcactagttttgcatttcactgctttgcctggtcacctgaaccatcctgtagctgccactccccagcagaggcaaaagattcagacattcaaacgttaagtataatatttctgctttccaggggtccaagcacagaattcaagggtctctgatgctaagggtttcaagaaggaatatctgcctgagatttttaaccatgtgtctcctgtcccggcagattgccactcacttagcaatcgcatccagaggacttttggagattttatctgttgttactcaaataaaatgccctatctctatctaaagccacactgctctcaaatctgtgtttacggagatcccagggagtgttgcttcagctgactttgctgtgatgattttgaaaaacggagatgggttcatttaggccaattaaggattttgagataaagggaaagatatggatatgtcagtgtgtgagctagtgttacactctgggttgtaacatattacttgtccatgtcatttttcattctatctgaaaactgttagaaattgaaataatgtatacacaatgataagcaagtgtccattttattaatactacagtatatgaaaaggatatgtttgtcaagaaagaccatggccaggcatagtggctcacacctgtaatccccacactttcggaggtgggaggatcgcttgaggccaggagttggagaccagcctgggcaacatggcaagaccccatctctacaaaaaatagaaaaattagccaggcatggtggcatgcgcctatggtcccagctactcaggaggctaaggtgggaggatcacctgaacttagggaggttgaggctgtggtaagccataattgcaccactgcactccagcgtggacgacagagtgacaccccatctcaaaaaaaacaaaaacaaaaaaaaagaaagaaagacctaaatacaatagagttagaagttctatctgaaagaatgaaaataaaacactgtttgcattttgatagtgccctctcaataccagctgcacgaacttgagaaaatctccctgaacttcacttctcttcagtggaatgagacaataatagtaacttgctcacagtagtgtgcagataattaaattaaaaactatttgtaaagaatttagcacaatgttactctcacacatagaaactcaataaataatagccagaaattttgttatggccacaaatttaaaaatcaagacactgctagctcagaaggtactgattggttataattcttacagagaaagctccaaaaatcttttccagacacctgcatacaccacagggatttcaaaaggagcagaatgataatataatataacaagggacaggtagagtatttttaaaatgaagtatataatgtgcatttaagaataaatttgtgataacacatgaataggtgcactaaaatttcattttcatgtcttattaaataaattgtattgctattagtatatgatttttatttccgtagaattaagggattatttctgagaatccaaatcaggagataactgaaaatattccttgagttatagatataagacaatcatttgatatgcaaaaattgcatatatttagaaaacctcagcagaacatcacaataaagctgttgtcattgttctgtttataagataaaggaagaaaaatgttctcgcttttgtaggcctttaaaaatgaagtagatgcagttattggaaatatgaactgactaagccatctaataggaattacacagtgtgaatttctctgacattttgtttgcagattcttagtagaaaagtagtggtttgtattagccttgaagatgttttaatcaaaggacacactgcttgtagaacaaagtgaataaatgtaaaatacagtttcattcaaataatgaaaaacctgtgctatagaaatttaaatctcatttaacttaaattacttattaagttacatatttataaattcactcatttttgtatataaaaatgtcaatgacatctccttttattctcacagggtttctaacattgctgatacacaagtcaaacttcagtgtctaatggaaaacaatttaggttattatttttcaaagaaaaaattctcaattatattagtcacatttataattacatggctagtcaaaaacattggagtctggataatagtaatgataataaaaacttgacatgttgttttttgacaggaaaagtcttctaggacagggtgttaaattccttaggagtgtctttttctcttttatagatctccatctttgctttccaggcccatcacactgtgtttttcccctgtaagtcagttcttcctctatctctgctttctaggctttctcccaaatgtcaattttcccctttactcactcccacttgtatttttactgtcagatgcttcttcacgttgatgccaaaatgtttttttttttaaaaaacagattttaaacattcccattttctttatacttgctaccatatcctcttttctatcactgtcttcagcctccctttttatgttttatctctttgtcaatttttttctaaaattttgttttctttttctactcatttctatgcatctatgctgtgataacgattaaggcaccctaaaaaaatgttaggctaataacatgatacacagtacattttttcagttgcaaaagacaactcgggggaaaaatgattaagggtgagagactcccactgaagtctatatgatgaaagtaacctcagatacaattaactatgagtatgagtgttcgaccatgttcctgactgaaatcaaacaggtaagaatccaatgaagtttgtgaaatatattgccaaaagcatggacgcaaagagattgggactctttcagacttgcaataagccatgaaacctcaacagtctgtgagcagaaagcatactgagaaaacatctctcaaaaatgacatgtattacgagatgtctacatcagatgtggccaaagaggataataaaacagactagagcaaaggaactatgaagaacaagtgaccatggagcccagactaaaggcttaatcagcttccgccacaaatctcacacttggaatcctcacaatagctgctcagcaggatttaagaattgctacactgggatctgctgggcaatgcccactcttccctttctgggaacgtttatttttgttaacttgttcctgatctgacatcgtatactgggtgagaaagagggcaggaaacttgttatttttgattctaggtctctacctctagaaaggccatatgaagaactaaagtagaccacttttatcacctcttgaagaagagacaattatcatgaggccagagcatctggactttgaccagtctgcacagaactcacagggactttaaagttaacaatcttgttaagggaacgagagtattggctgtcgtgtagagattaaactgaatgttttctaagcaaaggagctgactgataatcattagacatgttctccaatctccaataatctggtttttcttctaatgatttgtcaaatcttttcagttacattgcaaacatctttggaggaaatattatttattatgatacttatgtgattcacatcaccaaggaaaattccttgcataaatatggaacccaaccaatcccaatttaatttcatttgaatttcttttttaattttttttttctcaaatgactgcccaagtttttgagtaagttctagtgaagaacttcttgactttgcctgtcaagcaacacagaactctctttactatgcagaacatattccctgtggctcaagtagaaatatcctcatcaacattatctctcctcttctttcgcgtgactgtaactcaggccatttctgaaacaactgagacttgagtacatgcagggctggcttcatgggcatggaactggtgcagtgcaggtcttagccttcagcagggcctcctcacaatttaatgctcaactactgcattttaaacatccccctaggtttttctggtggaactggaaggtaagattgtgtctttccactacggatctggaatttcaggcagcaaatttccactaggtcgggagcatctgaggcaagcagatccaaaagtggaaagagaaattgaatccagaccatactgttgggacccagctagaaaagaatggactcaactgacctgaaagatgcaacaagtgatatggcattaatgatgttgttaagtttctaaatccagcctgatgccagaaacactcctggaccagtgaaatgagtgaatatagtctcatttcagtttaaagttacataagtgggattctggccatttgaatcccaagcaatcctgatcaaaacacattttctttctgtacttagtctaatatttttcccaactttccaaaactattcttgaatatgcctaaaaccaccatactttgcacaaaataggctctttcttagttaactcatattaaaaggaatcattaagcttgccataaattcactgctcaatacagaatgagcaatatgaaattaaaattgttgatatgtgttttaaaggtcaaaatccttttctccttttcttttgagtttttttatacttaatgttactcagagctatgcctctgcttttggctcaatattgattacgtacacctccacatcctcaaagaaaacaaaataaacctgctacatcctgtgccagggataactaatctaataataagaaatcagctttattttcaaatttttaatttctgtacataccacataaaggatatagttacttctgtctttccaatagtaagtaaatggaataaaatgaaaatgtatgacaattatattatgataatatgactaaagtattaagatgaattgttaatcattacttagcaaattacaactttcatatggagaaaataataccttacatatataatgaataatattacacttgggctaatatggttttgtaagttaattatagactacacagctgatttagtttcatttacctaaggagctgttctgaccctgttgcagattaattacatcttcaggaatacactctcatttatcattgtcacttggagcattatagctcttagcaagagtgtagaacttttttttaatgttaaaaaaattccttagctgtgatacattttgcaagtttagtcattaaaaacacatgacagctaaaagcaggtaagattaaattagctatggaacattgagaaagttcatgtcctagaaattaaatgactgaaagaaaataaaaattctgttaaaatcattcatgtcagacagaggcttcatctacatcctggagcattttttagaagatcccttgctttgaaatatgggtatgaaaaatgtttgccacattctaaattcttcagcacacattacacagctttttactattcccattttctataattgttagaagtatttaaaagaataacatcgttacctttatctatacctagaaagtattatttaaattatgatgggaaatttataccatttgcttttacctaatgatggtcatgtccttaattgtgaacatgagaaagagctaaagaagtctgtctagctttgaatactgtagaatatttatttacatgtgagtgatcatttaacatctgtttgagaactacgtgtcaatgtatgtgcagattaggcacacttgaataacttacattccttcacctggaggagctcagattataggggaaaatagaccaacaggtgcaactgagaaacaatgtgtaaaatgtgattaagattacataaagatatgcaacagttaatacggagtgccccaaatgagtggcaagcccagtttggtaggtcagaaaaggcttttggagggaagagaggcttccactaattattcaaaaatggacaggagctagccttgtaactcctgaatgaggaaaaggtggatgtaaagaggaaattggaggaaggagatgggaatggtcagtttcatccaaacagaattgatgataggagcaaaggaatagagtaaagtaaaagcatcttagaaactacaggcagtttctggagatgagattggagattgaggcaggcccagaacatgataggaagcttggaattcatctgtatgcaacagcagggccactggagccatgactagctatggggagcatgggtttgagaaatcaagactggaagcagagagagcaattaggaggcacggtgattgcaacagtaagaggtaatgagagttccagatacccaggggactatataaataaaaacagaaaagatttagagaagattgaatgataaaatgacaggatttcttggtcagtagtggggatttgtgaaatgctaagatcagttctagatgagtgatctagggcatgctgtcttctgcacagatggtggttgaaatcaatgaggaggagtgaaataacccagggcaatgcagagaggaaagagtagaacagaaaaacaatcctggtgatcatcagcaattaaaggaaaagtaaagttagaaaatctcttgaaagtgacataaaaccagcaaggtggtcagagaattataagacttgagagagtgtaaggtcatggatgcccaaggaagtaagaaaaacatttcaaaaaacagaaagtgagtcaagtgctgcaaaacactcagaaagatggtactattgaactggttaatgtgacatcaagggtgaccatagccaaagaagttttaggcatgtgataggggtacaagtaagtctgagaaaccagtttgcactggttctgcaaatggtgaagtggtaacataaaagaagttgttttacccccagaaattacctaggaataaatatttttttttaaaaaattgatatatattttctgttttcttctttcaccaaataacctatatagttattttaaaatattctatttaatactttgtattttttagaatactttatattaaatacaacatttactattcttcagaaatcagaaattctggttcagtattcaaaacccattttaaactttgttgagcgataaagagaatgcagggaacaataacactgaaaattatatttaagtctgaacatttaaaaacacagaaaagttatctggtgaaaggaaagacgattaaaatctctagctggctggacatggtggctcacgcctgtaatcccagcactttgggaggccaaggtgggtggatcacaaggtcaagagatcgagaccatcctggccaacatagtgaaaccccgtctctactaaaaaatataaaaattagctgggcgtggtggcgtgtgcctgtagtcccagctggttgagaggctgagggaggagaatcacttgaaccctgggaggtggaggttgcagtgagccaagatcacgccactgcactctagcctgctgacagagctagactgtctaaaaaaaaaaaacaaaaaactttagccattagttgcttaatgaacaagcaatttttgaaaatttattaataaaactaaaacagtaattttgttttattctgtcatttaaaattctagtttggggttttaagtattacagataaaaacaaattattcattattggttattatattatggatctgttttgaaaaaatcctattatattcaatttgctgcttaacatacaacttatttatcattcattagagattaggttaatttttttctaaaatacttatttactaaggagtttagtgtgacttacttaataaaacagaaacaaaatgtaattgaaagaaaatagctgaaattacatttgcaatgaaattttatgagtaaaataaattgctctgaggtaaaattatcaaatatttgagattaagaatctttttgtgattggtaatttactcaactaatctaagtcattctggagataaataacctgtttcagaagccaatgtcctattagaaagcatcttccaaaaggatatgaagttgattttccaagaaaaacattacagcagtatagcattaacatcattaaaaatttctttatgtcacaaaacaataaaaaatacaactgaggacattttctttctttcatgtgctttatagtcttcatttggttgctatgatcatccataacttgtcaatttctcaaatgtaaactccaatctcacttaagaaccaaataacaatgattgtcatgaacatgatgacggaattatctgcagaccaacagaattttatcaaaccaaatataaatcaaactaataaaaaatgacagcttctaaaattatatcacagtttcactaaagaggtagataatgtagaaataaaagaaaatgaaatttaaaaaagactttgatcattttcaaagcccaattatattcatctcacgactagacaaaaaattcttcctttttaatcagtctgtgagcattgctaaatttctttggttaaaatatttcctttgtgttttcagtaaagatataggagaatgtgttacaaagggctgaaaactggagaaattctgttaactatttccactaacttgaaatttatggttatgagaattaagtagtcatatttttcctacactggcagaataagaggctcttagtgactgactaaggctgaaggatattaaatcacaaccatgcaaatatctatttgataggacatttgggtggtaatatatatgtgtagtaaaagtccacttgtctttgtcagatttcttccagacttagaagatttctacagttaacatagacccaattctgatttcagaagaactaatgtggataaggttttcattttcatgttggctttcactttttacacagcatgtgatactaatttgtttctggatatgttctacaaaaactggaggacctttccagaagcctttacaattcttattgccttgcttgtttcttctcgcagtgctgacttctgtgttgaagagtgtccaaattggaacttactgggatgattaacagctgctacaaaatcaatactctatgtagggaaaacagaattgggctaagatagtcttacatgagcactattttgtggctgaatatctgttgatgtcagcaagccaaatacaatttatcttggtggaagcatttccatggatataatacaagagcttttcagacttggcctcagagacataagaggtggggaagataattcataggtcttaattgtgcataattatgcatattctcagttgcaaagatgatcactgttatactcagtaagaaatgggtttgcttaaatctttcattattttaacatttattatggttgaaacactaagtcatattactattgttactgcaatctgtctcacagtgagtcttaaattttttttcttcacaaattaaattgaaagataatacagatgtttgtggatttggtttattaagccctaatgttctaattacagaaccataaggtggtcactaacatatgacctaaaaatcttttgtatctctttttggagggctaaatatgctttataatattatatttaatattaaacaacaggataaatatgctaacagtttaaaaggtaataaacaattccctgagcccttacttatttgtatcacctctagccacatgcaagggaatatgcttgtgtgtaatgttttacctccaatatactagaattcacacttctttctggcaacatgttcatctttgtatccactataatgtctatgtcagcaattagacaatacgcatttgtggaataaactaataaatgaacttctctgtgattaaaatatcaaggagctaaatgctaaatgcccatgataactcaatattttagatttttatactaatgtaagtacactgtcagaagtagttaagaaatgtttattcaacaatgccatttgtaaagcccagtaagtgacccataaagagtatattttgcaaatctgtttaactggattatccactgggaataatattgtgtgctaaccctcctccctccctgtctcatgatactctccctatttcattgttgcacatgttgcttggataaggaatatgtcaccatgttttttatgtttttaaacacgaaaagctatcaggtttaaaaagacttaaaataattgttttccggggcagctaccatgaatttgactacacttttagcacattaagtaaggaatctgttttcctttctctccactaggaaaaattaaatgttttccaatagggagctatcacaaaatatggattctatagttctcagatgtgtggactttctaccaacatgttaaccagaaattgatcctgtagctcaaagccacaaggacaagaacatgataaggcagggtcagcgttgttatggaccgggaaagccacagctatcaataaaccagaaacctagaaagtcaaattaaagagccagtggtcttaaggctgatagtgacggctttgagatctttgggatgcttaaggcctaatccccaaaggggaaatcaaagataaagtcaaatgttaagaagcaaatgggaagaacaatacatgaaccagaagaatttgccacggtcagctcaagcagctcagcacagatgaattcattctacaaaatgaatctaataatgtattgcaaggcaaaaattattttccatctaacagtgaaataaagaccccataacatatgcacatgctttgtcactttcctttatagtaccctgtatcttttccttcaaaatactgagggctgtttgaaattcacttgtttattgtgtcccattcctaagaaaatgtagactaaatgagaactggttttccctcttgtgttctccaatactaattccgtttatcttctagtgctctgaagagtatccagcacatagtgattagtcacataaataaacaaaattgctatataagtaagtgaaggaaaggaaaagacacaagagtgtgtgaaatgaaaaagaatcagtagaacagcagctatagttatatctatccagttaaaatgtgatctaagcaaataaaaccacatccaatcgcaaatcattattaaaacaattcaataaaaggcagcactgtagaacaggttgaaagtgaatatttgaatgggaatgttagcatcatggtatgtatgggtttacaaacgtttaaatacattgaataatgctatgaaactttaaagattacccacagtcccaccacattttaaatttacattaagaagttttatttctctctgtctcctcacatgctggaggtatatatatttgcagattaatttatatgttttcatatacatattttgatatatatatttgtgtgctcctttacatgctttttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcaaccgtcaccacgcccggctaatttttgtattttttagtagagacggggtttcactgtgttagccaggatgatctcgatctcctgacctcgtgatctgcccacctcggcctcccaaagtgctgggattacaggtgtgagccaccacacccggccttcctttacatgttttaggagacagctaggtaaagacatttatgtttgatcaccactgtgttccctaacatttcttgagcactactgttgagtgttgtaagagctttaaaagtcccgaacaactccttaagatagtttctgtattgtcttccttcacaaaagtaggatatgagaaataatgttatttatggacaatttgtttttgtaatttaatgttaaattttggggacctcttttctagttgtacattattttcaaattgataaatttttaggtttcccaactattatgtctttaaatatgctttgtgcagcttacacttttgtactcttttccctgtggaatagatttttagaaatgagatggatggatcaaagggtatgcacatttttaaattttaatagatactatcacataataaaatattttaatttataagcccattacacaatatggatgtggtgatttttctatttacatcatcatgtcaataagtatgacagcatcatacttactgatttattgactgatagagatcatcagtctttgtaattttgaacaatttgaaaggcaaaatatggtaacctattgcataattttatcgttcattgttaactaaaaatattagggatttttttcatctggctattcagtatttttctattacatgcttattttttaaactggaattcaatatttaagtttattcaccctatctttattatttttgttgaaaacattttttgaaatttaaaagttaatgagttttaatatatatttttaaaatgaaagatcaagaaaacacaaccataattaccttttagattctagatttcttgctggtctctgacaagttttcctgttccggatgatagcaatttacttctatattttcttctaatataagtgtattgcttccatttgtatttttaatctatttgatgtatatttcacatggctttgaagtagaaatatgaatttgtttttatttaaatgaataaccaattctgtcacttcatttattatgtattgtgcattttatccctctccaatgatttgatacttcaacatctaacaaatattaaatattctgtatctctgcactttgtttttgtctaactttatattcaattctattaatctatttttgtgccaccgtattttagttgcagaaatttggtagcatttagtacacggcaaggaaattgaccattgtaggacattatttcagaatattttaatggcatttttgttcaactgcaaattacattgaatcaaaaacaatccccagtgaccctatcagaattctcagaatcaaggaattaatatataaattaatttgggcagacttgatctcttaataatactgaatctgtccatgaaggaatgtcagaggcatttgaaccagagcaactccatctagaataggagtaaggtaaaataaggctgaaacctactgggctgcattctcagacagttaagaaattctaagtcacagaatgagatacaaggttggtacaagatacaggtcataaagaccttgctgataaacaggttgtagtaaagaagccggccaaaacccaccaaaaccaagatggtcacaagagtgatctctggtcgtcctcactgctacacacccgccagcaccattacagttgacaaatgccatggcaacatcaggaagttactttgaagggtctaaaaaggggaggcatgaattatccacccctagtttagcatacaataacaaataaccataaaaatgggcaaccagcagcccttggggctgctctgtctatggagtagccattctttcattcctttgctttcttaataaacttgctttcactttgtagtgaaattagtaatttttctaattaattatttcttgcaggagattcaagaatgatctcttggggtctggattgggactcctttccggtaacaggaatacaagacaaattcttaatattcaagccttattttataactttgcataaaattatttagatttcctcatatatgctgagtggttttttaactaaatgtaaaccttggcatatttttagttttgctggtattgttaacaaaattttattcatattaacataataactggtaatattaaaaaggaaagttagaggtttaaaaaatatatatttagtatttattacattgctttactagtttcatttctagttgatgaatatttattacatatataatcaccttcaaatattaatagctgatttctctacataaacatttaatttttcattattaaattagttcacttttaaaaatttgttgactgacatagtgagagaagaattatggtcttcctcctcattttatttggaatgcatcccctatgcccctatacgtgtattttgatttattaaaaaagcttaaatttttttcaattagtttttaatcacaaaaaacagcaactcttgtttttatttaaaacaaataattgtagtaatattgacccgttttggctttcttgaaataaaccctattgggtcaatagatttttgtccttagacatactacttgaatttatttcctattatttttgtctgctattgttgcatttatattcacatgtaaattttattttggaagctatggttatgaggtattgatattgaggttttcaatctatgtaaaatgaattggagaaactttcccttttaatctgcattctgaaattttgttaaaatataaaaactacttgtgctcttaagagtaaatggaattgccaccaagtttagtagttctcttactacctttctacattttccccctttggctaactgaaagcagtggttctcaaaataggatactggacaagcaacattaggatcacctggaagcttgttggaaatgcaaattctcagcccccgtccccaatctcagacctaccaaacagaaaacccaggtgtagagaccagtaatctgcattttaacaagccccttaggtgattcgaattcatgcttaaatttaagaaccactatcttagatgtgctaccgcttgctcttcagcaaattttagctatttatatttggatgcaaaatgttccatttcttctatataaaaaattattgccatataaacacagatgatatacttatttaaatattttccatagctgtggctatgtctttaaatttattatgctgtgtatttatttctttctgttaaaaaaatatttgtgccggtctatgtgtattctatttgtcatttttttaggggagaaaaaagctttgggctttgtctgtcattatacttccgctctttttttccaagttgttttctttttgtcaattgcatcttaactttctatttgtcttgtagctttttcctagttctttcttaatttgactattgcttatttttatctttttaaaaaaataacatcttcatggctataattttgtcctccatatacagttttgcccatatgcatattggcttttgatagaaaatcttcatatatttgttaacttgtaaataatactttttccatttttatttccattttacctaaaaaaaaatttaaatgatgcttatggaaattcttaaatttcttaattttttggtgttacttggtttatttttatttccaaatttatttcattgtcatcaaggaaattatcatttagactccttacatatttattatttattatggtatacaaaaattcttaaaattattttcctgcaacattggttgattattttatctcatttatcattcttaatgtttactattttgttcttttacttgtttgctgtaatcaaatttctaagatgttctttttcatagctctttttcaagaaattctttctagatgcatccattattggtcttatcgggaaacacatctccacatttttatctgtctctttatatatatctatatggttattatatataattgccatttatatatttatgataaatatctatataatatgtaaataatttagatatatatacatatgtataccttctgtatagaggatgactatatcataattacagcattgttagtaatgaattttctcttagtttatattatctttgtatctaaatttctgctataaatattaaattctttttttgttctagaaatgaaagtttataaatcttcttctgaggatgcctttcacaattttacattagaattgtatatttcctgtatagtttgccatttttcctttttatttcaactttgatccaataattaaccagaaatgttttacaattttcaaatgttaagatttttagaccaactttttgcgtacttgtaatatgactgaattatatgagatcaatttgcctttaagatttctgcttttttaaaaaaaactgattttccttgtggccacatgtgtaattgattttaataaattgttcatggatattccagaaaacacacatattccctaaagatgtaaatttcttggtatcttttgaaaatccaccaagccgctaagaaaaaccaagaggctgtatccagatgtctaagtgagaaactctactcacctgctcagcaattttatggctgttggagaccagaacactcctgtaggttcagtatgtttggctcttgtgtgcctcagatctgctgctttccagtccttacacctaggactccatttgcttactcaacccacttggggagaaatccctgcctgaagtacctcagctaaggctctaacaaagccaaaacatactagctcccagctgcccctggtctccagcatccatttgaatcaggagagttgaagcaattgaacaaagcagatcacctgcatgtccctattttcttagaagcctccaaatattcccctgggaaagcccacaggtgtgtgtgaaatgtgctaggatgtgttccctgtgaccaacatgacctaacaccatgtccaacataatggtgacttttttcaaaaatgtagaaatactctgtaattacatcaattttcttagcatatagactttttctatctctaaatttctgtagtactttaggctagaataacctataaaatcaattatttttccttgcagttttatcaattacatataccaagtttattgaagaatctctccctatgcactatatcatgttatgtctctaaagtcccagttactttttgctctgcagtcctcctacatcattttggaggaagggggcacagcgtagagggtaatggtctgctcattctgaactgaaatccctcaaaaaaccctctgtaaaggtagctgacctaaaatacaggcagtctctttagtatgcattcaggttgggccttagttctggggtaaaagcaataatcttatgcaaccttctattacctacagcatatgccccttagaggtaatggggtttatactatacaatttatttttagaaaactcaactactattgtcaattgaattttttgttacatcatgaatttattaaattatttcaaaaacttgatgcattgaaaataaaatatttagcagttgcctaatcacaatactaaagtcactgagatgtcaaagccttggatctcaaacatttgtgaacagagttgtgatagcagctatttagtgaaactccaggatgtcacttggcccctctgggcactgggctatttctaacttaagcatcttcaaattatttcttttttcttttcttttcttttttttacttttcttttctcttctcttttcttttgtttctccttccttccttcctcccttcctctcttcctctcttcttccctccctttctccctcccttcctttttgccttcctctctttttctttcatttaagtgtggagaaacatttattcaatcttctgcccattttgtaactaggttattagattttttttttactgtttaattgtgctaattacatattttggcgattaacccttgtgatgtagtgaaatatttatatttagtctttctcctctttttcttttttactttctcctctctttttttattgttgtaagaacacaacatcagaacttaggacttaacatgagatctaccttcttaacaaagtataaaatacattattgttgagtataggtacaatgttttacaacatatcactagagtttatccctctagctttactgaaactttatttatgtccgttgattaataattttccatttccccctcttcctagccctggtagccacaattccactcttcagttttatgaatttgaccattttatatacctcatataaatgcaattatgaagtagttgtctttctgtggtgggtttatttcatctaggataatgtcctcaaggttcatccttttagttgcatattgcaaaactttcttttttaaaaaactgaataacattcagttgtatgtatagaccacatcttctttatccattcatctgtggttgagcagttatattgcttctatatcttggctatagcaaagtgtgctgcaatatacatgacagtgtgaacatctctcttcaagatcctgatttcaatccttttagatagtcaggagtggaattgctgaattatacaacagttctatttttcattttttgagaaacctccacattgtattgcatagtggctataccattttgcatcccaacattatgcaggagtcccaatttctccaaatcttcacaatcacctgttgtttctgacaatagccattctagcaggtatgagatgatatctcgttgtgcttttgatgtgaatttccctgatgattaataatattgagcatttagaaatatatactggttcattatttgaatgtcttctttggagaaaagtttgttcaattttctacccattttgtagctaggtgatacggtatggctgtgtccccatccaaatctcaccttgaattttaataatccccacatgtcattggagggacccagtggaaggtaactgaattatgggagcaggtctttcccgtcctcttctcatgatagtgaataagtctcaggaaagctgatggttgtataatggagagttcccctgcacacactctcttgcctgacaccatgtaagatgtggctttgttcctccttttctttctgccatgatagtgaggcctctccagccatgtgaatctgtgagtttattaaccctatttttctttataaattacacagtctcaggtatgtctttattagcatcatggaaacagatgaatacagtaaattggtaccaagagtggcgtgctgttttaaagataccccaaaatggagacgtgactttggaatagagtgacaggcagaagatggaacagtttggagggctcagaaaaagacagaaaaatgttgcaaagtttggaacttcctagagacttggagggctcagaagatagtgatatggacaataagatccaggctgaggtagtctcagatggagatgagaaacttgggaactggagcaatggtaactcttgctatacaaagagattggtggcattttgcccctgccctagagatctgtggggctttgaacttgagagagatgatttaggatatctgaggaaagaaatttctaagtggcaaagcattcaagaggaagcagagcataaaagtttggaaaatttgcagcctgacaatgcaatagaaaataaaaatccattttcgggggagaaattcaagcctgctgcagaaatctgcataagtaacaaggagcccaatgttattcaccaagaaatggggaaactgtctccagagcatgcgagagacattgtggcagcccccctcatcacaggcctgggggccttggaggaaaaaatggttttatgggctgggcccagggcccccctcatgtgtgcagcctatagacttggtaccccatgtctcagctactccagctgtggttaaaagggaccaaggtacagctcagaatgtggttccagagggtgcaagccccaagccttggcagcaagctctaagccttggcagcttccacatggtgttgagcctgcaggtacatagaagtcaagaattgaggtttggaaacctccacctagatttcagaggatgtatggaaacatctggatatccaggaagaagtttgctacaggggtggggacctcatgtagaacctctgctagcatgcagaagtgcataagggaaatgtggggttggagcccctacacagagtccccactgggacactgcctagtggagctgtgagaagagggccaccatcctccacaccccagaatggcagatccactggcagcttgcaccttgcactggaaaagttgcagacactcaatgccagcctgtgaaagcagccaggagggaagatgtaccctgcaaagacacagaggtggagctgtccaaggccatggaagcctatcttttgcatcagtgtgacctggatgtgagacatggagtaaaaggagatcattttggaactcgaaggtttaatgactgccctatttgattttggacttcccttttgttttggacgatttctcccatttggaatgagtgtatttacccaatgtctgtacccccattgtatctaggaagcaattaacttgcctttgattttacaggctcataggcagaagggacttgccttgttttagattagactttggactatggacttttgagttaatgctgaaatgggttaatactttgggggactgttgaaaaggcatgattgtgttttgaaatgtgaggataggagatttgggagggaccaatagtgggaagatatggtttggctgtgtccccacccaaatctcaccttaaattgtaataatggccatgtgttgtgggagggacccagtgagaggtaactgaatcacaggggcaggtctttcccatgctgttcttgtgatagtgaataagtgtcaggagagctgatggttttatgaaggggaattctgctgtacacgctctcttgcctgccaccatgtaaggcacgcctttgttcctcttctgccttctgccatgattgggaggcctccccagccatgtgaaactgtgagtccactaaacctatttttctttataaattacgtagtcttgggtctgtctttattagcggcatgagaacagagtaattcactaggttattcatttttttactatttacttgtggaaattacttatactttggagattaactcttgtaatgaaatatatatttggttttccctgtttcttgacaaaaaacttctaaaattcttgaaatcttcaaagtggtaagtgccattttgtctgttaatgagttgacagaattgagtgaattttttagttcaattattgttttcttccattccatgatttctatttggtaccttttaatattttctatctttttgttgaaattctcactttgtttatgcgttattttcttgacctcaatgagtatctttataagagttattttaaattatctgtcagataaatcatacaactctgttttttttttttttttaagttggttcttggtggtttaattggtccactgttgggaatatccttgtctactttttcatttttcttgattctctatgtttatgtaatctgcacattagacaaaacattcacctctccctgtcttcacagactagccttgtatggaaaagacccccaacaactagccaggtgaaatattctggggtcttcaccaagttttccttcctcagagaaaagcaagctgctgtagttttcctgctcactctgtgctcagccaggggaatgaaaaagctatggtttctgctagcacaagccaccatttctgttctcctaaaggcagctctgtgttagacccatcagagtttcaagactggtaagacaaatgctagctctttgggcagccctggagaaatttgtgtgatgaactcatggagctactttttatttaagcaggcagaagctgagagctgaaaatttttgtctgcttgctctgtgctgagcaaggggaaggatcaatggtatccattagttaagccactgcctgtattctcccctaggtggctggttttgctgaagccattagtgttccacctggaaagacagaaactagtcttccagggagataccttggaaaagtggaagtgctggacattcaaactaacctcttccttcctctaagtaaagctgggggttgagggttttcttactgatcatgtgatgctgtgcctgggcctggtcttcagtgagagggtaacccaattctccctaccaacttaaatgagtctggttttgcattatcccagggtacagtagcatttcaaagattttcagatttctcacaaagggaattagtctgtaaaagatttctgaagctatatgtttgtcaggggaagaagatgtaggtcttcctagtctgccatgttgctgatatcactctggttatttgtattttaatattaaatggaatttaaaaattcctcttgaaaatttcttatctctgttactatatagtctttatagatgcatcttcactggcccaatttcttcagttttgtcctgtttttaccagacttcttagcagctttctatttagtcggccattcttttcttaatctttttttttcttttttgcttacctgaacattatatactttttgttttcctcctgcttcattggccattgttttccagggcatttcccatgccatcttcttctagtagactctaggtattagtaaacctcaaggctttatcctaaagttccatttcttctctttttgagctctccctattaatctcgtcagtccacactgatttaagtatatgtttaggtagatggaaaataatggataaactttctcccattcctgaatgtccccttgcaatgtaactgtcttccgtcaagaggtagattctatatcttctctccttgaatataagcttagttatgtgatattctttggctaatgacacattagcaagctggatgcaaacagaggtttgcatcaagaggtttgcattgggctttaccctctttttctactgaaaatttttccaccattatgtaacaaagtctggcttaacctgttggatgctgggagtcatatggcccattatcatcatcagcctactaacagctagaaccaactgccagatatatgagggagaccagcatagaatagctccaggtaatcttccactaaaggcacaaccacccagttgacacacagacttgtgaataataaaatggttagcatattaagccactgaattttaggaaggtgattcataaagccatatagaaataaatatgtcaatgactccaaattctccctaagtgagatagtcttctaagcttccaacttaaatatccaaccatagccctgaaatttccactatgacatgcacctcaaactgagcatgtctttatatcctccactaaacctgaatcataaataattaagcccatctcagtaaatgagaccacctagttgttaaacttaaaacctcaggatattttatttccttccatcccctggacactgtcgattttattttcaaaatatttcttaagtctttccagtttttttcagtatccatggctcttagtgtactcatctgtctcttattttactagaagatattctaggatggtctctttgcttccattcttgaaaacttccatgtcattcgccatgtgaccaccagaatgatttttaatatagtaatttttttaaaaactgagcttcctttaagtgagcagccagattaatattttttcttcataaattatattgaatctgaatattgttaacagactattgtctagcaaatctgcacatttttctttttagtttttgaggtttatgatgaccaagagtcgcttgtgttgtttccaaacctgtttatgcctgttttactttccattatacttatataatttaatcacatataattggaaagtataattttaaaaagaatcattttatagaaactaaatcaaatgctttaggaagatgtaatataaatgtaatgctgaaactttgctgtataattatatgtaagggtaataattataaaagatttttaaaaacaattttaagtatctagaaggattttactcatatggcttcacaagtgtcttctgagtttttactctaaataaactgaaactgaaaataatagatggtttattatggactgtggtttacacaaggcagagtttatagaatctcagtgactgacattcaaaaataagacattggctgggtttatgagggaagatggccaattcaattatatttatagattttaggtagaaagaaaacatttaaagttgtttgtgtcatttttatgacaattgttttatttttcaattaatatccaactatcacctttagtagaagaatttctgctgcaaatggatcgggttacctcattccctaatgataattatttaattattcagtgacctaccacttaaaaggcaaatatcacaccatagtcctacaggagacttcgagacatggtggcagctgtgttaacagcagcctttcatgttactcactccccctatccctctccatgctccaggcacattgacctagcagagctttgaaggcactaagctctttcttacctcaagtctttcacatacagttatacttgcctggtatgctcatgacatctctttggtgtccagctcacttatgtatattcttcagatctcttcttaaatgcatcctctttatataagcctttcctgactctcagatctacggttgatgtccttcatggtagcttttgttttctttcacagcatttatcataattttcaaaaatgttgtatttgtgcattggttttttgctttttaaaaatatctccttgcatcattaaactccaagttctaataatgagatgacctgtatatatatatataaaaaattatccatttatatatatgtttatatatattatataaatatataattatatgtttatatatataatatacaattatatttatatatattatatataattatatatttatatattatatatattatatatttatatataatatatataattatattatatatattatatatttatatattatatatataattatattatatatataatatatttatatattatatataattatattatatatattatatatttatatattatatatataattatattatatatattatatatttatatattatatatataattatattatatatattatatatttatatattatatatataattatattatatattatatataattatatatttatatattatatatatttatatattatatataattatataattatatatttatatattataattatatataattatatataattatatattggataattatatataattatccaattataaataaagatatatatatatatatatatcttttttattgagatggagtctcactccgttgtgcaggctgcagtgcagtggtgcgatctcggctcactgcaacctctgcctctcaggttcaagcacttgtcctgcctcagcctcccaagtagctgggactacaggcatgtgcctccatgcccagctaatttttgtatttttagtagaggtgcggttttaccatgttgaccaggctggccttgaactcctgacttcaggtgatctgccttccttggcctcccaaagtgctgggattaaaggcgtgagccacagcacccagccagatgacctgtgtctttaatttactcccataaccctagagcctgaaaaaaataagtgcttagtttttttgtttaattaaacaagtgaatgaagaaacaactatggaaattaaactaatggggtagaaagttttattcctgggatatttaaagatatctgtagttggcttttgcttctaatgtccatctgtctagcatctcatgacaatcttctttcacctcactgccatgtaagcttagtgactatacagacttctatcattttcattgctaatcctcaaacagtacctggtacatagaaggtactaaataaatatgcttttattgatggaccatcactgtggaagaatatctatttttagagttaattatgatttcaggatcatttccgatagttctggctaaattggaaaagcattaaaaagaaggaattgccatagtgtctagttattgatcaatttccctttctacctaggcagacaaaatttatttcctcagctttcttacaattatgtgcaggcaagtgattgagatctggccagtgagttatgagtggaaatgatgctacatcttccaggtatgggcccactaaaaaaaatccactttctttagccattcagttgttgaatagagaaggttatctgtcaagatggaaggagcctgggtcaccgattgacaacatagagcagagcctctccccaatttttaacctatcctgacctgtcacgtgaggaaaaactgatttttattcattgtcagaccacggataatttgtaccagcagtcaacccattctgaataatacaaagggtctataacaatgaatatgaaggtgatatagctacatatttctgacctcgggctttctaaaaattggaggcaaggttctttgtatattgtacagcgctagctgtcagtaaataagggacgatagttgaaataatgaaaacaatactgagattagaatcaaacttggaaatcactttgtaactagacagcagaagggttcctaaagacaatttcaagtacaaactacgtgctcatctgaagctttttcatgctgttatagcataaagttgagatgcatcccatatgctttaaatccttcaactccactatttgttatatattcaggaatgatttgagacaatttattttatttcattatattctagattcattgattgaggaagaggaatgtaagctgctgagtagatgactttgttgaatgacattcaaggtagaagatctattgctctgattatgtccctgagcattgagattttgtgtccctggggcaggaataaatctttcagggaggaatgcctcctctctttatccccctaatccccatattatgctcaggtaaaggaggcccaagtcaaaggaaacaagaccctttaaaagaaaactcagtcaaagccaccttatttgtttaattagttctgatctgccttaaaatcataaacattctatcacatagtttttattagtttctaaatgtcatcttttaaatttagatctttaataagtctggcgtgtacttatataatatgaggtagagttctaacaaaagttttttctttctaggaagctaggtttgaacattatcaactaagtaatctgccatttcctcagtgaatttttgtgccatccctatactaagttccaatatgtgtctctgtacttcctcattggttcattcatctattatttcataggaccattctgttataattatccaattcaattgtagcatgtataatttagtaaaacaaatttatttctctccttattgttaaaattgacttagctattttgtcatacatattttaaataagtttgttataaaatccagctccaatcttgcatagttatatattaaatgtataaattaattgaatattatatcaagaaatctcatataagaatagaaaatgtctccatttattctgatcttgtgtgtctttgcagagagttttaacattttctttatataggtcatgtgtattttttattaattcttagatactttcaatttttttgttattgtttctggaaagtcattgattattgctaatataagcatatactagtgaatatttaagttgattttatatttggcaaatttgctataatctcatactagtcataatatattttcaattaggtatatattttttcaattggaatatatataaatatatatttatcattatttttattacttttttaaattttttgtttttcaccatatgttgtttacttataattctctatagagtatttttgcaaagtcaatttttcaataggtctgattaacttttctcaataatgcagctttcagttttgctaacattacgaatttttgttgttgttgttactctctgccattttctgtctcatttctattatagctttccttttcaagttttttggttttgtatcatttctctttttcaaacaccttgactttttgtatttaaatacaattgacccctgaacaacatgggagttaggggtgctgaccactcttgcagacaaaaaaattggagcataacatttgactacccagaaacttaacaactaatactctactgttgactggaagccttaccaataacataaagccaattaatatatattttgtatgttatgcatattatatactgtattcttaccagaaagtcagctaaagaaaagaaaatgttaagaaaattataagaaagagaaaatatatatactattcattaactggaagttgatcatcataaaggtctttatcttcatcatcttcagattgagtaagttaaaggggaggaagaagagaaggggttgatcttgctctcccagaggtggcagaggcaaaataggtggagaaggtaaaaggggaggcaaattacactgggtataacttttattgaaaaaaaaatcgataagttgaccagtgccgttcaaacctgtgttgttcaaaggtcaagtgtatttctgtttcctaatataagggttttacaacctcgacactattgacattttgagctgtatagctgtataattctttactttgtatttgaggtgttgtcccatgcagtaagcgtatttagcagcattcctaactttacctactagttagcaaaaaaaccctgctttagtcatgacaatcaagcagacattgccaaatgtcttccaggaagaggcaaaattctcctctgttgagaaccactggaaattgaccaaagcatataaaaaaaatgagaaatgtttatttaggaaaaactactgagcctcagataagaactctctaattagtgatatttcagatttgggttgcttcattagccttcagctccctgggtgctgtagttctatcagagtggaataagctaagaaaacaagtagattcattgtcagtggaactgacttgatttgaaatggaagccagaaaatctctatggcctagaacattgttttacaacttacacttacagtagtgatatctgtggcaaatgaacagggagagccagtgtcatagctagcctgagtttgtgaaactgactttagggccagcagctaaccagcagattggccagagatttaacaagagatctcggaatcaaactttcatatgggctgtgataaacttctatatattcctggctgtctgaaaatctgtatggatttgcaaggctacacaaatgctcagaagagacaaaagaggatcctagttatctacacatccttggttaaatgagaggttttgtacatgagcggaagagacgaaagaaaggccagattatattaaaagccgaagtgatttctaattgcctgaactttgaatgtattcttcagtgaccatatggatgcgatgacaaagaaaagaagacttactggctcaaagtgtttgagcgcaatctctagacaaccattttgacacaggggtgatctctaggaaagcagtatacaccataagaaagaaaggctccacaggtaagtcactaaatagacaaacataggaacaatgataaccactgtgggcagataaaaatccagagaattaaagatataaacaattttcagtattcaacaaaaaacgaggagatatgcaaaggaataggaaagtgtgtcacacatttagggaaataacaagcaaacaaacaaggtctctgatggggcacagatatttgacttcacagacaaatacttccaaacagatattataaatatgtcaaaagaatgaaaagaaacaccatttaaagaataaagtataggccgggcgcggtagctcatgcctgtaatcccagcactttgggaggccgaggtgggcggatcatgaggtcaggagatccagaccatcctggctaaccccgtatctactaaaaatacaaaaaaaaaaaaaaattagccgggcatggtggcgggtgcctgtagtcccagctactcgggaggctgaggcaggagaatgtcgtgaacccaggaggtggagtttgcagtgagccgagatcgtgccactgcactccagcctgggtgacagagcgagacaccatctcaaaaaaaaagaaaaaaaaaagaataaagtataaagtatagtaacaatgactctccaaatagaaaacgttaattaaagatacaaaattataaacaaaagaaccaagtagaaattctggagttaaaaagtctggtaaccaaaacaaacaaaaaatcctaagagacttaagagacaggcatcattaatatctaaagattggaaacaatcaatatgtccaccaattggtgaagggataaccaatatttgatacctccatgccacagaatcctattcaacagcaaaaagggaaacaatatttatacagttcatatgagtgaactcaaaaacttcatgctaggtgaaggactccagatgcaaaactcctatattgtgtgattttaaaaattattttcccataagtttttggggtacagtggtatttggttacatgagtaagtcctttgtgagattttagatatttttaaatatagaatgtccataaaagacaaatcttagaggcagaaagccaatcaattccttcctgaaactgggaaaaagagccaagattgaataaaaatgggcatgagggttctgatttgcgtaataaaaatgttctaaaattggattaatttactaaaatcattaaaaagtacacttacaatgaatgaattaggttgtgtgtaagtgatacactaagaaagctgttaaaaatactgtttttataccaacgtgaataggagggcttctctggatcaagacacattgcatttttctttcaaataataatagtcattacagtattagtaaccattgtatatttagccttcatcatgtaccactctatgagattctttaaatgtacaatcatatttgtaactctatgagagaggaaataataaccagcatggcacagataaataaatagatactgagattaaataatttgcttaaagacttttacccaggtagcttacctcttaagttcatggactcaaccaatgctttctatattctactagcctttttataatctatctctgtgtgtgtgtgtgtgtgtgtgtgtgtgtgtgtgtgtgtatgagatgtgacatgacataaaattagcatgggatgacatacattaaatttaatgtaatgctttattttctatatttttagatttcataatcattggctaaaaatatatataaaatcactattaaaattattcctttaggattaaaattttaataactatttcaactgccatataatattttactctgtgtaagattctaaaagaaatgaaatgaaaagccagccttctgacttattaatcacttgagaatagtagcaggattttttgtagacttttcatagatttttagtaagttataatgattttataaaatgcatctcaaagtaagataaaatttaacgcaatattttcacattttcaataatatggagttttagcttatactctaaaacttgtaagtatattaaatcattctaagcttcattttagtaacacaaataaaccaattacaaagaatatagtttttttcctttgcttaagacatgaaaaatatgtcaattgctgatactctgacttcaaattggtaagcgatgataataatgatagtcattagagcaataataattgcctattagaagagatgttttgatggcacaaaaggtaaaataagttatttataatcagtaaattttcatagtttaaaagttttctcactgtgattatacagtacaggtacaaaggtaaaatttagtggagaatcttaccacgccaatggaaaagtaattattgatgatactgtaaggcactgggtctcctttctcatctttgtcattaggtatgacttcaaacttccacctgtccaacatgatttctgtgctgttttcaatgtcttttagaattttcatcagattctcaccttcgtaacctagtgggaaaaaaaaataccttgagaaaagaactctaaccaaataaaaaagctgtatttttatgtttcagtgtgcttatgcatatgtaatattctaaaggtaaataatgattttgaagcacattctgccaccaaatgaagaattaattataagattatactcatacccacatttaattcttaactttaattggtaacatgtactgtatttctctttttgtggtgcaaattctcagcatatacaactgccaagtgaacatttctactgtattccccacaaaactttataccaatagattcaaaactgaatgaattctctgcttccatatcttcctcctgggcagctgacttcacaaagacaccatcctctacccagctgctaaagtcagaaacgtggatgacattttagacttttccctttccatcactctcttaccctcaccttttcccgtctagtgatataaaactttcaatttaagtaaaaggtcctactttttgtaagctttaaaatttcgtttcttattctgtctactcagggtgtcccttttctttttggctggtttgcatctatttctttggcattgttttatatttgctaatactacttcccagtgctgctgcttatgcctgtagtctcagctactcaggaggctgaggcgggaggactacttgaggccaggagttccaggctgcagtgagctatgattgcaccactgtatcccagcctgggtgacagagtaatattccctgtttaaaacaataaaattaaataaaactaataaatttgctaacacttctttctggaaagcaccctttcaaaataatggctcagatgcccctctcacagtccgctatacgcagttctcaaaactagccctatcttagaactagtacaccacattgtcattacttgtgtttttctcactacaggtccctcttaacccagcctgcaatagagtaaatgctcaacaaatcaattttttaatgaatatatgatagacggtcaacatgacctgaaaataaaagtcttgtcaatattacattctcaatattcaatttatttgtaggtagataacattatagttatcactgcagcctaaccctgacagagttactgtttttgtttctgaatcttcctcaacattagtttccttccctgtaaaaaccttagggttcttgtgaagattaagcaagataatgcctaaaaagttctcagtacatgagtcctaaaacagagaataaaaagttctcagtaatattttactactgatgatgataccatcagaatttgaaatattgtactaagttaaatcatctctcttttcacccacacaaaagcacacacatagtcctaaaatgattattttgagtcggaacaacattttcagtttttatttttttctgttcattatttaattgttgaacaaggaaatgccagaggctatgagtcctcattagagctattagcatacatatcattgaataaactcattgggttaaaagaaaacaggcactctcatataccaaaattccctaaagaggaatacgttacacttaaggtgtatctgttcaattaactattagaaggtgaaagccaccagaaactagaaatacctcttctggagctcatcatcacttcttaccttacacaggtttaaaaagtaattactcgctacttaatacatacagtaaagggtacaataagtaacgattacataaacattgaaaatattaaatattatttcagaagagattgggtctattcagggtggtatggccatagactaaatactatttaaaaagctatcatatattttacagtataatttgaagctgttaagtattaataatatgcatataactgtactcagtggcaaaacactgaatggcttaaactgcaagattacaataattatatttactaacatttcatgtttcttaatagtgctaccttattttaaatgtttaattaatttctaattgttaatttcttttaagaagtataagtaatagctccccaaataaattatatacatatatatattattttacctactgaattaagtaaaaaacacttaaatatattcatctattttccaaattctgctttcatgtcagaataagcttgatagtctctaggcataaattaatttgcatataattatatattataatataggagtatcgtgtgtgtgtatgtgtatacatatatacaattagcagaaatactagtaaataataatgctttcaaaaaggttgaattttttctcagtcatgtctcaggttaatagcagcaccgtccaacataacactggaacaatgtaggaacagcaacctaaccgggagagaacatgataggaatgaatgtagtgaaaatcaattaccacatctagattgtagcagggtcacgcagcttaaaatctttaccactggatatgtgtgtagggatttttatgactaaacatgaaaaaggctggtttaaatctgtcttctagccaagcaaaagtagaaagaggcaataaataaatcttgagaattacaacatctgcaattcagaagtgattcacatagataaactctgaactgtagtcccccatttaacaaatatcttttccctacttcttgtatgtatctatgcccaagattgttaaataatgataagtaactattaatagggttcctgtacccaagaagatcatgattttaaaaaagacaaatcaaatccactaaatatgccagcaaaagatttttacagaaaagaataatgctattttactttcattattttggtttaaagcctgtaatcaatccaggctaagaaacaaaatgaaaacatgattaatatttattttatatttaatgatattatgttataatgactgaatctaaaaagtcatagaaatttttgcaaatgaaaatcacataaagaaatgcaacaacaaatctgtataaaagtgtgttcaggccaggtgcggtggctcatgtctataatcccagcactttgggaggtcaaggcgggtggatcacgaggtcaggagatcaagaccattctggctaacacggtgaaaccctgtctctactaaaagtacaaaaaattagcctggcaaggtggcgggcgcccgtagtaccagctactcgggaggctgaggcaggagaatggcgtgaacccggggggcggagcctgcagtgagctgagattgcgccactgcactccagcctgggccaaagagtgagactccgtctcaaaaaaaaaaagtgtgtccaatttacaactattacttgcctccttattctacacaaacaagattttccttgcaattaaatttttgttaagagagactaatgattgccagaaatttacaaaaagaatgctaattaagctagaatatcctacattcttacagtgtcaacttttccaaaatatgaaaatatattcctataaaaaagaggcttcaagtcaatagattccctgaatcttaagtgaaccaaatgattattggttgaatgaagtactttcttctacaaatattaagcataataataattactgcaactgcataaagtacttaacacaaacattgatatggtttggctctgtgtccccactcaaatctcatttttagttgtaatccccataatccccacgtgtcaagggagggacctggtgggaggtgattagatcatgagggttgtttcctccatgcagttctggtggtggtgagtgagttctcatgagatctgatggttttatcagggactatttcccctttgctcatttgcttctctcacctgctgccatgtaaaaaatgcctttgcttctccttcaccttcacgattgtaagtttcctgaggcctccccagccatttggaagtgggagtcaattaaacctttctttataaattaccgagtcttgggtatgtctttatagcagtgtgagaacaaactaatacaaacactgtgcaaacaagttatcggtttagcacgagaacctacaaggcactgttattttcttcaaattctgatgaggaatctacagcacacaattgttaagtaacttgctcaaagttacacacctgtcaagaaataatcccaccgtaaagcatatttctttgttaataatctctagcaaatggcttctccatttccctaattgctcaacttgggcatcttgataccttgctttccctaaaattcctaaccaatccactggtaagtacaattaagctaagcctgaaaatgtacctccagtttggctacttgcctgatttaaatcatgtaagctctagtctgctcactttattatgcaattgggacaactataatagaagttctcatttggagaactatagttctgcatgttttcacattttctgaccagtttattttctacccccaaattaatctgtttttgaaaatgtgtcagtgtgttactctgcttctgagactttcgaagcttcactttgcatgacaaattcaatcaagtaaaactctcacaatgacaaataggttcctgcattatctggctcccaattgtctttccaaagtcatagtactcactatccctaattgcccaccatgcactgctgcttcagcaaccccacctgcattccttccttcagtccttgaaacacagggagctatttctcctccttcttatattttaggtccagttttaatgttacctcctcagagagaccttcttggccatctagctagatagttcatctctattattcattcttctgattctttgatattttataattatatatttcattattgttcaatttattttcaattatactcaacgaaaatgtaatctccagaaggatagaagccatttgtttatttcctcactgtatatttagcacctagaacagtgccaacacatatcagacactcaaagggaattcatcactaatagattctttgacacatgctacagtccttgcctttgtccattgttagtgctttgtatgtggtttcacaagaattattagagtatgccaaatatggacttctttaacaaatttgagatttaggccatttgttaatctggaagcaaaaataaaattattaattttcatatacatcaaatatatgttccaggagaacatggcaagaagactcacatattttccttctttttaatctatgcacttgtatgaacactggcaaatacaagtatcttatcagaaatggtgatgtctttattcatttctttagattgcatgaactctaatgcaactcatgaaaatactcctgaagtatattcttactgaacatcccaaatagactacatactaagctcttgacttagtcaagcacgtatacagcttagagctagttggtcagatattcatggaattattctccaactttgccgtaaatcagagttacttagggagtttgtttaaaaaaaaaaatcatctgctcaggtcccaattccagatatttccattcagcatgtctggggtggggtcaggccactgtatttttaacaagtgccccagggactctgttcaccttgtcttagtagacacttttcaaacttctctaagtgagctttgatgctaaaaatatttagcattcaagtcctgcttctttaccaaagtctgatggtgtttagtgatcttacctagtggtgttcagtgatcttcagataaatatagcctattagtgactctgcaaaatgttttaagacctcatctccaaatattctctctttgcttaccctactccatcgacactatttcagtttcagttccttgaatatgtcaagtgccttcccacctctgggcctttgaactcaatgttccctccgcctatgaagttcacacccagctttacatggctgtgtcattatctagctagcagttttttcttctatgtcatatcctcagtgaggtctttccctataatgatcatctgtttacttgttagtgtaaggtctcacatatgattttatgtgccactagaaatcaaggtacttttgtttttcttttgtcaactctgtatccaaagtgcagagcacagctggctagcatagagtgagtctcaaaactgagtattatttaacgtattcactcctgggaaactaattcattagcctttcatctttcctttgtttgtgattttacctcccaacttataaatgaaaagtataaaaattaccttgaagtgcatccatgtgtaccttattttctaaacaaaaaaatcaaaaaccaaaaccagagatgtttggaaacttgacctcctttagtttaagtctctatttaatatcacattaaaacccaatacccatggtctcttttttccactatttgttcttctatccaagactattgttcaaaatcatatattatatataccacatcagttatcttcactgaaatcatatcgtttttgtttcttttcttttctttttgttttgcaagggaaaggggtgttgtgtactgtttctgcttttgttgttgcagctgctttacctcctccccatcgcaggcatcttgctagatcattgccagtcccaagaggcagaatcgcaactggaggatgcttgcctacattggccttttctgcagaataaaaaaaaatacaaataaagaaaattttaagttcagataaaacgacggaaataaaaagatagcctgatgacattaaatgaaggaattccaataggtactcataaacaaaacataattgtagttttagatatacacaataatgaattatggataatttgtatacatttgtagcaattgataagacacaaatactattattcacggaatgatggaattttcaaaactcaggcaagaggaaagctttttaaatatcttaactcagctaaaaattgtggtgtgtcttatctccactacaatcctcagggatattattatatacagcataagattacaatacagagacacaactaggatggatgggtaggttcctacataaagtccttttgcaacatcaattctaggtacattttacttaaaggaataaaatatttgaaaactgttgaattataaaagtgagtaaattgctaacaatgtccttgactttttcccacccatggtgctgctttgtgtcagagcaaatggaacacaacgttaacagctggaatacaacgagatcagcaggttttccatgagattaatctttacatcacataatgctttgggttcagagcagtaaagatctctgccgctgacatcccatatgctttggtttgaatcattgcatgccttgaattaatctcacaaatgtatatcactttcttttatttgtttcttcctccttagcccctcaaaatcagtgtacatatgtgtgtagggatagaggggatagataatgtagggaaatgtcacaatgaaatagccgacaataagatttttgagggctaaaacaagctaagaattcctgctgtttttcctctaaaatccttacaagtcctcagatacttttccagctaactcattaacttttgtaattcttgaattctggttgtcttctcagataaaacatataaatatgatttacattgtttaatggaaggccagatcagaattttcactgtttctttttaaatcaaatattagtagattaaagctgttagatccttatcaaaagtgttgccaacatgtatttttcttattttgaatatttttagtgtatgcatagacagaatgttttctgcattgactaaataggtgtctgtttcaatttatacagaaggtaaaacttcttttgaatcaattcgttttatgaaagggcctgttttaaacaaagaattgatcaatgcggtaactgaaatgagaccaaaaagagtcaatatttgttttggatttatttcctcataaaggccaattcatggtctctttttctaactagtaaccagttccaacaactgactagatctgaaaaagcaaataattttcctgaatttatactttttcttgtgctgcatacttaccttatatcctcagtgatgttcctgtattatttgctcataaaaatcgagcgttttcagtttaaatagagaggcaatatagaataaggcttaactgtgcattctaatctcagctctctcagttcacagctataagactttgttgtagttatttacttttttccaagttttaggttccctatctctacatgggattattaatactatctgtatcatagagttgtgaggaataaacaagataacatgatgaataaaaattagctatgatgatgatgatgatgatggatgataacgatacaaatgtatacagagggtaaggttttgagggtccatgttttaaaaacgtaagcacatcaatttcgcacagactttatcacaaatactaagactgctccttcagttccttgtctggggcacacaaacaatctgatttcctagagcccctgaaaacaactctgaaaatttggtaaacactgtaagaagtggattagaaaggaaggacttctatgtacttctaaactattttgccagttgaatttttgaactacagaataataagttaaaccagtgtgcaaccttccagatgtccaattatatcactgcttccaaagataatgatacaagcaatagacacatagatgaaacaggatttaaagctattgctctctccccagccatattaagtatgtgtctgcattacctatgcaatccaaaacccagcccacggttccatctccaccacaggctaacactctgaagtcaggaacatcacggaaaaagtttaacctgaaaaataagcatgttatggcacatgattaatagtttaaaaataagatgttttcagttttgtatcattaacattttacccgatgaaatacgtttttattttataaaaactgtaaaatatctcagtgataacttacatatcctttaatcctattttataattatatattcaagattctataatttaaaaatattttgtaattacatattctagattccataatgaatatactctttttctttaataaactctaaaattttaaggataaaattagtaaattataataattttcattgatattctcccagatgtgatttgcagttcgcataacccagaatgacatatactacattatttcatttaataaatttcatcaatccaaaattatcttttgagtgaatatataaatgtgacagttatgtcagtaaatatgtctttaacaatgttctactttctccattactgggagaaattgatcagactgcaactggggttctagccaactttccttttgactgagaatctgcaaataggaggcaggcttcaccttgtattttgacctggttgacagtgttttccacccaggaacactctagcctaattgctgggtcagctgccataaatacccactgcttctgctgttactgcatgcagggtgcttaataatgcaacctaccttgggaaaagtcacaaaggcaggtaatgcagccagctatacagtcatagcctattttattgcaataaaaaaattgaaacaggacagaaattttggtatgttatgtgtctcttcacctcccttgtcccaaacataacaactgatagtgatataatatgcaactatccaaggaatttttctacgtacttacgtatacaaattttcgtacataaatctttattacacacatattttcaacacgaataaaactgtgctatacatactgttcattaacttgtgtggttttattttaacttcaaatatgtctaagagaactttgtgtatcagtatataacatatgcatatgtcatgtgttgcattctgtcagattattatttttaagcactgcatcatgttttataataagttcatgtactacaagataaaatgaatgatctctttttatgaatttttaagctatttcctgtgtctcattactacaaaaaagtattgtatttaacattagttgaagaacatttgtgtaaatgtgcgcatgtgttttgaaggctactctagagaaaaatattccattacatcattatatccctctgaatggctcccactgtcaaatatgcaaggattcatttccttgcaaccacaaaacactacatatgaacaactttatgatatgtctttaataataagtgaaagccaatgtctttttatttgttgtaaaatcacacttccctgtttactagtgagttcagcatatttttatacatttcctggagatgcgtaacctgtcctatgaaaagaacactcaaagatgtgcctttctttctattgaattgcctttttattttttatttttattttttttttgagatggagtttcacttttgtcgcccaatatggagtgcaatggtgcaatctcgactcactgcaacctcctcctcctgggttcaagggattctcctgcctcagcctcccaagtaagctgggattacaggtgcctgccaccacgcctggctaatttttgtatttttagtagagacagggtttcaccatgttggccaggctggtctcatactgttgacctcaggtgatccattctccttggcctcccaaagtgctgggattacaggtgtgagccaccttgccgggcgagatgtcttttaataatactttaaaactctttgcatattacagcaatcttcgcatttaaatttgcatcatttaaaaaaattttgtcaaggtaataccaacactgcataaatataataaaatatgtataaaaattactaaaacccatcatctgattataatatccatggatatttagaacaggaaactttcatgcattttctcatttattatattgtggatatttaacctttgtgagacatgttgcaaatattttattcggttctaatactcattgttttgcttatactaatatatatacaatataataaacacatatgtaccagttgcccattccaggaagtagaacatttctaataacttacatatttctctgttttctttccctatagcactgccctttctaatttacaaaggtgagcactactctgaatactgagttaccacgtgtctgacataatcaacatgtgtctttctacttttcccacttacattggtactcagattcattcatgttgtagctgaagcttttcccacgtgtagctgaagttctttctacttctactgctgtgttaaataccacttacatgtcttttaaaatccatgtcaatgggcatttcaactggtttgctttacattcttgcaaaaagtgcattcttgtacaggcatacctcattgtattactctttattgagtttagcagatactgcattttttacaacttgaatgtctgtggcaactctgcttctagcaagtctatcagtgccatgttttccaacagcacatgctcacttggtgtctgtgtcacatttttgtaattatcgcaatatttcaagctttttcattattattatatctgttatggtgatctctgatcagttattatagtaattgctttgaggtgccatgaaccacgcccatgtaagacagagaacataattgtgaatgttgtgtgtgttctgactgctccacccaccagcggttctcctgtctctctttgtgtcctcaggcctcttaattcccttagacacaacagtattgaaattagggaaattaacaaccctacaatgtcctctaagtgttcaagtgaaaggaagagttgcatttctctttcaatcaaaagctagaaattattaagctgagtgagtaaagcatgtcaaaagcacaggcaggccaaaagctagccattttgtgccagtaagccaagctgtaaaagcgaaggcaaagttattgaaggaaattaaaagtgttactccagcgaacacacaaacaacaagaaggcgaaacagccttattgctgatagggagaatgttttagtggtctagacagaagatcaaaggagccacaacattcccttaagctaaagccaagtccagagcaagcccctaactctattcaattgtatgaaggctgagagatgtgaggaagctgaaaaatagtttgatgcaagcagatgttggttcttgaagcttaaggaaagaagctgtataaacagcaagtgctgaggaagaagtggcagcaaattatccagaagatctagctacaattattgataaaggtggtacgctaaacaacaatttttcaatgtagacaacatagccttctaatggaagaagatgccatctagcactttgatagctacaaaggagaagtcaatgcctggcctcaaagcttcaaagaacaggctgactctcctgttaggggctaatgaggctgatgactttaagttgaagccaatgctcatttgccattatgaaaatcctagggcccctaagaattatgccaaacttactctacctgtgcactataaatggtggaacaaagcgtgagggatatcgcatttctttacagcatggtttactgagtattttaagtccacgactgagacatatttctcaaaaaaaaaaaaagattcctttcaaaatattattttcattgacaatgtacctggtcacccaatattctgatggagatgtgcagaaagatgaatgttgttttcatgcctgcaaacacagcatacattctgcagctcgtcgatcaaggagtaattcaactttcaagtcttatttaaaaaatacatttcatatggctataggtgccacagacagtgattcattttggggatctgggcaaagttaattgacaacctctgtaaaggatttaataatctaggtgtcattaagaacattcataattcatggacagaggtcaaaatatcagcattaacaagagtttggaagaagttgatgccaagtctcatggatgactttaaagggttcaagacttcagtggaggaagtcgctgcagatgtcataaaaacagcaaaaagtagaattgtaagtggaggctgcatgtgactgaattgccgcaatctcatcatatttgatgagaattgaatttgaaaggatgaggaattgacttttagagataagcaaaaaaagagggtttcttgaaatggaatctactcctagtaaagatgctgtgaacactgtcgaaatggtaacaaaggatttagattattacataaatttaattgacaaggcagcagcaggatttgagaagactgactcaaattctgagggaagttctactgtgtataagatgctagcaaacagcatcacatgctagagagaaatctttcataaaagtaagtgtccatcaatgggtcaaacttcattgttgtcttattttaagaaactactagagccacctccaccttcagcaaccaccactctgatcatttggttcccattaaaatcaaggctaaactctctaccagaaaaaacattatgactccctggaggctcacatgattgttactaatttttcgcaatgaattatttttaaattaaggtatatacattttttaaaccacaatgctattgcacatttaatagacaacagtataaacataacttttatatgtactgggaaacgaaaaaatttgtgtgattcactttattgtgatattcactttattgtggtggtgtggaaccaaatccacaatgtctccaaggtatgcctgtacgtacttcctagtgcttaagggtagtggccactttagagtaatgcatattaatatgcaactttaccagataacatcaatgtttttcgcaaagaaggtgcaccaatgtacaatggatgtgctctattgaatccattctctttaacacttgtcacgctttttcattttatttcttatttttgtgaaatgcctatttatccttttggtttccattatctattccttttcaccttgttggtttgcaaaaaaattttacacgtctttgattttagtcctttttgaataacttttttttcaaatatcttctacaaatttaaagttttttcttttactttcattaatgtgtattttaatgaataagaacctagttttaatattcaatttcatcatccctttgataagtagtcagtaccttaactagtcttctgtaagacaagcttccttactcagagctcagaattcacatacactctcttaaaatgtcagttttacttttgacatagaaattcttagtttgttgtggtgtgaagtactttcttttcttctctccccactttctcccatctcccctttatcctggcctccggccctccctctcttcctttcttactccctttcatccttccttttggctgtagtggagcactttttttctatttattttttatccatcttttcatttattgaataattcaactttctactatgcaaagtccatgataagtattatttccacatatgggtacatttctatttctattctctattgtgttttactcacgactttgtccatctctgcactagtaccatactctcgcaattactacagctttccagtaagtccatatctcagggcatgaagaatcttaccaattatttcttctttttttcatgtacatttaaactcatcatatttcaccaaaactaaaataatagtaagaaaaaccaatcatgattttgactgaagttgcattaaaactatatattaattttgggagaaataacacacgtataatatgaattaagtttccttattcatgaatgtagtattgctcgatttatttacatattctttaatatccttcaacaaagatataaattttctactaacaggtcttgcatatattttgttagatttattcttcgttgttttgtggtttttgttggtattttaaacatttaaaaattatgtttattaatattaatatttttgttgctggcatatataaacatatttgagtgttatacattgattttataaataatcatattatcactgtttttctattgcttacattttgtttgtggatacatttggatttctatgtatgtaattgtggcatttgctactagcaatggtattattagtaatctctagtctttataattgttatttctttccctgagtctttttccttgacagaattccaacatattgttgaataggagtattcatagtgaatatccatatcttgttcctgaagataagaattacttttggaatctgcccatttaggatatctgttattgagattttatttttctttctttttactttccttctttttgatggagattttttatgaggttaacaagtttctcttctactcctatcataagaatttttactatataaaaatattaagtttttctgcatttttgagatttgacaaggtctctgtcctttaatcggttagtgtgagaataaacatttatatatttctgcattattaatcattcttgaaatcctttcaggcacccaaattgattcttgtgtattaatatttttaagataattgagtttctttgctaatattttgtttagaaattttgcatcaatctttatgaacaaattgacctatttttcttcctcataccacttttgtctactttttaaaattaaaattataccgcctcataaaatatgttgcagagtattccccattttacgattttttgtggaagaatttgtataattattgaagttctttgaaaactggtagcacttgcatataaaacctaaatgtcgggtcgggggaggggggagggatagcactgggagatatacctaatgctagatgacacgttagtgggtgcagcgcaccagcatggcacatgtatacatatgtaactaacctgcacaatgtgcacatgtaccctaaaacttaaagtataataataaaaaaaaaaacattaaagagaaaagtcttacatcattgtttaaattactttagtaactattcttaaaatttatgattttaaattctccttaagtcagcttttttccagctatacttctgtagcaatttgattctccctcctagattttcaaacattggcactgaagcttaagaaaactttgtaaaacacggcagtagctgcaacatttcccaccgagctaactgtttctggtgaaagcctaaccatccagttgactcaccattgttcttctattccatgatgatgtttcatctgttattcattcttgttttctttaaaaattgtcatcattggttcttcagcagcatcctacccccaaacataaaccccatgtgactgtcagaccagcttactctctgtaaattgattgctaatcggaaaatttgacctctctttatctcaatttcttgatccattcaatccatgcagttttccctagaaactcattcattccttactacattcattcattaatatccttgggatttatttagtgattctgaccctcagtttccataactttagaatagaattaacaccacgtggtttgttgggctctttatatacacataaagaaaatgtgtatgtaaatacaccttactattcacatgttattactgatttaattatatttttttctttattaaaagtagtataggtatgttttaggtcagagtgccactcctctatttccccacctcctccgcctgcactgttctggcagaatagtcacaattttctaacaagcagtaaggagagtttttctgcatgcaatctgaaactgtagctagcggacaattgggagacctgcctacagcactggagacacaaggtacagaggaaaacagctgtgatagaagacaagtaaactgaagagtctcagcaagagccaaaatgcagggtcctgcatggcactgacttttcacccaggaaggctgtgatgaggagcagctgtgaggcttccacattacaggtcatccttccaatggggagaagtgagaaaatggggagtgtcaggaaggatttcactctggggaaacttttgtactgcgtattgtactttttacctatcagttccacagtgttccatgtgaagaatgaataagcatgaacattttgcaatgaaatcatgcttgggtcctgaatttatttgcaccattttattaatttttttgaaattaaaaattcaaatgatgtatgaagaaaatgaatgatgatgagtttccaatgttggcctttatagcattgattcacctagagagtttcctatgtatctccaatagctatatttgaaagcaagcctattatttgggtttagcagccctctgtcagacacttctttttttatcatatttgctctataatcaccactataacattccataaagtttcagttatgcaagatgaataaattctaagatccactgcacaacactgttcctatagttaacgacacttttttgtacatttaaaaagtttttaagaatgtagatctaatgttaattgttcttaccacaaccacaacaaaagagcaggtggtgaaattgtgatgcttaatattactaaaaacaaatccagaaaatttcatctaagattcagaggcttactttgtgttaagataaaattgatacagaaaaggcagtaaattttcacttgtacctaattgttattaggtacaaagcacaccaggaaaaccttttttaaaagaaaagaaaattgtagtactgattccagaatcttggaaagtgtcataaatcagaattcttaacatcaatacgtaaatattactttttattccaatcttatattttattattaaaaaatactatcgcttacatacaatgtggctgtatgggttagaaatagattaagtatataaaataaataaatatatggctctaagtagtatatatattataaatcataaaataatatttttgatacttagaggaaatcagtgtgagagtcataaatattttcagcatatctatacatggtgaatgctcgctttaattatacatatttacatctctttgtattaaagaaacacaaggctgaaggatccaaaatgactttaccatatgtcatcaattctctttttcctcgttcttgtttagaaaaaataatttcaagagctttccttacgaaaggtctgcattttgatttaagcatttagagacagaaagaagcatacttatctctgattattctattcaattcatatttatacttgcatgtacacagttacatactatattattcttaaagttacaagattagatggattcaaaattgccttagtaaaatctggctgaattttctgatttgtgatgttaccgttgtttttgaaacaatatttatggtctagaaaaccaatttttaataactttcagcttatttattaatacccaaactgtatctgtacataccttggtatcattgatattattattattgctggtgtaatatcttttaaaaatccatgcatgaattatttatgctccctaaagtttcactctattatatatattacaaaatgggggaaaggttatttcatgtttttctctgtgggtttcgatgttttatcaatttaatgtgactctctcaacattttaatttaaagtaaaattaattataataatatcctccaatctaatatcttatgtactttagttcaacaatacattataaaatttagttaaactaggaaatgcacctgtttcaacaaattcgtttagagttttgagatattgtgtggaagctgaatttacactgttttgggaagacattccatgtggctaagtgggatagttataaaaaattaatttgaattaatctttataaacccagtgtaaataattatgttaccataataaccagaaataagttttagagtatttgaaaaatatacatattccagtgggccattaataactgaaacatttatttcattatttctggaaatctcaaacaaatcttttatgcttatgtgtgttaaaagtgaaggagagagggacagagaaagggaaaaacacagactgaaatgacaaaagagagcatgagacacagaaaatgagagaatatttattcctggggaacctataatgttatctcattaaataactttaatattccttctaatataaagtgagttagaaatgaaaggtcagtaaatgacaggttctatgatgtagcctaaatatttttcctttcttcactaatgtacatgtttctttaaaaattaatattggcagaaacatcaaatttttaatgtcatttctgagtgaatagaaacactaatatttagttgaaatatccttgccatcatatagaaaatatttataattttattagtataagtaaaacacttttgtaaatatatttgttaaaatataaattttttctattgcatggaaaattataacccttgaaggatatttttaaagtacataaattaatattcaaaaaccaagtaaccgatgttaaacaaaaattatgagtggtcattattttagactgagcttctgcactaggccccaacagaccagaacaaaccagaatggagtcacttgtgctaagtgccatgtaatcaaattgaactttaaaatggtccagttaaaaaaagaaaaaaacaacacaggagatttgcagcatccaatcagaaggggcccagttcaccagagctagcatgataaggaagtcctttcggttttgaccctgtaagaaaagtaactttgaaatgaccaatctgcctttcatgccttatttctgctttcttcagccctcttctgcttataaagccaaactcctgtgctcagttcattggaacactcatactattctatagaattaggtgttacccaattctagaattgcaaatataagccaatgagatctttaaactaactttgttgtaattttgttttttaacactgaagaacacaaaacaccttttaaaacgccattttctctcatctgtaagtgtgttttttacattagaaagggagggatttaattgaacttagtattttcatactgtatttactgctacaaatacgcagtaaaatttatggtcatgctacatgaaagtccatctcttaaggtattaatgaatatgcataagttatgtgtgtactgatatgcatatatatatgtttggaaatgcaggttaaaatatttcttgtaagttacatgactaaacatagagaattgacagacaattctgatgtagtaagttgaaaatgaagggaaaaatacgataaagagtgtcaattaaaacagaagttacacagtcttcctgatatttgaaagaagttaaaatggaataattcattcttattacttctaattggaaagcacatatattttatggtccaaattcatcatctataaaattaacccctaaaatgtagcagcacaagtgattaggttgctgaagactgtttgacaaatttactgaaatccattctgtcgtgtgaatgattttaatattaataattagaatgaggttttattctgtacacatcagatcattccatggagttagcttagagtgtgaagtaagaatgtattttgaaaggaaataaatctagacttctatagggaaaaaagactttgcttagggtcaaatacaaaagaatagctctaaatactttataaatgaaatggcacctgtatctatccacttatttaatttaaatgtagtaactgcaactatgtactaggaactgagatagattccagagattcaaaacaaggtagaattcttgcctttgagtatctcactggcttaactgagaaggcagacaagaaaacacacagttcaggtcactataagatgctctttgagggcagttaatgtggactaggtagggatgaggggtggcttaataaacttggagacatatgagttgaatctcgaagcttaggtaaagttaattagctgatgaattgggggacagaagtgaggagaaattgagtgaagggttgttatgtaagaaggagggtaaatatagatcctaggagagtggttagatgacaaatcttgaaagcctgaagtgacatactgtcagtgggaatgagaaagcggttctttagtgaatggtctttttattcatcaagttagagaataaaaacagtgtgtaaattcgggaaaaagggagaaaactagtttagtaatagacatgtagaatttgagatactcatggaacttgtgttcatggactattgaacataataagttaatttcctccttatgatctctctttgataaataaggagcaggagagtgaatcctgattatgtagggcctgatgtttataaaaattgaggcccccctttaagaaaaaatatgcaaaataaatgtgtacaaacttttataaaagtgatgtatatatataaatatgtataaataaatacttatctataataaaaaatcacattagattgtaaatttaagatagcttacaaacattacatcataggatttcaaataacatagttttataaattagtaaactgcttaatgcttcgtttttacatttttatatggtaatttaaaataatatttgtactgaggttaaaagataattttcttttcctctagaatgatttattaagatatgtttaaattgatgatttattaggaatgttccacttagcttcacaagtcatcattgataaagtaaatttttagtattattgttaaatacgtgaaaatcaatattgggtttttggtcatagccaagctgtaagacttgcaggcatttcaattttttgttcaatgactaaccttaagtactgtttgaattcatgatatacattaaccattgttacgttaataacatgacatattgtgagttttaggtatcttcattgatggcgatatttcatagagatttataaaacatgtactttacacataaacatgcctgcttgttgtagagctgatataggctgtgctctacaagcacaggaataatgatacatttaatatcatgtaactttcatcaataataaaaatttaaaattgtttatactgcattgttaactgtattcctggaagaataacgcttctgttttgatgacacattaaagagaactgaatgggatgattagaagaattttccaaggataagctttgaactttgtacatttcaaacctcatttctcccctactatacacatattctgttaccaggcaggctctggaccatttttatcaagacatgtcttctggctctttaaatttatgtcagaaaaccagtgtaaagtcacactgagcaatggggatatgcctggaagtcatttttacaccaggagaactagcaataacaaccatacacaaaaatatccatgaaccacatattataagtctcagggttcaatcatgtaattggacctcatcctcttttagtcagatcctaaaatgctcatgctcattccaatgctactagtcactaggtaaagtgtgatgaaaaaggagttggaatggagacaaaagtcttttttgttttttactgttttatttttccatatagatgcccaatttttctggttaataccaatacatatacagggcatgggggagggctcttaattatcttccattgatatatttgcctctctatgcattactactgagctggcttaactaacattgttcataaaaattcttgtagttaaaataccctctttttaaaatatcaaaaactcaaatgagaaaggcaatacaaccacattgctaagatccttcctatagtcttgaaaggagtccttgcaagtgagagacactgaagttgaagattcattgccttcaagagcatctgcttctgggcacacatcttactatagcataatactggtcagagaccataatttaaaatatgacagctactcgggaggctgaggcaggagaatggcgtgaacccaggaggcggagcttgcagtgagccgagatcctgccactgcattccagcctgggcgacagagcaagactccgtctcaaaaaaaaccatgaataatttaattacacagaattctaactataggcataaaggtaactaaatgaaaaatacatgactcatcaagaagagataagtaaaagtaaataatgtaattggagaataaaacattatgaattcaacaaacatctgccattttcaggaaatgatatgtacataattgaagattagtatcttagacaccaagatatttatgattttaatagttgtaaatataatttgtatcaattttatcaaatgtattatattccaaatccaattatctgcttttcggagtgtgtttattaggctaaacttgtcttgattacgaagaacactgttacccaataatataattcaagttgtagatttctatatgctgataacctctatattaaattaccttaaattttcatgctccttgagttgcagattttaaatagaagaggagggtatgtataatcaggaaaagactggctgaaggactgttgtccagagagatttttacagggttttattacttgagtcacctaagacttgagtcttattattattattattttggtccagaaggttcctgggtgactactgaatcagtaggagaataactgaataatttacatgtgtgtgtgtgtgcatgcatgtgtacaagcaatataattatggcttttattttaattattagaatattaaaatttcttgggatgtgattataatttatgtgagcaatcaatttaaagcacaatcttttttatcaatcaattcattactgtattagaaatcacgtttttgccatgatggcatgcttcaccagaatctacattcaaattattcccacagaaggaaattattgtatcagtagtgctaaacgtttatactgattttatgatagcattatcactaatatctaatgtctcaccttcatccaaatgaacttccaaaaaactttatttagagtgcatgaattgaatgaattcaaatcatctttgcaacaaacagatgtttcatttaaaacattctgatcactctgatataaaaatggcattacttgatcttttggaaaagttattctgctaatggagtcaagatattaacagctataacttcattaataatacacataaagaaacttggaattgaaaattaacactaattttgaaaagtcatttgatctaaacgaaaagtcatgcttcaaagagtgatatgcaaagggactttctgcatactaaatgattgctttggggcagagaattaactattaattttaaagcagatgctcatgtttcttcagcatagttgtgtttactgatttctgcatagtcaatgatatcactggagctctcattgcagatggtaaatgttcataaatatttcacacagattatgtattcatcaactctttaagaaacagaaattcagaactattttttgttttgaaattcagattatttttatttaaaagacattttatttttaagctatcttttgctgaaaagtgttattgcaaaataaaaatctattataaagtaaatatttataaactatatatttaatgaaaaataaaacattgaggaagtatattcaagccattcactatacattcttggtaaaactgctcatgctctttttctcacatacatttcatgaacatctaacctatgatttgtcaatatctccacaggcatttctgattggtatatttgtgaccctttgcaactctcagggagctgtgaggtccaggccacagcataatgggctggcataaaagggataccaattcttcaaaagttgtcacttgtttttgtgtttaaagaacattggaaaatagtttatttttggtcacgttttaggtataatgattactattaaagtcagatctctcttccttggacgtgtgtcttacacattacaagaggataacacagcaaaagctggatttagaaattggagggctgccaaacacatcatcatcattcttcattgcaatgcacttattaatagcaatacttaaaatacaatacagtcctgggcaaatgctaaattgggccagatgctaggacaccagaaacaacctgaagaatcttaggtaaacctaattattatggtcacaataatcctaaaaccctctgtgaactagcccttagtagctttctgacatccgactgcccttcactctgttctagtctccctgggcttcttgctaatgtttcccaaacttacacaatattttccaatcattatgcttttatgcttgctgctctctctgccttaaaagctcttgtacaagatgacaatgagctacctcctcatcttcacatctatactcagccagttcttctccacctcatttaaaagaacaaccacgaaaccctcaccaacaatgcacactccttgtttacattccctgctaatatatgtatatttcacctgtttattagtttaatatatgttttccatcactaaaatataaggctgtgagggcaagagttattatccgttttgttcagagtggattggcagtgatgagattgttcctggcatctggtagccattgaataaatgttttgaaccaattcatctgctatgggttttcttatttttacttattggtaagctatcatcagttaactgcctggggctggaggtgaatttgagccagtaattttactatgtacacttacataacagtaaatgggaggatatttaagtaaaatatgttatttattaaaaacttaactcctatagaaaaaaaatcagaaacagattactttagttcatttgtgctgctatatgaaaataactgaaactggataatttataaatgacaggtatttatttctcacatttctggaggctgggaagtccaaggtcaagacatcaacagatttgttgtctggtaaggcttattatctgcttcaaggatggcacgttcttgatgcatccactcatggcagagggatgaatgctgtatcttcacatggcagtagaaggggaaaggcgagagctagttcccttgagccattttataagggcattgatccaactcatgagggtagagccctcataacctaatcatttgctcattgctccacctcttaatatgattgcattggtgattaaggttcaatataaattttggagagacacaagtattcaaaccatagcattctgcctctgctctcccaaaatttatgttcttctgataagtaaaatacatccattctatcccaggagccccaaaagttttaacaatttccagcatcaactaaaaagtctaaagtccagagtctcctctaaccgtcatctaaataatacagagttaccactccaggtacaatttattttgaggaaaattccccaccagctgtgggcctgtgaaatcaagcaagttaggtccttccaaagtacaatggtgtacgatagaatggacaataccattgaaaagggataaataggaaagaagaaaggagtaacaagtcccaagtaagtccaacacccaacaaggcaaacaacattaactcttgaagctgggaataacaaaaaccaaaaaaccctctttgacgatgtgtcctgccttctgaacacactgtgcagagtttaagcccctaaggctccgaaacccccattccttccatggctgtgctgtgtgcagcccacactgcatttctcacttgttagagttgaatgccaacagctctctcaggctggctttactagcctggagtctcagaggtggcccagcccccatagctccactaggcattgtcctagtggaggctctctgcaggggcctgaaccatgtagcagttctctgtctggggtctggggatctcaaggacctctccatcctttgaaatctaggcagaggtaggcatgccttcacagcttttgcactctgtgcctgcagagttagcaccagctggatgctgcaaacctttgccacctctgtctcctgaagggtggctctggttgcactgaggctcactggagccacagatggagtggcccaggagtgctgcactagaatgcattgagcagaaacttgaggcagctctgggaagtgagccctgagatcccacaggtgctctgaatccctctttgaagtctttctgtcctcaaggccctgacactgtgggcctgtgatgggagtggcagccttgaagatctctgaaacgttttcagggccactcttccattgtcttgatgaatagcattctagattccttctagacatactaatctacccaaactttcattggtaacacccttggtgttttatcataaacacatttctctttctttaccaattggccagtctgagaatttgtcaaatccttaatttttgcttcccttttgatgacaaattctgtcactaattcatttctctcttattacatcttactataagcagtcaagggaagccatgccacaccctcaacactttgcttagagatttcttttaccaagtatcactccatggtatttcatcactctaaaattcaacctcccacaaaatagtaggacatggatacaattcgacaaagttctttgccacttcataacaaggattgcctttcctctggttgcaaataacttgttccccattttcgtatgaaacctcattacaatggcctttcttatccatatttctagcaacattttgttcgcaaccatgtagataatctctaagactgaacctctctctatggtcttctttctttcttcttctatcccccacctctcctcctcctcctctacctcctcttcctcctcctctttctcctcctcctcatcctccatattgcagcctctccccagtccacatagcaccttctacgtttttaggaatttgttacattagcacctcactccttagtaccaattctgtcttagtccattctagcagctataacaaactactttagtctgtaaagtctaaaagtctataaagggtaatttataaacaacagaaatgttttgatatcacaggggtacagcagaagagcaatttagcccaggatggatcataccttgagtctcatccatatctgatttagaagatatttagatgagactctgggttttagatttttgagttggtattaaaacaaattaagactttgagactattgggatggaatgaatgtaatgtatctgtatgtaagaagaacacgaattttgggggacccaatccagaatgctatggtttgaactttcatgtgtctccaaaattaatgcttaaaattagtgcccaaagcaatagtattgggaggtggggtactgaggatgtgattaggtcatgaggactctacgcttacgaatgggattagtgaatttgtaaaggggcttgaggaaaccagccagctgtttttctgctcttctgccatgtggagactcagcattcattctctccagaggatacagcaagaagacaccaccttggaaacaaaaagtgagccatcagcagataccaaatctcctggcccctggaccttggacttctcagcttctagaactgtgagaaataaatttatgttgtttgtaattagccagtctaagggattttgttatagcagccagaacagaataaaacacaagttaaagcacacacacaaatacgaaacggtcatttcaaatggccaattcagaacatgtttgtttctttagagtgtttcagcaattttgataggcaataatctttaaacagtgacacacagatctctagtctaattgctatttggcctttgttggtgagatagataataaaagctagacttttcaacatctttaaaatcatagtgcatttgtggatgcatgtaaaaggtgactaaaggcctacaatgactcaaagggggaaatttgtgtgaaaggcaagcaattatgtgaccttattcattgtggtaacatatttttgttacttttattaatccatagatctttaattttagaagcatgaatcaattttcatactccatcactccagtgaccaaggcagaatcagaattatgcttacacatttaattgggggagagcttgccgaatcatctgcattttattttatgattaatcatgagaaggatagagttgagtgcttcacttttatattagtaaagaaaattttttatttttgaaatttgcaacagagctcaattaaattttgatgaacatttccttagccttttgaggattctgttcatttctgtgtcataatttcataacaagaggcatatgtaaaaggtcataagctctgattttccttaaataaaatatggtagaaatttggttatataaaatgatattttaaattaagaagataatgaaatctgtgaaatctgttatgcattttctaaattatacatttattttaataggagaatatattccaaagtttcactatgaaatatgcatatttgaaatatgtaaatctgtaggttgactgttgcattatatttttaaaattatgtgtcgtttgcatttagttcaggtagatggaagcaaagatttctaagagcagctttctcacacacaattaattattcttaattatcctgatcaatctgaaaaataatttacatattttaaagttatcttgtattttatttcaattcattaagtgcttcctatttctcacttaaaattttagaaataatgtgagaataaaccatctgtattttcatgaagattagattcagaaggggaaaagtaatgtcacaagtatacaaaaaacttgatatgaacttttcataagtcacattaacatgtgaagttggtgtacagctagagctatacatacttattttaatgtagtgaaggaaaacatattgttatataaagcccaagagtaatttatattttatatttcatctcttctaactaacctatacctccaaataatttattcaattatatcacaacatgttccattaggaaagaaacaacttatttgaaagagactattgtttcagacaccttgaaacagaataatcaggatcagggagagatgatttatataaagagatagaatggaaacacataatacacacccatttctgttttaaaaacaattaaagataaaaaatgaaatgcccagtgagttttagtatttgccagataatttagattaggaatagttttagttcaagaaagttatttcctcttataaacatagtttttgaaaaaaaataaagttgggataaaagaagagttgtataccaaaagaatacatcaatctggtgtggtaaagaggaaaatatttttaaaaaagaatttggaagaatgcataaccacaggtttaaagtagcagaaaaaatgcatactatactttcaagagtatgcattcaaaaacctattgttagcattggaaaagtaataaactagaaatggtgataaaactaaaatgtataaatcaccaagggtatcagagtaatagggagaccttatgaaacagagcaacttctaacgccatacattaaaagggaatcactgcaataggacactcttagcatgatcaggggcaatacagctagaaaacagggctgggaggattcacaagtgagcagatcagtcattgagttcagagaaagggcaacatcatagcctggccagagtccccgttctgagcaactacctgtggcatttgcctttaggataaacaaagactagctctctaacagaagtctgagtctgacactagggatgcagtgtgggcatcagtatcagaggcaaacaggacattctcatgttgatcaagatgaagctaaaagttcaacacaattatatttaatcattttttaaaacaaacttttgacattgaatattttcagccaggcaattctactcatagccactgataccataaaaatatttgaacacactttcaagaatatgcagataaattgatagatattgacgtagcatatttggtaataattgtaaaacacaggcaatataaatattcatcagtaatgggatggctcacatgattatggaatatcatgcagcagttagaaaaatgaaactgatcaatgtctactgaaacggaacaatgtgtatcacctgctttagagtgcagaaagcaagttgcaagataatataaaatctatattctgttacgtaaaaaactatctacctatatttcatatatatatttcatatatatatactatatatatatacacctatatatgtgtgtgtgtgtgtgtgtgtatgaatacgttatagatagaggggaatatgctcatttatatgtgtgtattagattgggaagctacagcaaacaaccacaataataatttctgaggagtagtagtgctcaaagtgggacctttaaatttttttctaaataatattcattgtagtgtagactttttacagttacatacattactttcattttttaaacatgttaagatagagcagaggataacaggatgcctagaactgaaagagtagaaggaaacatgtagtacatatttaaagtgtagtaggaaaaaagtgagatgagagaacagggctaaaatcaaatttattccaatatatttacatagtgctacaaaacagtcatgtttttattaattattaattcatatttgtacaaataatacggataataaaccacattcactgaggacatgctatgcagtaagtacattgttatttgcttcataggcattatcccatttaacttcacaactatcctataaggcaggcagaaatcctcattttacagataagataatgaagccacacagaggtgaaactgtaaggcttgtaattagcagagccaattgacctcttgtttaactatgaaatacaggaaaatcctggattaacttggtttgattcaacttacaggggtcttagaatggcaacagttttgaatgcacaatatcctaattcaaagaagagctacttttttgaagtccagagaatattaaaggacaagaaaaagagccatcctgactgagcttgagtttacaatactttacttttgcttggctttatctacttggggacttcctgcatgtagctagctcacttagccaacagtctgatcatgatcctctagattctggattgtgaagcttgacaaagacattgttctgaactaaattcctgtgatgagcctgtcttccacaggaaggaggttctgcagatcactgctcagcattgggaaactgatcccagacagcaggcagcaaggcagtagaagaaagagctgaatataatgctgaaagactatgctaattaattatactttatgaatgtattttttgggtaagacactatggtacaaattttattctgagtttttaaaagagtactatttaaatacttggtttctggttcctgagaatgagaagtaagactaattttaaatcaactgccttttttttaaaaaaaaaaaatgaagcatgcataaagcttatagagcttctgtccacttcatgtggtctaatgtttaccctcatgttgacagaaagaaaagaggtcaatgaaataaaatgacattaattatttaactaagccaaattaatggtgatttgtttaggtgcatatcagtaacttcaaaagtatacagtttatgttaaaaatttattttactagatcttacctgttaacaatgaagtataagagagtgatattgattagatttggtaagtagtaaatgaaatcgtatgatttttttcattaacccatttatgctggaggttgcaatttttaaaatttaacttgaatttaaaaataagaccttggcaatgaccttaagctgtagaatataaataactcctacatgcttagtgttccaataatggaacactaggcataaatggactaactagctttctctttacttttagcagatattttaaatataagaagtacaataaaagagaatcgttcttcaaatacatggtttggcagtgttcaaactggcattcagctagtttgtcgtgtgtgtgtgtgtgtgtgtgtgtgagattaatatcatcattagtacaataaggagcattacttcacaatatttagaaagaagaaaaatctgctagaaatggactattttggaaaaccagtatttgcactcatttctcttacgtagttgatatttcatttttatgtactaatatgctgctgtgttcaaataacattatttctacatatgtcaggcagcttatttaattaattaacattaactgagttaatggtaataatattatccttggacttaccctggcattggtccatttccagaaagactgtaaacctgacgaggatttaatagatactggaattttctgtaaattctataaaggtgaaaatgtggggaaaaaatttaataatattcaatacttttaaaataagtaatgtctctcagtgttataaaatatatatagttgcaattaattatataatttaataaaaaatttctatcaatttaataaattttgaatcaatatcagaagtccaacagctcaataggaattaatggttttttaaaaggcttagtagccactattaaggcaatatagttcataagttagaaatattgcttggatccttaatatgcacatacatttaggatattctctaacccgcttttgaacattatttagctaactagatttcaaataaatgtatttttttaatatttcagtataaaattgcctaaatatcttctctcagtaaatccttgtgaataatttgtcctctatagatctctgatagatctgaaaattatctatcccctatatgaaacgggactgtacattgtatatgtgtacatgtaagcaaagaatgtagcctcatctggcctaatcatttcacataaacaagatcttgaccagtcatctcacaaaattgctaaactgtcttagcagcatatgacaaataattctttttttctgaaagaaaacaatctttataaataaatgcaatagaaatgtttctatgcatgcacatatctcacactgttttaattcttagacaaatactaaaagtaaagagataaatagtacatcaaaaagttaatttaccacaatcagttaggcattattcctgggataaaaagttggttcaacatacacaaatcaataaatgtgattcaccacataaatagaattaaaagccaaatccatataattatctcaatagatgcagaaaaagcatttaataaaatacaaaatcctgtcatgaaaaaaaatcttcaacagactagacatcaaaggaacataactcaaaataataaaagccatctatgacaaacccacagccaacagcacactgaatgagcaaaagctggaagaattccccttcaaaactggaacaaaacatgcccactctcaccactcctattcaacatagttctggaagttctaatcagagcaattagacaagagaaagaaataaaaggtatccaaacaagaaaataaatcaagctctctctcttcattgataatgattctatactcagaaaactgtcaaaattccaccaaaaggctgttagaactgaagaattttagcaaggtttcaggacacaaaataaatgtataaaaatcaatagcagttcaataacatccagccagagtcaagtcaagaatacaatatcatttacaagagtcacacacaaaaaatgaaatacctcggaatacaactaaggaaggaggtgaaagtgctctacaaggagaaccacaaagcactgctgaaagaaatcagaggtgacacaaacaaatgaaaaaaaatccatgctcatggaagaatcactatcgttaaatggctattctgcccaaagcaatttatagatttaacactatttctatgaaactaccaatgtcgttcttcaaagacttagaagaaaactcttctaaaattcatgtttaaccaaaaaacagcctggatagccaaagcaagcctaagctaaaaagaacaaagatggaagaatcacaccataaggctacagtaacaaaaactgcatggtactggtataaaaccagacactcaggccaatggaacagagtagaaaactcagaaataaagctgcaaaccttcatctgatcttcaacaaggccaacaaatacaaaacaatagcgaaaggacttcctattcaatacatgttactggaatagctggctagccatatgcagaaaaatgaaactggactcttttctttcaccacatacaaaaattaactcaacatggattaaaaatttaaatgtaagatcccaagctatatttctaaaagaaaacctaggaaataccccacgtgacaatggctttggcaacacattttttattaagtcctcaaattgcaacaaaaacagaaattgacaattaagctacagagcttctgcacagcaaaagaaaccatcaacagagtaaagtgacaatctgcagaatgggagaaaatatttgcaaactattcatccaacaaaggtgtaatatccagaatctataagaacttaaatcaatgggaaaaaaacaacaacaaataaccccattaaacatgagcaaaatacatgaacagacacttcttgaaagtcatacaagcaggaaacaaacatatgaaaacatgcttatcatcactaataatcatggaaatgcaaattaaaaccacaataaaacaccatctcacgccaatcagaatggctattattaaaaagtcaaaaaccagtggatgctggcaaggctgcaaagaaaaggaaatgcctctatgctgttgttgtgaatgtaaattagttcagccattgtagaaaatggcttgaatatttttttaagaacttcaaacagatctaccattcaacccagcaatcccattagtgggtgtaaactcgaaggaaaacataccatataccaaaaagatacatgcacttttatttgcatccctgctgtattcacaagagcaaagacatggaatcaacctaggtatccatcaatgctgggctggataaagaaaatgcggtacatatatagcatggaatactacacagccattacaaaagaatgaaatcatgtcctttgcagcaatatggatggagatggaggccatttccctaagagaattaacacagaaacagaaaaccaaatactgcatgtactgcacgaaatgttaagcagcagctaaacattgagaacacacacacttaaacatgggaacagtagacatgggggactaccagagtggggaaggaagaagtggaggaagatatgaaaaaaactacctgttgggtactacgcttgctacctgagcataatatactcatgtaacaaacctgcacatgtacctcctgtatctaaagtaaaagttgaaattaaaaagatttttttaaagttaagggatatatttaaacctaaattggttttatatacatgtgaaaatatgattattttataaacaaattcttatgatatttactgataaaactctccaaattcagtatgtaatatctgctcatatcacctagagttgttctcaataccctcttttccctggcacctgaacctactagtggacaactctgtgccttcctaaaagaaaacctaggaaataccctatctgacgttgtccttggcaacaaacttaaaaaaaatgcctatcaaacctggctattctatcccactgccttacttaaggtcttcaagttctttcaccagctttataaatttcttggcaatccagccttcctctatactgttgtctaagtacagccatgccttatccatgatgcaaagtttatgccagtgtccagttattcacaatataaaattaagacatcttcacaattcagccacagtttctctctcatctttcccctctttttccttacattgtcatcccggtaaattcctcttggttgacaccctgccatttcacaagtctgcctttctccttctttcattgggcaaacatctaccatataataacctataaagaagctccttcttctctaaagacttcttggtcttcagagatagttatctccttctctgaactttgatagcacttttatcttaaacatttctacttcaacctgtaatatatggtattgcaacagatctatttatgtccctgcctctctgcacgactgtgtattatgcctcttattcccagtcactagtagagtttggattcaactaggcattgctgtctgaacacatatgtgaacattttcagacttattgattgatatggaaaagtttatgtggatttatgattctgtgaccttttgcaacttatctaacatatcaaagtcaaaaaagccaaaaaatttggaaaggaaaacactgaacgggatcaccttgtgaaaggtgcctcttatgcaggcagaaaaattatgtttgcattgaaaacagatcacctttaaaacatatttacatttcatttgacttcgcgtggtcccagtcaatgaataaagaacaaaacacacgtggatgtgtatatagaagagctcgaagttgaagcccccagtaaatttaatttacttaacattttagtgtaactatatatatatatatgtatatttttaatttagggaaaattatttatatgtactggtagaaagggaaggcaaatattcaactaagggtcattctacatgattcatattatcttaattggagaaaaattattttcctttgaaaatactattttttttctcttcaaacttcaatattctgtaatttccaatgtggatttaagtctcatctaatcctttgtggaaagttttctttttttgttaaactatcaataacatatacagctaactgactgtaaatagtaaagaagaaagtaatttcagcattattatttaatgattattttatgagtaaaactattccctttaataaagcattaggaatatttttaattattaaaacattatttaaaataatttctatcatgtttagaggagtaaaacataactatatactgatgaaaagaaaaaatcttatactcattttattttattttattttattttattttatttatttgagacagagtctcacacggtcacctgggctggagtgcagtggcacgatcttggcttactgcaacctcccaggttcaagtgattctccttgcctcagcctcccaagtagctgggattacaggtgcccacgaccatgcctcgctaattttttcgtattttagtagagacggggtttcactatgttggccaggctggtctcaaattcctgacctcatggtctgcccacctcagcctcccaaagtgctaggataataatcttacactctttaaagcaaaaatgttttgttgattcaataatgaaaagcattcttcatttcatggaaagaaagctggaaagttaaatggtagaaaaaaattactttattcatggaaacatttcaactttgctatttggtgagccacaaaggaaatttgttatactgttatcatgtttgttatgagtgctttcatctgcttgcttatttttggttgagattaggagagttatctaaaaagcattaaggcaggtataaatgcatttttgtttatgactgtcatctttaggaagacataagatttactcttcaatgtagtgattttcatatttgtattaaataatatgatttaatcattcattcattacaaaataaaatgttatcagccagaatgctgaaatacctgataatgcagctcattattattcagattaaatatattgtacttctccaggaaatatggcatcatgttctccaaaatgcacatgcagaaaatcattataatatattttgcctagatgttgggtataaattcggttcctcagtactgaattatgatttatgtggattcatcttgttaaccatttagagaaccaattttcattcaacagtatttatgaagccagactctttgttaggggataggggtgataggtggggtagagagaattcaaacacctgagctataatagtaaaaatagttacaaaaggccattgtattaaaatttcaatcctaaaaacaagatcatataaacatattaaatgctagcatcatttattttgcattaaaattagcagagaggaataattgtttttaagcatttttacatcatagttttgtctatttttttacatatacatgacatagacactaaaatcaatcaaaaaacataccgttctccttgttttccaccacttttggggttcacaaaaactaaaagtgggtgagtaccaggcacaggagtgacctataagaaaagttatatacatggaaaaattattaggcccattatatatgaagaagactccttgttatttctaaattataaaataccaatacgcaatttcaataatattactttccacaatgtgtgtgtgtgcatgtgtgtgtgagtgtgtgcgtgtgtgtgcgtgtgtatgtgtgtgtggtgtgttcaacaggaaaacctcctccacaaagaaaggcatgcctatctagatagagggccgaggggaaggcagtcaggaagagggaataacatttgtaattcctgtaagataaaaaaaaaaattacgattttcagacagtaagtgaacaagccagaatacagcagaatttgaggaaaaagggatgagaagcaaagaaagagatcaacttatagagaggcctccttttacgcaggagtcctaattgagagtttcgaggcatgtgtggaatccatcttcccaaccacctgtgaactggaaagaaactcaataagatcctttgaggtcccttttggcctaagagtccttatctacacaatttgttcagtgctttcttttcctccttgctgaataggttgctagttaatcaagtatatttgctaagtagagtccattaactattgatctctctttcaggtaacacgaattgactcgactatacgtcatgtgctactgctttcatcacaactcagctctcagttgaacaagaaagacaaagtttctgtcctaatggagcttatattatagtggagaaatatacaataaacaaatacatatttagcaatgaaacatgccacgatgggaaataaagcaggtaaggtgatagcacgtatttttgtgggtagagttgttttacgtagtgtgggaaaggacaagtgttgtctcttacctgattccaatgttaaataacagactttttaaaataaaagtattcctattcaatgtaaccctatgtaactcccatctaaatacagtttgatgaaaaaaatttaataacaaaagtattcagctaattgtgtcctctaaatactaagttgaacagttttggatcaatctgcttttttgaaagtacattcaaattatctttactgcagtgttatttctcccctagaaagtagtcttaaatgtttaatgagacaattaaaaacactcattttaccatatcatgcccttccttcctgtttaacaatataagttaaaatattctactaacatattttcctccacttctttagtaaaatggcatttttctaatgagaataggcaatggggaaatgttaaaatctccacattaccgaagtgggaagattgactgagatactcgtaatttttctattcatatccaactagctctcattataatttactgtgtctgtttctattttactttccattgcaaagaggacaaagtttctttcttcctaatttgtctccaattcagctgggagaaggatgagcaggaaaaacttatgcactaacttcccaggtctcccctgaaccaaatgtgtgcaatcaattaatgtacataaagtgtctattatctttaagccatggtggctgcggattgcaatgggtaccccttcctcccattaaaaactaaaatcaaacaaacaactatatctaaaaacctgtgttcgattttctttatttctcatcctattacaaattgaaactcctaacgttttcataagcaaatagcaataataaatagatgtagattttagttgactttttagtcaatttgaactgtttctactggtttttaagtagaaatgggaatctcaaagtaaacagatttttaagcatgagcaaagtattaactctgaacccaaatactcattaggatgagttttccttttctccctaaagtcaacattcattttataactatatgagattatacaaaaattcatgctgagtccaatatatggaattattttcaaactatgttttgaaatgtctctcagagatatttaattgtgagaatatttatagacatcactataaattgtcaagtaaaggggaattaaaattgtattttaagttatatactgttatgaacaaataaatatcccactggaatagattatagtctgtaaggaatttcaaaataaaatacaaaatcttgatgtaatttttaggggtagttaaatggagaaacagattaaatgtattagaaaaatcagagaatttaaagaatttagagcaatgatgatattccacaagtggcaaaagttgaatatccaatatggatatacaggaataatatcaatcaattagcaaccattattttacataatacttctctcattattgagtatgagttcattttcagacagtcctaacatataaagtatgagataagtaaaattgtggatattatcacatgtagtctttcaattagttaatttgatctgtttgattccagattctggttttcagagaggtccatcaaataagaactatctttgcattgtattgcaatgcaaaacatgtctactgacaaaatgaatataaatagttttcttagtttctgaaactcagtatatctgattttggtgaataaagttttatggaaatatcttacattaatattttttaaattttacagtaatatttttatttttttgaaaaactctcaaatttacagaaaagttgcaatgactctcaattaactttttccctcaaccacttgagagtaagttgccaaaattctactccatcactaccactcccatttacattagtatttcctacatataaaaacattctctcgtatatacatatatatacatatatataatatacatatatacatatatatatatacacacaatacaaccatcaataacagaaaactaatatgattttggactagttttgtggaaaaaaactattattgggacaactgatgaaacctaaatgggatatgaggtaccaatgtagttaggtaccaacgttatattcaagcttactaattctcttttggattgtatccaatctgtctatgaatttagaatttttactttcacaaaacaattgtgaaataatatgtaaaattcaattattctgaaaatacatttgctgcaatcctaaaatattgtgtcctttttgttatagattttggtggagtaggaggtgaaagataaaaacacaactatgtcaaaaattctgtcagctgaaaactattcattctttgaagtacatatatttatacagcatttgagatcatctgaagtagaacagcatatagaacagatgacttcctagttgatttgtttaaaggatgaaagaaccctcaacctgctctcaatctcccatgactcttccattgtgcttgaggctctctctacagagccctgtgtcttttcaaaacagttaaacaatacttgagatacagtaatacggtttcacacacacaaaaatactgatgaagagagaaagtgtctaggaaagattttatagcatctgtggtagttgaaatcttgaagaatggttataaatttgatgtgcagggtattccaggagactgttcacactggattctccaccatactgaatagaattcatcatgtaaaatcttacttaatcacataaaggggcagttaaaaacagtacatttaaagagcatgattttagagttagactggttttggatcccagttcaatcacttctctctatatacacactctgtcctttaatgatctcatcttatctgatggctgccatcaatgcctttcactcccaaattcatgtctgccttttcttctaatttctaggttcacatattggtctacctacttgatatttttatttggatatctaacagcagcagaaatttccctctaaacattcatacagatgctcccctatctcagtcaatggcaatttcatcatttcagttgcatggtccaaactattaatatcttggagaagttcctgattcctcacttttctcataaaccctgtagtcaattcatcagcatatcttttgctcattcctcaaaatatatgtagaatcccatcacatctctctacttccactgctccatcctaacaagcctacgtcttataacccctgaataacttcaacagtaatctactggactcttggctccccaacaatctaatctttataagagtaagccttttaaaataccattcaatcatgtcactcctctgcttatctttcccaccaatatcttctcatcacactcagatcaaaagtcagtctttattgaagccttcaagcctttaaaaattctagcccctgttacttctctgaattacttgctaccactttccatcttgcccaccctactccaactacagttcttactgaccctaggcatatacttaccttagggttgtccattccccatatatccaaatgaccaactgcttcatctcttttaagtctttacccaaatatcactttattaatggggcctaaactagccattgttcttaaaattatagacaattctgactcttagccctgatctttcttatcttactcagctctatttttacatcatttattatctaccattttatgtatatggagatactcagtttaaaggttgctataatgctcaaaactatagagtaacaattctgggtttacattgagagttagaatgtcaatgaagtgctaagtatgaaacagtcaacagggttaagaattctaaaatgagcaaaggacatacacacacacacacacacacgtacacacacatacatcaaagaaagtgaattgattatatagagataattaatttaatatacatatatactatacacttacatttagtgcatgggtgcatggtttacagtcttggtgattacaagaataagatattacaaataaggaagataaaataaagaggcagttttgtgaggaaagacactggttcagttttagatatttaatcataaaggtccccctttctttctcgtgctaaaagtgttacaaactagattcgttacttcttaaatgacccttttatttggaaatgtttctcaaagaatatttaggaacaaggtaacttcaacataaacacagtttaaaacaattgttctgtttttctccttatttcttcacatgtgggagagccatctgtaattttatatctcttgcatggtaagaagtcgcagtttcaattacatttgatcatatgtattaagtgtaaacctatggtgtgagcgatgacaaagacagagtgcctaaccacctctatttgaagtcccctaggacttgggttaattaatgagactcatcctaaggttatacatgatctattacttcctctaattagaaataataatcctgatcattatgctggttagctggaaagaaataagatgaatgtgcttaactatgattaatagtcttctttaagcagtgtagatctcttctgtcactgaagttatatgcaaactgggctgcaactcaatgctttttaatgatacatactttttaaagctcatggaaaaaattaactttatggtagatctttttacctttcttgataataaacaaacattttggtattttaaaattgataaatacaacacaaaattactattttttcattttgcatataatagctatccagaactttattcttttattttttttctccaaaactatgtggctatatatgtgtattctattttggtcctttctgctgaggtacaacaggcttttgcacatgattatataccaactttttttaattcaaaaaattattactacacatatggtatttttttaactggtgtttttttagggctgatttctatacttgtcccactcacaattttagctgacacttttatatgtcaaagaaagttataaaaagttattatctggttagagagatgaaacacttccacaaagaatgttaatcatctaagatttttaatgtgactaatttagctgtaataaggtcgaatatttcagattattttaaaatagaaaataaaatcaaacatattactatgtaggtttaaaacctttaaaacactgcatgtactatttaattttggttttgatgtccgggcaaattgaggtatgattatgaaaatcttggaaaactgagattagaggagttaaaattctgttgcatacataaattgtatctcaaagcctgcagcaatataaaagcacacagaagaacaagatgttcagaagtttagcagttacatacatgttaaaaaattttaagcaaagagacagggtgtcttgggagtgaaacacataaactctagtcagatggtcttcattcaaaccttggttttaccactgactgtgcccttggggaagttatctcacttctgaacatcaacatgattttgaaaatgatgataataatggtattgatctcatatgtttattgagagaattaaacaagctaatatgtataaaataccatcataatgcttaagctatcctatttaacaaatgatatatgcttcccatctgtgatgagaagtatgtgcctagtcatgtgaaatacaattagatttcagaattaggcttccctttcattaatttcattccaggaacccagagtagctgaagatttaaacttatcaatattaggcatccacgtattgaattaaaatgttgatttttttcaataaaaattttataggataatttaattaatttttttgctaataaaattgtggatagattttatatttgacagctcctatgaaatttctaaacatatggatatgagttccaaaatgtacatcttgatttacttttttaaaattaaattttctgttctctaatatataataattttattattcagaattccctccttttatatttgagtttaataatttatgaaaaattttctattcacaatggatttttagataaaaaacaaacagtaacttagttatcaatatttaataaattattattaaattttaatgacattcaagatgataaagaagcaagcatttaggcatcttctctgtgccctgaactgtgctctcatattgaaaaaatacaaaagacataatctatagtatcagaaataaaataagaaataaaaaaagatgatagaaaatcaaatataatgaatgcaagtgtgtgacatactgtttgtatgttaaattgttggtaaatattcccagagaatgtgaaacttgaagtataggcagttggaacacaaaaacataagtagaaaaacatacttaaatccacaatttcataaattaagccaacgttattgaccatttttctgttgaagtaagaaacacaggtaaaaaatagaggtaagtaaatgttatacattcaccccatacaatgtcttaaaatgctattcttgatgccacaggcggtaaagataacttacacgtttttatataatagtattaaaaaatgactacctgtgtttatttaacctagatatatatttgaggtttaaattttgacttaaaattttgacttaaaaatttgaaagctagaaatatattacaatacattctttattattaaaaatatttatttagaaaaaaatgcattcagagttcattttcttctttcctaaagtcttttttgctatcagagtgactcttcatatcatacccatactaaatataaatatatagagagatataaagtatacctgtaaataaataacacatatgtatttaataagtgtgtatatttagcaataattttcaaatctttcaaaagatctcttgccaatttgagtttaaatggagataaaatcataaatgattaatttaaccagaatgttactctgtcaatcaaccgtaagactgacatcttgataaattaataaagatctttctgaaagagtctactaagctaatatgcagattaaacaaatgtgttgatagctgaacatatgcccctttagagcctagaagtatcaaatatgaaacctactaaaattttgatttaaaaaatcatacctgcaggccttgtccatctacagtaacagagttggctctttgcattttattcttgtcaatcactttgtttggctgctgggaaccactcttttcctttttcactgttgattgtctttcctgtaaaaaagaaaattttgataaaaataaaaattaggaaaataacataataaaatgttaagttgtttttactaatagaagagtttcatggttacaaacacaggctcaactttctaatttgaagttcctagtgaataatatgaaagctgttgttttcaactggctcaatatatatgatagcttcatgatcgaaccaccatttaaagaaataatgagaaagaataccaaattgtattatccctatgtgcccaattatgactctttatcaaaagttactaacgattactgaagttgattattttcatatgtaatgatacagataaagggtacaggattataatttaaagaatgtggtattgagtactaagaaaagcttataaatacatgcaatattgaaaattatttttaattgcatgatggacttttaagctactatttatatcaaaaatagcatatatcttaaaactgacattccatcccagctaattactttgttcctcatagtaaaaaaatttcttttaggagttgcctgctccctgtttctatttcctctcttttcactctctcttaacacaacccaatcaacttgtatcaccattactccaccaaactatcttttactaaaatcaccaatgaccgtctcagtttcacatctaatgatcagtcttcatcttctcaaatctttcagcagcatctgacagaattgatctcttcttactctttgaaaacttgcctcacgtggcttccaggacacttctttctctgagctctcttcttccttcacaacttcgccctcatagtctcttttgcccattgcttctccagctttgccacctgtaagactcagcctcttccttggacctctcatcatctctatctaccctcactccctaggtaacttcattcattcccacaactttcaatttcatttttatgaagatttctaaatgtataattcttgttctgatttctacctgagccttaatttccacatgcagatgctgtttctgtatgtccacatgaaggcctaaagcacaacattgtaaaatgtccaagattagttttaaaatttcctgcctactctgtccctagaaaataaatctcaaactggatgacaactcaccacctgcctcattacatggcttaaacatccattatctttttgtgcttggattattgtaactatcacctaatgaatcattctacttccatttttgtctccctacactcagttctctacacaaaagccaaactcatcccttttttttaccctactccagctgcactggcttcctcattgttccttgatcataacaatcatgctttaaattcagagctcttgcaatcattctgcagtctgctggaaaacttgccactgcacatttgtgggccttggtcctgacttcaggatgtggtcaaatgtcagagaagtttctctagtcccttgagcctccttttaaaacatcaattattacaacctaaagtattatttatctgatttgtttaattgtctgcattctttcatcttaatcaaagttccataagcaaaagaactttctttgtgtcactggtctatatcagatcctaaatcagtgactaacaaaagtcaggataaatcaagaaataaatgaaaacttttttgaaaagttttctaagttcttgaagcaactgttgagaaggattcttagggattttaggcttgatgtgaaaaattgtcctaattgattggcaatgcatgccatgggtgcttaagtgctttagtgccacacatttcctatcacttactcagctatatatatttcctagttcctatatttgcttgttagagtaccatttcaatttctataatttagaaagatcggattttatttgtgcaaatgtatggggtaactgagaaatgttttacatgtaaagggtatttagagtgatcattgcccaagtacaatacatttattaagtataatcacccttctctgctatcaagcattgaatttattcctagaaagacatttttaaatagctttgaaagtaaagctgtttttaaatatattagggctagatggatcagaaatcgtctctgactaaaataatgctaatcaatatagtccatttaccttgcaattccatggtgcaaaaacactgaatatattttgtgtgtggctgaaaatggatgccataataggattcctgaaattcaagtcgtttggaaagtgatgtgctttcatataagcataatttctggcaaaaatattgatttttaaaagaaagttccttctttttaagtttgcaaattataattttattcatagatagttaaatggcataatgtatataggagtgaattattagatgaggtctcgaatcagaatgcctgagttgaatctcatctctactacctaagtattatgtaacctagagggtttatgctttggcaaaatggagatagtgatacctatttctcagagttgtgtaaggtttaatataaaatgtatagtctgtaatattgtcactacattaaagtatgtattcaatataacagttactatgaatgatgtaaaatagttgtggttgcctttttgggtactcatcaacattgtttttatatttccaaatgtgtgtgtgtatgaaaaaacattcagtggttacgtcaggaacatatttaaaatttaaaagttcaacgcttatatttgaaaatgcatagcttgtgttagctgttcaaaaacttaatgctgttggtgagtgtggaaataatttactccagcattcttgcatgcatatatataaaacatggcatcaatattttgtaaaaatctgcaatgtgaaagatataccttaatacagttattcttcctaattatccaacaattgttgtttggcattcaatttataaaatgcttacacttgaagaattaaataaaattcaatttgattagttacaatggaactgggaatttgcaccagattatatatttatgttttaatggaaatttaagacatgcaagtatatgtttttaaagagctatgaaaccatctattaatatgactttacttttggccacacgtatagctagggaagttcttgtgttctaagaacctccaaatggcagagatagcagttgattaaatggcatcatgtccctccaagtagtcacccccctaagtaagttgggcaggagactaaacaattgctttagtgtaaacaatcagaaataatacaaacaggctgcatgtggtggctcacacctgtaatcccagcattttgggaggctgaagcaggcagatcgctggagcccaggagttcaagaccagcttgggcaacatggtgagcccctgtcgctactaaaaacgcaaaaatatagtcgggcatggtggtggacacctgtggtcccagttactctggaagctgaagtgggaggatcactggagtctggggatggaggttgcagtgagccaagattgtaccactgaactccatcctgagagacagagtgagactctgtctcaataaataaataaatatataaataaaaacaaattttaaaaccctaagttgagttttcaacttatgagatttcatttatgaaatccagaattatgagaaagaggtatataacaagttaatttttaaatcctcagtgtatccatctgtctgtgtattttattatagtatctaatactaaaatggtaagcattcatttaaacacaaacacacagacacacgcatcaagaaaaccaagtgatttctttggggaaaaatgcaaatgtgtggaatttgtgcaattaatccagtctaaaatcttaaaaacaggagagcctcatcactatttaatttttcttctatttccattgagaaaattgtctctcctttttatatgagggacaggaagggggaggcaactgtatcctcaaaaaatttcctgtccaccaggtttcactagcttttttgggaaggtaaattgaccctgactggcagacctctattatgatatttatgagagttaattaccaatgttgaagttattgaaagtttcagaaagagctcaccaatcttaggttgcacaatcattcaggataaaattgctctctgataataggggacaaagtttgccatttaaccttcagtttctttctttaagttttggggctctaaaccacaaaataaattacattgttgtaattaaggcaaatttccttctgccagataaatcatcctagatatacaaagagttggaaaattgttgctttaatcaatagaaattattcaaacactgaaaagagctactctaactaaaaaaaagtcatgaaagaaaatagaacatataactacaaaatataaaatacagttattgatatttgagcattttcaaatatcaaccatttgtgtttgctatgtagacattttaaatatagaattcagtgttttgtgatccgtagactccacaagtagcacaacagatcttaactggggaatatattgtattagaattccaaaagaataatcatcatcataaacagagaagaaaagccaaaaagaccattcacagaaaatagaaaggtgaaatgaataaaataaaaagacctcactttaaatatgtgctctaaaaaaaaaatctttgtctacatcatgctgattctcagaggtagagtatttgtacactggtgaaaactgctttcacaaaagggttgtttaccacaatacttaagcctgctgttatcgatcgctggcaaactgcaagcagcaagtgatgattacctcaagaacagggttttcttctttttgtccaatctcagcatgagaaactggcagcagcaaagcacctccactggtacaaagctacaaaggcgagtgctttcctgccaacagcatccatcacttgtatcgtagaacttactttccctgctactactgcacaacttgcctgaatggagatttagtcctttctgccactggagctaggccacatgaattttccagaaaccctagagtttttaacccaaggtatcatatagattcacagcagttaagatctctctgatgcagaaatgttaccacattcagcagggcttacgaaggttcggtctgagacaccaacttactaacaaactgcaaagctgcacctttaatcaatatggactgaacgtgggatttgaacattttaatggttgaaggaaacaaattcatttcaaaaatgatgaaggctctaaatctattagtaatctttggaaattgcagcaaaactatttgctgactagaaaaaacagttttgattgtttttaattataaagttttaaagataaatataataaacgatataaggtctaaagatttttatttcttttaaacttagttaagtaagtacttttaaaaaaggcaaaaacaactttttgtaaaggcaaaagtatgagtttagaagccaaattgcagctttgtcttttatttctgtgtaagcttgggcaagttatttaccattgctatgttaccacttattttaactataaattggaaagcttatgttagaaaaaagtaagaaaatttagacaaaagtactgacataaaacaggcactcagtaaatggcaatgattttaaagtatagataaaaaattttatttattttattattaagttaatcacaggtatactgcttggtcatagcagtaaaaggtaagtgttgtaagaagtatgatttatttaacatcctgtactttatttgcccactaagtcaccatagctgagaataattgctgtggtgatttgggtggtgtctttttgggagacgggggacaacaaaacagacaaaatgacaactggtcttaaagtacctgggggtgttagtcacttcctacacttgaaggtacacttggtgacttgatccataagtcccggttttcacacattacacatgaagttcatattttctcctaggatgattttatcctgggtataaaccacttacaagatttctgttaaggaaattcttattggagggaatgaaatttaggaataagagggtctatgccaaaataattcaattttggctatgtgctagtacatggcagcaccattataaaataatgtgtgtatgtctgtgtctgtgtgtgtgtgtgtgtgtgtagtatacatacacatatatgtatgtgtatactttatatacaaaagaagactttgggctaggcgcggtggctcacacctgtaatctcagcactttgggaggctgaggagggcagatcacgaggtcaggagttcgagaccagcctggccaacatggtgaaacctcatctctactaaaaatacaaaaaattagccgggcgtggtcacgtgcgcctatgatcccagctactttggcggctgaagcaggagaatcgcttgaacccgtgaggcagaggctgcagtgagccgagatcatgccactgtactccagcctgggagacagagtgagaccttgtctcaaaaaaacaaaaaaaaaaaacaacaaaaaaaaccagactttgtaaccaacctcaacattcctctttctccaatccctttgtaaaccatactgactgtcatccacagtaaactgaaagtaagtaccaggaggcagctctcttatgctcacactcattgtctctttctaccacctaagctaaatgctcaacacagtgacttattagccctcaatctgtttatgccagttctaagtaaaacttaccttgtaattgtaactgtgtaatttaattattactcaaatcattgaattttgaatacaaaatgaaagagtcatctttataaaaaataacctgcaagctttagaaagacaaaataacacaagttatgtgtgtgtgtgtgtgtggtgtgtatgaggagtggtcaagttaagtttagagagaacaactgtgcaagctttgggtattaataataaaaatagtatttttacactcagatttcttcacagatgttcttgagtttttgctatactttaaaagaattgaaactattataagtgataagattgtgatatatacaagaaaggcaagataccatttccaattagaagatctgtcctcatagaaaagcccttaatcttcaaaaatatagccaatgaatataaatgtacatattttaagttaaacatttaatgtatgtatatatctttctatatgttctcccacatatactttaaccacattttccgttaaccaaggagcaactgttcctgatggcagaacataaggtttcttgtctttctgtgtgtatatatgtgtattcacacactcagccatgcatatatccatgcatgggcttaaggaaatttttggaacaacaaagttgaaaaatcttatataatgactttgagggatactggaaagtttaagttaatgtaaaccaatatatagtgccagaaaaaaataactataggaagacttttaaaaacttcatatcaaaataaagacttttttcctgaaaattaaaaaaatatataaaaacaaaaatttggatctatttactcaatctatatgacacaaattatataactgaatgcatggggatgctttggagattaacagatctaaagagaaaagtttagatctcaaatgcaatgcctatatttgcttgattgggctggtaatcggggcagaaacaaactcaagaacctgaggatgcaaaattaattctctcacacttaaataacccaatgaaataataaactgtcctaatacttttgtcacttgagtgtgtaatttagcatctctattttataataataattgtgataataatgtcaccaactcacttaaagaatataaaatcagtttaacattttcttagattagaaacattatatttaagtgtatgtccaagtatttttgagtatgtctctggttaaaaatgagaactttttttttaatttaacgaagaggtctacactgattaaaaagccatttttggtggggagaaaagagcagttatgacacttttttacaaacatgttatcctctaaataaattcataatcttatgtagcattcatataagcaatactttctaaaataagcagattttaattacaattttagggaaacaataccatttgggcatttcctatagagataataacaattgaattggatactgtcacagaacaatgtggaggctttgcatcatcaatgcaaaggtaaagcaaaaatgttactgaaaataatgttgtggcaatgcttacatttgttttcaaaacaaaagccatttattctgactatattttattctgatgtttctctatacaatggcatgggctaggtgattaatgctgcattcatttgaaagtgatgggcacttcaaagtaagcaagagtctctcaacatactgccattgaaacttatattttgatggctcaaagaataaattcttttggatttccagcaatgtatctacattttaacgtgaaaaaatgggagtggcactatttttctatgtagtaaaaactctttgtaaagtaacctttatttttctctgtgaagtctaggtcacataacttcttgttttcttaatgcttatcacaaatatagatggaaaattcttcaagtctatcccatcactgaaaatatgaaaaccaccacttccaattagcagaatatgaaaaaaataaaatataacatgctggtattcgaatgtcactgagccagcacaaaatgttctttacagcaatacaagatgtataatgacctataattttaagtgtgaaaacctgtttttgcttacgcacctcaggaactgaaactcctgaagtgggcagagtctgctgaaaaagagaagttcatatgaaagctgaaaaagagtcaaactcaaaacaaatcagtgaagtttctcatatcattacatgcctgtgaaataaatgagtaaattaaaaatacatttccttggtataattttactgcttccttgaattaaataattaaatatcttttcattgaataagaaattatctaacacagagtgggttaggttgtgaaattatttatccaaaacacaacttcatctacccaaagcatgctgatcaacatctttggtcagctttagctccaagttccattctctttaataaataatttccactaagtttttttaatttgcccctttacccatcccaattttcattttgaagtccaactctcattctttcctaaaaatactgtgtcttttgaacacagacatagcttatgatgttcattttgttttgtgatactctggaaataagaaaacatattccattaataccagtaaaagaataaaaactataattaaataagtagcaagaattttacttgagagtaatttttttaagatggggttaaatacattgacattagtcttcacaactgtgttttccattatctaccactactacccactttgtagttcatattggaaagcctttttttttttgacaagaaatgataaaaggtcactgaattccaaaagcctgcattctatggaaatgagaacataaaatacaaatttggataattagttgacaaatcacacacacaatactagataaagtttccccatgctggaacgggagaagaaaagttggatgggatgccagttcttagatatttgtgtccctgaaaagaaggaggtagtcagaattcccttttcctccctagatacgagctatctgagggagggtctgggcagtgctagatcaccaagatgggtatgaaaaatctgatagtccagatattattatagtcccttacccaggagaactttagaaaggcagcaagaaccaaaaaaaaaaaaaaaaaaagaaaaaaatagctgaatctgagataggtaaaacctgacaccctcacagctgtgcagaatagagatggactaaaagcattcagtgcactcaaaagtgacacagaaggagaagaagaggtctagcacagccccacagaaaattaaggtgttcaggaatacagctctatttggaagatatttccataatataagtagaaagtactgtagctgcagatttctagtcaaaagaagccacgaagtggaagagtatgagctctggccaactatccattccacaggagaatctaatggaagtaattattgttgttttgaagatgaattgacagtaggtttggtagagcctttactgaaaacttcctgatttcagtaacattcttgacttctgagtccaaatcagtctacataacaccagggacaacgaatatttgtgctagtttctctctgggtcagttcaaagatatttgccaaccttattatcattctttcttagcttcgggttgaagcttaaggtctgaataaaattgcaagacatggatatagtccttccatctttatcataatatatacaagtttgttcttcaaattcaggtcaggaatgtaatcctatggatccttatcccattctgtgccatggacccaggaaactctcagagactctcaagcaaccaaaataagagacttcaatcagcctccagagcctgagtcagagatgccttttaccttagaagagtgtatgcttaccatgcatacatttgcagagagcaggcactggaaagccaagtgaaaagattatggctgtctaaatggttcagaataacaaccaaatgcaattcaagagcttcagatagatcctggtccactttcacttttaccatgcccaaaaagtaaataaataaaagcaacagaaggcattttggggataactgtagacatttgaatatggacaagataatgactgatattatggaatcattgttaattttcttaggtgagagtataataatgtcattaggtagaaaattgtccttagtcttagaaggtgcttgctgaaatatttagtgatgtggtgttaggctatgtgcagcttactttcaaaagcttcagctttatatatatatatacacatacatatatatttatatgtaaagaagtatatataaagaaattatggcaacacaatagcaattattgaatatatgtggaaaatatattggatttttttattgttagtgaatattttctaataaaatttgagagaagaaagttctttctacctcttcattatatcctttaacgcctaaaagtgtgtaaaaatgtttctacaatgaaataaaaatatgtacattatctcagtgaaaactatgaagttgctagaaggttgggagagaagtcataggagtgggtgggagagaaataaggagcactattttcatggaaacagagttctcatttaagatgagtaaatagaggtaagtttctaggctgctgggaaagaggaacagagaaagagggggaactgttaaagataaatgaaaaacaaggctttttagaaaaaagcaatatttcaattagagcagaagcccttattgacaggcatcgcacttttccaaatgtgttccttttgggtctcaaatgcagaaacccacagcggccaaaagataatacaaataggtaaaacaggtccgatgttgcaaaggtaaagactgtgccatgctggataataatcctcccatttgaagttatccaaaaaagaaaaagaaaagacactgtggtatgaaattgaaacctagctaccactttgcaattaattggcaattcatggataacatacttgaagtcttcctctttctcagagcagcaggggtatgagatatctactgatagagagcaagtgaggttggcagagaggtggtacaatgaaaaaggtaatgaaacagaggtttgtcacttcttttctgaaaataaaaaagcagtttgctaaggatgagtagcaggatcaaccaaaactgatgacccagctggagctagaagttttaaatatgtaagagagaaagccaccagccctaagaattttcttatgcaacactcagccttctgagagcaacactagaaatttactccaagaataagagtgacaaaaccaacatatatctaacctcatttacaatcaaaatgtgtaaagagttatatattaaatgtacatgcccatcagtagtttattcctgttacaatgagcaaaccatggtacttagatctaaaagaaaagtagaaacttattagaaaataaatttagctatcgtatcacttctttttttactctcctgtacttaatttttaaatatcaaagatgagcagagtaaatgttttggtttttttgaaaatcatcatgagtgcatgattctaaatgtaatatatttttaatcagaattaatacagaaactgtatatttttatttaatccaatgtgaggtgtgactacagaggaatgtgattgattttatttgatcagtatctttttaatattaaatagaatacacagtacagataattagtttaaaagatgcatttgccttcagggcactcattaagttcaatttaatatcaaagaattttttaaaattctattattcttaagtattaggatatctcttgtcttcatattttctaatgtgtaatcattttaaattgacaatttaatccaaattgtcataggacaaagaaaaatctttggtggagattattggaggtttgacttagttaagatataatgagagcacagtactcacattaaaagggtcattagttatttcaggctaaaggaaaactttaaaaatgataccttatacctacataagaacatttatatttttatatatatattttacatttatatatttttcatgtttgctatcttgcctcatttaatactcccactgaaacaagatactttatctttcaggttaggaagctgaaaatcagagagcttagatgcctaacccaggaaaacaaagttagtgacagaatattgcttccctaacccaggctctatttattcaaataacagtagttgcaagaggagactttttaaaattactatttttagccttgccttcattttttaagtggtttggaaataaaattattttaaaatattgatgaagaatgaaaaatatttagaaatcactatatctacaaagtgatacacacacacacacacacacacacacacacacacacttgttttgcctgaaaaactggcttgaataatgtgaattaatttaacacaataacttccagtgtagtagttaaagtgttccaaatatacaattggatatctctggcatcaaaaaagtagtaagagacagagaaaaaaaactagggtaagataaagaaaaattgtcttcataaaatgacactttgtcttagctggacaggtaaagttgttctctcaaacaagataataaagtgtattatctctaggatataaaaattacatatatttttggcttccatgttttttttatatttcagtttcatataatttgtttaaactttataattcttgaggtccttaattgtgtacactcacacatatgaatacaatgcaagttttaaaaaggacgtgagataaaaatgattttaatactattgttgtctttattaaaacctttagtaagagattatttcagtcataatacaagcaagacactgaaaagaaacataaattatttttcttttccacaaaaattctgatatgtctaattaagatgtaactataaaaataaaacattttaaaagctacacatattgtaatcttatccagggtcccttgactacttctcacctgactcaaattttaaagtttgcattaacagaaatttaatggtaaaatatatttttaactgtggttacttcactacccttcaactgtaattgctcacaaaatattccattcttacttagtaaatatgattgtttatgtctatttgtagagttttgtctggaggctattgacaagaagggaaccaacagaattttaaaaaataaaaacatgtatttgggggctattagagacacagaagaaattatggaggagggtagaaaacatatcaaagatagaaagcaatggagaaaaatggagacagaggaagctcttagaagaaagaaagaacaaaattctctctctgttgttttcctcaattatagaaactgttctttccaaagactgagcaaagaaaactatgaaatcgaggaggagaaagaggggagctgatatttagagcacccatcttcaaaacacatttcaaaatgaaacatgcacatcctattgactattttttcagattattcttcagaactcttaatttacatataattcattaatagatacctatttatgaatgtgtatatgtatatgtgattatgtttgtgtatgtttgggacagggatctgagggaagttggtaacttgaaaaaatcacccccttcaaagaactcagtataatagactgatacatacaaattttatgttcataaaattaatctataatatttcctgttatgcctattttatctccctataaaaacgagagccagttctagaaatatatcattgtatagttagcgtattgctgctttccagaatacaaatatagcactataggtaatgaaagtatattgataataatatttagaattaaagcctaggtctccttttcaccatccttgaaaaagatcttgaattaaaaaacaaagaggttataatggaatttgttcttgtcttttgctcctttaaatatccattgatctcatgccaaagtattttctaaccaggttaaagtccaattctgtactcacgttaggctaagattcaattgagttaaaattttacactgactgccagtcaaccttatcatgaactttcattatgtgcatgtaattaattgggtccaacgaacaatatcagttctgagttatagactcttttcccccgaccatataattagaatataattacccacaggatatcagaatgatgcagaacctttcctctaaatgcgccctcattaggaaacaagtctcaatgtacacttattcaatcagtgtgaattaattaaaatgttactgaaataaaagagggtagcgataaagagtatctgacatctattaagagtctatcactagagatctgcatgcacagtttatatttaaatccttttagccgaaatagaaactttgctatgtaatgttatatacatccagtgtactaggaaatctgagtacatacatcggtgtgtgtcatcatttttgaaaagagtacaagatacgataactatagaatctttaagaattgggtaggaatctaagagccccattattccataaatatgtcatcatcagatagaatctacctggcgggcaaaaatcattttaactcaaactacctaagcaattattggtttaacccacaaccttatattacaaatctgaaaatatttgtcccaaaattgcttaggagacaacaattcgaaaagcccagatttgtgaaaacactaattatttttgtctttataaaataacctgaattccttaagctagctcaagttattacagtagcatattttctttaagcagcacattcaaatacagctaagaatagcttctttttaagagaataaataatacatcataccacacattctgattatataaaacacatttaaaaatagtaaatgcacaaagaagctgagggacacatgatacatagcgcacaagaagctgcggattcaaacagtaacattctacctaagagctattcatctttatttctccaggtgtatagttatattcaataaaactttgctaaataaataacccgtgtacaaaggaatactcagcattagtcagaaacaatgccatgaactgttaacataaaaatttcagagctgcatgtaataaactaagatatatacatattttcaagctttcagtgttattatatattcctcagaaaattttagatacagaaaaaggttttataaaacatagttctggtaataaaaatttggcattcacttttataagtagacatgcaccactttgtaatggaaattctgcatgagtattaagataaactaggctatctacaaatgtatactttttatatgctctttaggagcaaacttcaagcagttttaaattattagtcttttttacaagaatgtttaactctataagattatatatatatgtgtgtatatatatatacatgtgtgtatacatgtatatacttgtgattacaacattcaaaaatatgttttatatacctatatatgtgtatatacacatatatacatatatatatatgcatgttgtaatcacattctggtataatattctattcagacactaaactcatcttggtggagaccaaaagtgagagaaataatggttccactctgctaagcaaatgaagattgtctcacaaaggtttgctttattcttaacctaaaatttttttagaatttcagtaataaatacatgtagctacagttgcctgctgaaaatattctattggagtaacattcactaaaatgccacattaactaagagtaattactaccaaaaagccacaatttctaaacaagagaatgtgaatatttttgaagttccattctataataaacatcaattttcattttctgaacacaaagaagaatgattatttattatattttacatggaaaactatattgcttaaattatatttaaaaatcagatttttaaatacaatttaatatccagagaaaaacatctcaattctcctcagaattctgaaaatgttccctttatattctctacctgctgtaactcctcattttacatgtgaggcattttacagtaccatctattggatattttatataactacaacacataaaactcaccagcttttcgaaatttagtagtaactataagaagctgcaagagccattccggaaactaaatacaatgctactttggtatccactaacatttcctcatcatcacacactttaaactcaattttattagcttctaacaaaatgatttaattatgagttaccaatgattttttaaaaccaagcctccttgttatatatttgttttaatttttacttgatatatatgttactgtctgatatattttttcttgactcagggaaaagagtgataaatgatgggaattttcaaaagctgactgaatgctattcattcactcagcaaatatttgttaagcatctagtctatgaccaaatcaaattaggcactagacataaagagatacacccttttgctgggagtgataagaataatgggggtgctagtcaatgagcataagggacagtttcacaagaaatgtttcaagttcaattcctgctatgttgactttaagcttctgtgggatatatctgagaggaaacttaaaacatgaagtgagggccgggtgcagtggctcatgcctgtaatcctggcactttgggaggctgaggcaagtggatcatctgaggagtttgagaccagcctggccaatatggtgaaacccatctctactaaaaaaatacaaaaattatcccggcatggtggcttgctcttgtaatcatggctactcaggaggctgacccaggagaatcgcttgaacccgggaggtggaggttgcagtgagctgagatcacgccactgcactgcagcctgggcaacaagagtgaaactccatctcaaaaataaataaataagtttatttattaaattaaaaaaaacacgaagtgagcatttcgatctagatgtatgtggggagaatgggctcatacagacacatgcaaacatggtagctgtagctctggaactggataacataatttataaagtgtgggtgtaataagatgagaattgaagaaaaaactgaagttttacacatattaaagaatgaaaggaagactagggatttagtaatattgacaaagtgtggcttaaaaggtaaaagaaaacctagtggaaatgcactggatgagtgttagaggctatcaaaggtaagcatctcagtgtcaaacactgtagagcattcaaaacagattatacttggaaagggtttccagtagatgctgttggtagctcaaagcagatcctttgctaccttgccagagcaactatcaccagctgctatgagtgttaacttctgaaagcttgcagccgtccctaagaattaacctttatccacagaaataggctgtgccaggaggccctagataatgactgacacataggtgaggaaaggccagccttcttgccttaagttaggaacaatcctatgattggatttttgctgcaaagccctaaaggtacgggccaaggctaaactatcactatgatcaacattcttgcttagagcttgcctcttcctttttctgcctccctcccttcattataggttgttttgtttttgtttttgtttttttctaaagaactttttctccctccataaatcacacaaagccaaatcttggcttaatgctctactccttaggaacccacctaaaagagtgcaattcgatttagtaaggatagcaagaacaatttcatatccatgttacagtcagaagttacactaaagtgggttgagaaggaagagaggaatgtgacacagtgggtgttatctacacacctgcacaaacatacttatggttatgtgaagagccagacaagagtcagcatgcaaatacaggaaatagaattgcacaggagaaggacaaacagccctttcactggaatgagttctacaacacactaatagtaaaaacaatattcacctactggactcaaatcatgatgctgtttagtactaaattacataagtgtgctggattataccttgtctgggtttttcctattgtaaattaggaaattgatattttattaaagatctgtgacaaatgccatgaaaggagaaaaatgtggaattccaggagaattaaggcagagaatactagaatgaaagaaatctgaaagaatatacgcattgggtggctcaaggatgttgaagaaatgataatcaaaggaagtaatttaaaaatatttgtggtcaagataaaatgagagtaatgtaatgaagaatagatcactaggtacagagccgtaatcttccagggtttgggtttccttgggcaaatgaggttgaataagtcaaagctctttagagtattagcaacagaatttcaactgatagatttttatcaactggactggacagcaaggagtggtcatggaaagctcgagaactatccttattccacataaaggggaacatgggttgaactagggaacaaagacaggcaatgagacagagatcatggtagtatttacaaaattgatgtgtggaccaaaagttatatgtgacttaattcttcaccaggtttcaagtaaaagttgagaataaacaagccatatttaatagtaaaacagagaaagtcatgtacataaatactttctgatcaccactgtttcagcaggaatcattaaaactacagattacctttgcaaggtggaatttatcccttaatgtctagtggtggttaagaatgtctggttttgactgcattcaaaatgtaaaaattaaaagataaaaatgatataaagcatttgtctctactctaatgctattagctctagatatatgccttgccccaaccccaaatttctttgaaaggtgaaagcagaaatatcaacatagaagttcacatatttgggagcttttatgccatagtttgtggcaatttagtttcaccagtgtttaatgagaatagcaaattttgcacattcttgccaacactgggtattatcattttaaaaatattttccaaaatggatagaaaaattaaatctcattgttttaatttatatttcttcattactttttacaatatagggatttggtttacaatatagggatttggtttacaatatagggatttggtttacaatatagggatttggtttacaatatagggatttggtttacaatatagggattgcattttacaatacaaagatttgttgttgctgttgttactgttattatgatccttatctttaacttgatttgtaagttttgggatttagcattttctttaaaataaattttcattgctcaaggcagttaacattttatctttctcattttggaaaaaaaaaaaaggctgtgcctaggcaaaaattaaaccctgaattcatgtttgatttttttgtaatagatgtaatgtagaatttaccttactttattttcacgtggttatacaataatcctgacgcctttgatgctccaccagatttcatttgtgacttttattatagactatataattacatatagttcaatatgtctttagactttctatcacatctttacaacttttagagccatattattttgatcactgaaaatttaacaaacatatttttaagactttttgttagaataagcatttttttattactcttcgtttttaagattttataatgtttatgtacatttattcttccagacaaaattagaaatcattttgtccagccaaaaaattgcatgcaaattgcaccaagtagataaattaatttgaagtgacgtaggttctttttcattcagtttaattttctttacacttaagagaacaatttagttttttgtttgtttgtctgtctgttttgcttagggatagcatgatctcttttcaatttgttgccattctctacagtagtaaaaggagattttcgtaatcctcttctccagattacttattttgttgtcctcagtgttgatttttgccttattctaatacagatatagttagtttctgctaaaacattatttttttctatactctttcttaattcttttgtttctttcaagtcagtgcattataaagtaaatgttttctttagtattcttgaccatctaaaactattgctattgatgtcttcttctgtttgatgcaataaaactttatgtatggcattcatctaacttttatctgccatcctttttctttatttttgagttgcataactattagtattttatttggcaacaggtagactctttaataccaaaaggcacttgggtcataaaccatcagtctgcattggcagttgatagaaaagtcaaaggaaacaaatacaactacaccgattattgcaatattgtttaggtactgtccaatacagaaacaacttcacacagaaaaattaatctaaggtctcagtaaccacaaaataataaaaaatattttctctaattgaatacaatcaagcctataatatttatttttgctaaggctaccaagaaactcagggaaattctgaaaaattacctctgttaactttgaatggtattgtgaaataaatttgagttttaacttaattttggcacaaacttactacattttattttgctgcatatggtatattacataagctgttttgaatactgttagcaataacttgtagaataatttaaatcattcatgaatacataatttcccatcctcactttagaatcagacatatataatactctttgttttaagtctatttttaaaatttagcttttaatacattgtaatctctctttggataatgctcatgtatggctatatgtttaagatttcccgacaccatcaagatggctgactagaggaacctagcactcatctcttaaacaaagaagggccacaacagcaaataaataaccacaaatcaaatggagcatctaagggagaacacaaattcagcaagaaaatgatgaagcccttctaagacatggaaactcctgatggcacaataaaaataaaagcaaagcagctagccaggatcagcatagaggcaggagagactctccattgcaggaaaaaggtaggtgggagattccccagccatctacattcccatcagagatgtctggaatcctagggagagaaaagcccctctgccctcacagaccccgagcctagtgcagagagtttcctggagttcacatgactgtattgttccagagaggaaaatcaaactgggtgccctacactcctgggaccaaagctgatgcatcatggcattattttgagggaagaaccatcaccagaatacattctgacttgggccaaatagcccctgtatctccacatccatagtattccactgatattcccctacatccactgagaaggctacagtctcatgaaaccaactggaactggtggtacaactgtgttcccagcatctgagcccatgtagctccctgtactccagaaaataggtgatctaaacccttaggaagtctgcctccaggacacaggtagctgaagcatgtgcacaccaaagcttgagagccacctgtcttatctgccgtcaccaacagtgacctctccccctctagcagtggggccaccacatgtccatgtgcaatgtcaataacctgcaaaccagtttaactggggtccactgccagtgccccaatgtgtgccatccaggagcccgaggccatcctcctcaggaattgctaccacttcaagcccaaaaaactgacctctccaatagtggggctgctgcgcacctttgcacaccatttaggagccagaggagtggaccaaccagggtctactgccaccaacacccatgcctacaaatatcccccaggatcctgaagactggcctacctgggctctcccaaagaaagttatgacagagcctccacaaacaactacagcctaaactactgagaaaatcacatatgctactgatttgattacaggcaaaaaaaaaaaaaatcatatggagaatacattactgtacctacctagaactaaaaccaaagcactctacctaactgactctatagatacatctacaggaaaaaaagtgttaccctatgaaagctacttcagaaaattcaaagaagtgacagctatatcagagatgtagatatcagtgtagggatgcaggaaacatgacaaaccaataaaacataacacctctaaaggaaaataattattctgcagtaacagaccacaaataaaagaaaatctataaactacttgaaagggaattcaaaataattatctttcaaaaattcagtgaaatacaagagaacacagataggcaataccgtgatatcaagaaaagaattcatgatctgaatgagaaattcaacaaagatgtccaacagaaatcatagaactgaagaattcaatgaaaatataaaaagtacagttgagagcttcaacaattacagaagaaataatttccgagcttaaagacagatcttttgaagtatcctagtcacacacaaaaaaaagagaaaaagaatttttaaaaagagtgaagaaactctatgtacatacaggagaactttaagcaaacacatttttaaattctgggagttccaaaaagaaaagatggggaaagacatggaaacctattgaataaaataatacttgaaaatatcctatgtcttgggagataaatagacatccagatacaggacactcaataatcctcaaatagacttaaattaaaaaggtcctatcgatggcgacaggggacagacaaattcctaggcagacagggatgggtctccagtgaaacccaaccttccagcaaaggacagtttaaagcctgaaaaccaagctgccagttccagatagactccacaactggcatgagaacttctatctccatctcacccactcagtcttgattggttccttctgaatgatgccttttaactaatcaaatgatatttttttcaagaccaaccatggacccatcagcatgcattccccgattctaagcccataaaaaccccagactcagactcacaaatggctacctgtttaggggtcctctctcattgccgagagctttccttcagtgactcaatacaattctactatatcttactcactttctggtgtgcacataccttgatccttttggtcacggacaagaaactggaaatccttgaactgcaggagcaaaagagctgtaatgttcctgcttgctgagctataggtggtgagaataaaagagtggtaatattctctgccgctcgccgaacaacaggacagaaaaacccactgggtgccaccttctcctgcttgctgaacaatggcagcaaagagccactgggtgccctttctctcactcactgaactgtggaagcgaaaaagccacaacactatctgaggcacattatagtcaaacagtcaacagtcaatgataacaagagaaaagaatcaagtcacatacaagggagtccccattagactaacaacacacttctcagaagaaaccatatggtcagaagagcatgagatgatatattcaaaatgctaaaagaaaaaaaaaaacctgtcagccaagaatacaatacccagcaaagctatcttaaagaaataaagagtaaagttttctcagacaagcaaaaactgagggaattcatcatcaccagactggatatacaagaaataagggagttcaacatctgaaggcaaaaggatgatatctgccattatgataacaaatgagaaagacaaggaatgaaatgttatttctacagaaaacaagcaaactgcaaaaaataacttaagagagaaagagagaaacaaaacaaatacaaaacaatcagaaaacaaataccaatgggtagttagtcttcacctatcaacaactatgaagaggtttaattcaccaattaaaagatagagatttggctgaatggattaaaaaacaacaagatccaactatatgctgcctacaaaaatctcacttcacttgcaaagacactcatagactgaaagcaaaggaatagaaaaagatattccaatgcaaactgaaacgaaaagtaggcaggattatctatatttgtatcagacaaagtagactttaagtcaaaaaacataaaaacagacaaagaaggtcattagataaaaattaagtggtcaattcagtaagaggatataacaattatagaaaagtaaataaacatatatatacacactcaacattggagaccataatacaataatagctaggaacttcaatgccccacattgagtattagacagataatctaaaaggataataaattgtaaaatattggacttacactgcactatagaccaaatgaacccaatagatatttacagagtatttcatccaatagctgcagaacacacattattctcctcaggacatgggacatttgcaaggatagactgtatcttaggcctcaatataaatctcaaacattttaaaacatcaaaattctctcaagcatcttctcagaacacaataaaataaaatcagaatcaatattaagaagaactttggaaattgtacaaatacatggaaattaaacaacatgctcctgaatgacaaacaggtcaataaggaaattaagaagaaagtaaaaaaaattcttgaagacatgaaaatagaaatacctatgggatagagcaaaagaagtgctaagagggaagattacaccaatgaacacctatataaaaaattaaaatatttaaaataaacaacctaacaatacacctcaagaaactagaaaagcaagaacaaactaaattcaaaatttatggaagaaaaaaataataaagatcaaagcagaactaaacaaaatagagactaaaaaattacaaacagtcaacaaaatgaaaagttagttttctgaaaagataaactaaaacgacaattagactaagaaataataaagaaaacctcaataaataaaaccagaaacaaaaaaggagacattacaactgataccacataaatacaaaggatcattagaaactgttatgaacaactatacactaccacactgggtaatctagaggaaacatataaattcctggaaaacttacaacctgccaaaattgaaccaagaagaaatagaaaatctgaacagaccaattacaagtaacaagactgaatcagaaataaaaagtctcccaaaaagaaaacaacaacaacaacaacaacaacaaggcccaggacagagagttttactgctgaattcaaccaaacttttaaagacaaacgaaaccaattatttttaaattactccaaaaacaaaaaaatagaccatacttcttaattcactttataagtacagcatcaccctgataacaaaacgaaacacagacacaaaacaacaacaaactacaggccaatatccctgatgaatatgggtgtaaaaatcctctaccaaataatagcaaagcaaattcaacatcacatcaaaaagataattcatgggggaggagccaagatggccgaatagtaacagctcgggtctacagctcccagcatgaacgacgcagaagacgggtgatttctgcatttccatctgaggtaccgggttcatctcactagggagtgccagacagtgggcgcaggtcagtggtcgcgcgcaccatgcgcgagccgaagcagggcgaggcattgcctcacttgggaagcgcaaggggtcagggagttccctttctgagtcaaagaaaggggtgacggacagcacctggaaaatcgggtcactcccaccagaatactgtgcttttctgacgggcttaaaaaatggcgcaccatgagattatatcctgcacctggctcagagggtcctacgcccacggagtctcgctgattgctagcacagcagtctgagatcaaactgcaaggcggcagcgaggctgggggaggggcgcccaccattgcccaggcttgattaggtaaacaaagctgccaggaagctggaactgggtggagcccaccacagctcaaggaggcctgcctgcctctgtaggctccacctctgggggcaaggcacagacaaacaaaaagacagcagtaacctctgcagacttaaatgtccctgtctgacagctttgaagagagcagtagttctcccagcatgcagctggagatctgagaacgggcagactgcctcctcaagtgggtccctgacccctgacccccgagcagcctaactgggaggcaccccccagcaggggcacactcacacctcacagggcagggtactccaacagacctgcagctgagggtcctctctgttagacggaaaactaacaaacagaaaggacatccacaccaaaaacccatctgtacatcaccatcatcaaacaccaaaagtagataaaaccacaaagatggggaaaaaacagaacaggaaaactggaaactctaaaaagcagagcgcctctcctcctccaaaggaatgcagttcctcaccagcaacggaacaaagctggatggagaatgactttgacgagctgagagaagaaggcttcagtcgatcaaattactctgagctacgggaggacattctaaccaaaggcaaagaagttgaaaaccttgaaaaaaatttagaagaatgtataactagaataaccaatacagagaagtgcttaaaggagctgatggagctgaaaaccaaggctcgagagctacatgaagaatgcagaagcctcaggagctgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctcattggtgtacctgaaagtgatggggagaatggaaccaagttggaaaacatgctgcaggatattatccaggagaacttccccaatctagcaaggcaggccaacgttcagattcaggaaatacagagaacgccacaaagatactcctcgagaagggcaactgtaagacacataattgtcagattcaccaaagttgaaatgaaggaaaaaatgttaagggcagccagagagaaaggtcgggttcccctcaaagggaagcccatcagactaacagcggatctctcggcagaaaccccacaagccagaagacagtggggaccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaacaaccggtaccagttgctgcaaaatcatgacaaaatgtaaagaccatcaacactaggaagaaactgcatcaactaacgagcaaaatcaccagctaacatcataatgacaggatcaaattcacacataacactattaactttaaatgtaaatggacaaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaactagaagagctaactatcctaaatatatatgcacccaatacaggagcacccagattcataaagcaagtcctgagtgacctacaaagagacttagactcccacgcattaataaagggagactttaacaccccactgtcaacattggacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacagcctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaagagctggttttttgaaaggatcaacaaaattgatagaccgctagcaagactaataaagaaaaaaagagagaaggatcaaatagacgcaataaaaaatgataaaggggatatcaccacagatcccacagaaatacaaactaccatcagagaataatacaaacacctctacgcaaataaactagaaaatctagaagaaatggataaactcctcgacacatacactctcccaagactaaaccaggaagaagttgaatctcttaatagaccaataacaggagctgaaactgtggcaataatcaatagcttaccaaccaaaaagagtccagcaccagatggattcacagccgaattctaccagaggtacaaggaggagctggtaccattccttctgaaactattccaatcaatagaaaaagagggaatcctccctaactcatttgatgaggccagcatcattctgataccaaagccaggcagagacacaacaaaaaaagagaattttagaccaatatccttgatgaacattgatgcaaaaaatcctcaataaaatactggcaaaccgaatccagcagcacatcaaaaagcttatccaccatgatcaagtgggcttcatccctgggatgcaaggctggttcaatacacgcaaatcaataaatgtaatccagcatataaacagagccaaagacaaaaaccacatgaatatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgcgctctctcaccactcctattcaacatagtgttggaagttctggccagggcaattaggcaggagaaggaaataaagggtattcaattaggaaaagaggaagtcaaattgtccctgtttgcagacgacatgattgtatatccagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaccttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacatcaccaagtcaatcctaagccaaaagaacaaagctggaggcatcacactacctgacttcaaactatactacaagtctacagtaacccaaacagcacggtactggtaccaaaacagagatatagattaatggaacagaacagagccctcagaaataacgccgcatatctacaactatccgatctttgacaaacttgagaaaaacaagcaatggggaaaggattccctgtttaataaatggtgctgggaaaactggcaagccatatgtagaaagctgaaactggatcccttccttacaccttattcaaaaatcaattcaagatggattaaagacttaaacgttagacctaaaaccataaaaaccctagaagaaaacctaggctttaccattcgggacataggcatgggcaaggacttcctgtctaaaacaccaaaagcaatggcaacaaaagccaaaattgacaaatgggatctaattaaagtaaagagcttctgcacagcaaaagaaactaccatcagagtgaacaggcaacctacagaatgggagaaaattttcgcaatctactcatctgacaaagggctaataatatccagaatctacaatgaactcaaacaaattcacaagaaaaaaacaaacaaccccatcaaaaagtgggcaaagtatatgaacagacacttctcaaaagaagacatttatgcagccaaaaaaacacatgaaaaaatgctcatcatcactggccatcagagaaatgcaaatcaaaaccataatgagataccatctcacaccagttagaatggcaatcattaaaaagtcaggaaacaacaggtgctggagtggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaacagcaaagacttggaaccaacccaaatgtcccacaatgatagactggattaagaaaatgtggcgcatatacaccatggaatactatgcagccataaaaaatgatgagttcacgtcctttgtagggacatggatgaaattggaaatcatcattctcagtaaactactgcaagaacaaaaaaccaaacaccgcatattctcactcataggtgggaattgaacaatgagatcacatggacacaggaaggagaatatcacactctggggactgttgtggggtgggggtaggggggagggatagcatcgggagatatacctaatgctagatgacgagttagtgggttcagcgcaccagcatggcacatgtatgcatatgtaactaacctgcacaatgtgcacatgtactctaaaacttaaagtataatttaaaaaaaaaaagataattcaccatgatcaagtaggagttatcccagggttgcaaagatggttcatatatgcaaatcaataaatgtgatataatacatcaatagaataaaggaaaaagtcttacgatcatcataatagaaaccaaaacaaagcaattcataaatcttcatcctaaaatttcttcatcataaagtctctcaaaaattggacatagaattagatatacccctacacaataaaggccatttatgacaaacccacaactaacagtacactgaacagagaaaagcttaaagcattttctacaagaactggaataggacaagtatgcctacttttaccactcttattcaacatactactagcagacctaggcagagcagtttggcaacaggatgaaataaagggcatccaaattggaaaagaggatgtcaacttatccctccttgtaaatgagataatcttacatatagaaaaacctgaagacttcacaaaaaactcttatgactaagaaatgagtttaataaagttgcaggatataaaaattaacatacaaaaaaatcagtagcattcctatttaccaaaaacaagctagctgaaaaggaactggagaaggaaatcccatttataatagcttaaataaaataataaaatacttaggaataaatttaaccaaggaggtaaataatctctacaattaaaactgcaaaacactgatgaaaaaaattgaagagggcataaaaatcaaaagacatgccatgctcatggattagaacagttaatattgtcaaaatgaccatacaacccaaagcaatttatagattcaatgtaatccctattaaaaattgcaattacatttttcttcaaataaatagggaaaaatcctaaaatttgtattgaacccaaacaaatacaagtagtcaaagtaatactgagcaaagggaggaataacactatgtgacttccaagtatatcacaaagcaatagtaaccaaaacagcatagcattgctataaaaactgacacacagacaaatagaacagtatagagaacactgaaacaaatctatgtattttacagtcaactcacttttgacataggctctaagaacatacactggggaaaagacaccctctataataaatggtgttgagaaaactggatattcatatgcagaggaataaaaccagatccccatctttcaccagaaccaaaaattgacacaaaatatattaacaacttaaatgtaagacccaaaactataaaactactagaaaaaaacagagggggatttctttgggactctggtctgagcaaagatttttatggataaggttacaaaggcacaggtaccaaaaagaaaaatggacaaacaagactatatgaaacttttaaagagcttttgctcagcgaaggaaacaatcacagagtgaacagacaatctgtatattgggagaaaatatctacaaactatttacctgacaagggccttttacctagaatatacaaggaactcaaacaacttaacagcaataataataatggtaataatcccattaagaggtggaaaagaatctgaaagacatttctcagaagaagaaatacaaatggccaaaaagtatataaaaaatgttcagcatcactaatcatcagggaaatgcaaatcaaaaccaccataagatatcacctcaccccagttagaatggctattatcaaaaagacaaaaaataagaaatactggctaggatgcagagaaaagggaattcatacattgttggaaggaattatagttagtacaactattatgaaaaacagtatggaggttccttaaaaaactaaaaatagaaatatcatataatccagcaatcctgttattgggtatttagccaaaggaaaggaaacttgtgtatcaaagtgacatcttcacccccatgtttataacagcactattcactatagccaagatgtgatatcaacctaaatgtccatcaatagatgagtagataaaataattatggtatatatgcacaatggaatactattcaaccataaaaagaaatgggacgttgtcattttttgcaacatggatgaacctgaagggcattatgttaaattagtcaagcacagaaagatcaataccacattcttacttatatatgggatctaaaaaattgagctcatgaaataaaagggtagaattgtggttttcagaggctgagaagttagggatgagaaaggcaaagagagaagttggttaactgatacaaaattacagctagacataataaataagttatgttctatagcactataatgtgaatagagctaacaataatttattgtgtatgttcaaaaagctagactggagaattatgaatatttccaatacgaagaaatgataaatgttttaggtgatggttatactaattactctgatttaatcactgcatatttcatacaggcatcaaaatatcattctgcatcctataaatatgtaaaattattatggtaactatagataaagtgaaggaaacaaaaaatgcaaaaaaccaaccaaaatcatgtaaatacaatttttaaagaatttttatgacttcattattatttttgatttgtgggactatatatttcacagcaatttcaatgtaccttctagatattatatagacacctatgatctgaacttaaagttttagaagatttctacctataataggtttttggatatttaaattttggtttttttttctaggtttgaggtcagcgaagaaaattgacattttaaattaatataggaatgatggcctaattaatcttcttgacagtgaactcctgtgtgtcaagagtcaatccataggacactgcatcctgaatatattaacttcccaattgttcatatattaaactaaaagattttcatcagatttcttcttagctgaacttccaattcatgtcttatggggcttttgtttggcttttccataaatcatggcaaaccaaatgtggcacaagtttgatttttgaaaaaaattattattgcttaccctgggtacagttatacatataggatatatatacagtatatatataggatatatacacacacacacacacacatatcctatatatatggtatatatatacatatccctgtttaaaaaatccctttaagtatacaactctaccttatgcatttaggtagaaacaaaaacaattgtctacaacacttgaactttttcttttagactagaccctgtttataattatacacgttctacataatataaactagttcaatgtaaagacagtttgtcagaaagcaacagcacacagccaatctgagacaatgtaacagataaatggttggttaacctcccaagggtaagattatgaaatcacttagtgaggctgggtcccttccagttttcttatgctatgtctctttaaaatatatgtacatgaagaaatacacggacatgctatgactctttaaaatacatgtacatgaagaatattttaaaccaaaatggatgtacacatgttttataaatattatagcaccctagttcttaatgtgttcctcatcagaatttgaatagtgagaatgtaatcctacacatttaaaaaattaaataaataaaaggcagctatcctttatgaataataccatgaaattgagtctgagttagatttccaaaatatggaaaaatgaggtttctttttgcctatcattactatgatgacaattatgaattgatctataatgaatattaattaaatgaatattaagtaatgacactgatgaaacatttattgagagctgacaatatgctttatccctgctctttcaacaaaaaagaacgttgcataggcacaaacctttggtagatgacataggatttcaaggaaatagatgacttcagtaactttgcttaaaggttaaagaggtaaatttaaaagaagggtgaaacagccataatgatgtgaaataaaagctgaagctcagtgcagcaagacacatccttagttagttatatgttcacacctccccaccagactctgcatttctggaagttttataactagcctaggaataatattacagagaattcaaaattcaaatttcagaatcacagaagatttgaatatctcccaccctccttgaattagctgatgtgtagcattgggattgtcattattaactcttgccgataaaagtcagatgaaaaaatctacagaaagtttccatactactggagctgtgagaaagagacacacaccatacttctacttcctaacaaactttctgacattgctgagaaataatgacttagttcaacacatgctctaaggaaagatttaacatactctatgctatttaagacttaatcaccatatttacaatgcataatttagtagaattcttaaaattgtggaagagcaagcaagatcggaagaagaggagaagttaatatgacatatggttttctgagggtgttataggtagagatacgtagattgctgcttcagcaacatcacaacttagccaagttttcagagttacagtgaagaaaaaagagatgcagaactgggaccattttaagtttcagcaacatagatggaactggaggtcaatatgataggtgaaataagccaagcacagaaagattaatattacatgttctcattcatatgtgggagttaaaaagttaattccatgcgggtagagagtagaatgatggttatcagaggatgggaagagtttgcatgtttgtggagtagggggataaagagaggttggttaatggatacaaacacgaggttagatagaagaaataaattttaatgttcaatagtagagtagaatgacgatagtttcacacattgtatgtttcaaaatagctggaagagaggacttcccaacataaagaaataatgaaatactcaaggtgatgtataccctaaataccctgacctgatcattacacattttatgcatgtaacaaaatattacatgtaccccataaacatgtacaaatattatatatcaatacagaataaaattcatattttatatttataattttaataaatatgatttaaaaattacgtttataaaacaggattaattaattttaatactaaagaatattttttaaatatacatttttcaaatagttttgttgtcctttctgtgaactaacaagcttcataatttatcttgatggtatttttattaactctattcttcttttttaaactttactttaaagttctgggatacatgcgcagaatgtgcaggtttgttccacaggtatacatgtgccatggtggtttgctgcacctatcaacccatcatctaggtttcaagccccacatgcattaggtatttgtcctaatgttctccctcccctaaccccctaccactcgacaggccctggtgtgtgatgttcccttccctgtgcccatgtgttctcattgtattaactctattcttaaaggctcatcagatattataacaagagagtgtattccaggaagaacacaccataactggtctaaagggctatggtgctgaacatattcattgtttcacatcctatcatttcctgctaatggacagtaataatatggttaagttcaaaagtgagataaattaccctgggcagtatggcaattttcacgatattgattcttcctacccatgagcatggaatgttcttccatttgtttgtatcctcttttatttccttgagcagtagtttgtagttctccttgaagaggtccttcacatcccttgtaaggtggattcctaggtattttattctccttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaactgccctggccagaacttccaacactatgttgagtaggagtggtgagagagggcatccctgtcttgtgccagttttcaaagggaatgcttccagtttttgcccattcagtatgatattggctgtgggtttgtcatagatagctctaactattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtgtattgaaccagccttgcatcccagggatgaagcccacatgatcatggtggataagctttttgatgtgctgctggatttgttttgccagtattttattgaggatatttgcatcaatgttcctcaaggatattggtctaaaattctcttttttggttgtgtctctgcccggctttggtatcaggatgatgctggcctcatcaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcttcctggtttagtcttaggagactgtatgtgtcgaggaatttatccatttcttctagattttctagtttatttgcgtagaggtgtttgcagtattctctgatggtagtttgtatttctgtgggatcggtggtgatatcccctttatcatttttattgcgtctatttgattcttctctctttttttctttattagtcttgctagcggtttatcaattttgatgccatccccatcaagctaccaacgactttcttcacagaattggaaaaaactactttaaagttcatatggaaccaaaaaagagcccgcatcgccaagtcaatcctgagccaaaagaacaaagctggaggcatcacactacctgacttcaaactatactacaaggctacagtaacccaaacagcatgctactggtaccaaaacagagatatagatcaatggaacagaacagaaccctcagaaataatgccacatatctacaactatctgatctttgacaaacctgagaaaaacaagcaatggggaaaggattccctatttaataaatggtgctgggaaaactggctagccatatttagaaagctgaaactggatcccttccttacaccttatacaaaaatcaattcaagatggattaaagacttaaatgttagacctaaaaccacaaagaccctagaagaaaacctaggctttaccattcgggacataggcatgggcaaggacttcgtgtctaaaacaccaaaagcaatggcaacaaaagccaaaattgacaaatgggatctaattaaactaaagagcttctgcacagcaaaagaagctaccatctgagtgaacaggcaacctacagaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccgtcactggccatcagagaaatgctaatcaaaaccacaatgagataccatctcacaccagttagaatggcaatcattaaaaagtcaggaaacaacaggtgctggagaggatgtggagaaataggaacacttttacactgctggtaggactgtaaactagttcagccattgtggaagtcagtgtggcgattcctcagggatctagaactagaaataccatttgacccagccatcccattaccgggtatatacccaaaggactataaatcatgctgctataaagacacatgcacacgtatgtttattgcggcattattcacaatagcaaagacttggaaccaacccaaatgtcccacaatgatagactggattaagaaaatgtggcgcatatacaccatggaatactatgcagccataaaaaatgatgagttcacgtcctttgtagggacatggatgaaattggaaagcatcattctcagtaaactatctcaagaacaaaaaaccaaacaccgcatattctcactcataggtgggaaatgaacaatgagaacacatggacacaggaaggggaacatcacactctggggcccgttgtggggtggggttaggggagagggatatcaatgggagatatacctaatgctagatgacgagttagtgggtgcagcgcaccagcatggcacatgtatacatatgtaactaacctgcatgttgtgcacatgtaccctaaaacttaaagtataataattaaaaaaaataaaaataaaaataaaaaaagagatatgagagttggcaggggctagaaatccagtttaaaaaaaaagtgagataaataatcatctaaaaatgattttaaaattttaaataattttctattctaagacaaatgttctgttttaggaaatatttaatcattattttcttcattaggaatgggtttatagtacagaaagaattaaacaaccataaaagcggactcatttgtaggacaaaataacacagtatggggaaaatgatcctttgcacttctgagtagagaacagccagaagaaaccattcttcataaagatgttcactatcatgttacttataataacaaaatgaggaattgaaaagatgctagacaaaaacagtttcaactaaaatatgacttctttacttaatgagattacacaggcattaacagtgatgtcccatagtatatggaaatacataaaaatttaaggatatcaagttaagtgttaaaatataatgccacatggtatattcaggttaactttaaaaaggtgaaaaaaaaacctaaaaatcaggaaggtaattttaatagtgtttctatttatatattaattgtaattcttcttatataactgtatcacaggtttttaaatgtttaaattctttttctttattattttaaaattttgtatgattacatagttatggtatgataaaatgttaaaattcacttttcaaattacagcataacacttataatagtaatattagatgatatcatcttagcactcaccatcagctatgcatagttataagcaattttcatgaattaactcatttgattttatttacaaatggaatacagagggacaaaatgttaatagctcgcttcatatcacaaaactagtgaaaaacccaggattaaaatacaaatggtatactgccagagttctaaggtaactgaaccaatttactctctcacctgcaatggatgaacaatttggctgaatcttaacaaagcttaggctttttaacgtgcttgtatcattctcttcagtgtctggtgttatctcctgatacttaacatcaattttcttgataagtaatgatggtgagtgcatattcatatgtttataggtggtttatcaatagacttagttcaaatgcctgtttaggtctcttgcccttttcaactgaattgtttgtttattattgatctatatcaattctttttatatttcacatacaagtcatttgccaccattttgaaactactggatggaaacgacttgcccacagatcaggagttcatgtaagaactctggactctagtcttccacactttctggctatcattattctctcttccttctttctcttcttccttttctttccttctcttctttcttttcttttcccttcctcccttcctcccttcctcccttccttccttccctccttccctccttcccgctcccctcccctccactcccctcccttccctcacttccttccttccttccttctttcctcccttcctttctctctctgtctcataaatcttccacacttctcctcttttctaaaacttttaactgggctccctggaaccagtgtgcaaaaaaaaacaaattatccttttcctttctaaatgattgccacttttgctaataacacttctgaaaagaggcagctcactctctcaatccttacaactgctatagttttaagggcaatctcttggccttccatcaaaattaccatttgtccagctacaaagctggacttgaggttcatgaaatctttacacttgaggttcatgaaatctaatagttctcctctacccttattcattactgtcaagtaataactatttttaaaactctgcaactatcctggatggttttaaggataatatccaataagtcattctcagagttcccttactttctaacatctaatgaacttcccctgcacatcagttgagccacccagattcatggctgcatattggatcttaccatcatctgaaaataatctattttgaaatcacatcaaatcctaatgttctactctctgctacagttttctctcctggttgcctaattttctttctctgttggtgtctcttgactattcacattgcagtctcctagtgatactctcatatctcttctgctccctgctttacatttcttttacaccacactgctagcaaagctgtctttctacaacacaaagttaatcatttaagctcatatttatattggataaagccgatctccttgacaagacaggccaggaagccattatcttggaccttgtattttctccctctccagcctcacccttacacatgccctttaaaaaatattttggagtttcatgatcacactatgtactctcttgtcactgagactatttatataaacatcactttacattttccttcaaaatacctatttatgctcagacatcatttctttaagaaaaagtttaatttactgttttcccttgggatggattaagattcccacctctagagcccctgtaagtgagtatgtatcacaccctaatatttaacctctttggatgcttcatctaatttactctgaattgcaggaaagaagacaactgctcttatctggatttttagctccattgtctttagtaaaaattaaggggaagaaaaaggaagaaaagaaagaaggaaggaaagaaggcaggaagaaaagaggaaagagaggaaaaataaacagtagaaagcgagcactgcagatattgtgtataaaaataatgcaatgatcttaaaggtacctttaagaaataaaaataacaattcatataaaacaatggttacttatgtatcatacaacttcaactttaaataatcagcatattaacactatgtcattcataattccaatttatcaatataaaatattgatattgatatgaaaaaaaggctaggtaattaacccctttgttagagaattaagaaccttgctcttcaagatcgatcgtgttcttggcaagagcatggatggagctaaaggccattttccttaggaaactaatgtaggaacagaaaaccaaataccacatgttctcacttataaatgagagctcgatgatgagaacacatggacagatagagggcaacaacgacagagggtggagggtgggaggaggaagaggatgaggaaaaataagtaatgcatagtaggcttagtacctgggtgatgaaataatctgtacaacaagcccccgtgacacaagcttacctatataataaacctgtacatggacccttgaacctaaaagttaaattaaaataaggaatattgtttctaaattataacacaaaatgtgtacatacagaaaacaaaactaaatcatggaggtgaatacaacagaaatgatttttgtgataatctgcttgattttactcttcaaagtttaaaatgtgattttctcatgagatatctcaagtcttcttttgttgatggtggcagaattaattgaataaaagcccctccaaaactgaaaaataattacataaatatgtgcactcttaaagagccactttacctcatcataaaaattatataaaacttagaatgaatgtaaaactaaaatataattctagagaaattgatcagatttgtagcctcctatatgagattactctaaaatcaaagggattctataggcctattttatcgatttctgtgacctcacaaatttatgtactacccaaaataatttcaaaagtatggacttaagccattgcagagaaacagaagagaaatttatgaatagaatagtgataaaggtatatataaacacataaaaataaacaacttatattccaacatcatagttcaatgttagtataaatttaattataagcttcttaagtaccaaaaataaaagcatgatggcaacgacacatgaagtctaagagataacatcatgataaacagaactgagaagaacttttgtcaggtaatgaaggacatttccaacatatctttttttgttaaaatagggagttttatatgattaatttttaaaactccctttcaatgcaggctgatgacataattgctgaagcccaatttaatttaagagaaactgagaagggctaaaacaacatagactacatctgtcttgagttaggggtaaattagaacatagaagagtgagtggcttgcatatggcctcattaggccatattccatatgagattattaaaatttatttgcaatgtcactttgttttggattggccagctgagatttcagtgtgttatctgcagcaagaaccaagaatgcattttttaatagattctattaaaggcagaacatctgttttgacaatcagttgggaagggttaatggccttttataaattaagcagcttatcatgagtctcgatgagttgggattcatcctacatttttttggaagtaaaataaggggaggatttaaggaaatctacctttgtaaacagtttctgacctctcttcaatatggcagtaaatgaactatagctataattgttaccagaacattttttttcttaaaaaaaagcattctaagtacctaaacacagtcatgggaaaatcttgactaaatcacacattaaataaattttaagtaatatagatttttgatagtactttcaaaagatactggatgccaattgcaacctcagaaaactaattatatctgatgtagggaatcattgtttaatttttatttgaatgaaaacaccatatgataataattttaatttcagagtagttgattttaacccatttttatggcaacagccattatcaaggccaattatctgtgaaagccgtttgtaatgcatgcttataaaaagcatttcatcagtgcagaggagatgcttaccttgctaatctctggaaatggtgagcatatatctactgaatcattaacctacagcttataacaacgattggggaggaatgggaaggctgagaagggtggtacaaattttttttaatgaccctggagaaggtgttctaaaatatgagaagacaatggctatggatcttgaccttgtggtatgtcattaagatacaaggctatgtgagcttcaaccagaaattaaggatccacgctgtatttatagaggtcattcaataaccaattcctaactacagagtcaacgactaaggaaaaaataaaactagacatcttaagttctctaatattttttataatgtgatagagataatatcaatatccactttgtattaactgagtctgaacctcatctgctcctcttagagaagattagccaaagaaactggggcatacaatttcttaaagaggaaactggtactaaataataaaaaccaaaacaacatgatatatgtgaggactaacgatttgctttaaatgaagggctacaggtcatgcagtgtgaaattattcctggaaagttactgaaagttcgcagactgaaaaggctcagagcctatcagctggagctgattaagcaattttgtgggcagaacagtttcattaatttgtttgaagtatgatcacttaaatagttaatgtgtacaacagtcaatatttttattccgtgacaagaaagtaaccttttaattcggacttagctaggtgggcaaaattttaaagcaaagtgatttaaattgatttattaacacatacgagacccgaagggcttgacacaacaagtgcacttaaagaattacaagcagttcaattatccttgatttctagtggataaggtactatatgagagaatgagtaggttgatccagttaaagacccttgtttactgtaatagagtgtttgggattcaaatagggaatcaccaaaaatattttaagagtgagagggacttataatatttgcattttttgaaagttgacccaggaagcaggttggggtgtacagaaaggaggtagttcacaaggatgctactgggacaatcctagaataaaatttgtgaggctggtatacaagacagtcacagttgggctgaagtaaagagacaggattaagaacattagaatagaattgagtaatattatattccagatgagaaataaaaaatgctacttaggtttctagtttgggaaagttggggtgtgaaggtttcagtagctgagatacaacagataaaatctctctattgggatttggagaaaatctcagagcacagctctggagtgataaccactcgggctccacttctaaattgccatgtactattcatgggacactgggaaatttacttaacctctttgtttctcagtttcctcatatgtaaaatgggaacaattataatatttatcttatgttgtcactttgaaaacaaaatgaatttatatattgtgttacttataaccataccccttcataatctcaattcctacctcactcactctcaacctgacaccatttaccttgattccaacaacctttgacttcactgtaatttacaatgtactatttctaaaatctattactgtacctcatatttaatgttcttacttccctcacttccagctcaaattccacgattaagccttacaattactcctttgcatatattctcaactctctggctgccctctctgtacatcacatttgccaaaagacacggtcacatgaagactgggctgtgcctattccattcataaagctggaatgtaactagataaatatgactgaatgtgagtaaagaaatatattcatccaagccgactggaattatatactaaatggatgattattaactagaggtagctgctcttttctccttgaaaatcacagtttctttgaacaattttgttcccactttcctaggtgacacaggcttcttacacatcttgcaccatcctcactctagctaatgacccaggtttctatttctttgagaaaacagaagtattatatctttttgccattgttgcccctcaacactacacagattgttccttttaaaatataagtcagataatttctggttctggtcggaatcctctaatggcttcctattttattcagagtaaaggccaaagattttacaacgacctaaattgtcccacccaatataaaaatcgtatgatatctttgaacttctatttttcctcctatacactcagggctagccactaatccccccagtgcctttgagatctgtcaagtgtctactgcctcagaatctgttggtgaagttctgtccccagatagccacagaggtgactccctcaaatcactcaactctactcaactgtctcttcagtgaacatcttgacagcctcttttatcactgcagccccaacatttcttctttctctgctttaatttttcccttgacattgaaaacaaaaccagtacttatttattgtgtatatttaaggcatatgattactgtacaattaatgttttgatattgttaaacaaaaattatcaaagtccattgttttggactgagctcctacaggaggccccaacagaccagaccagaccaaaccaaaatggaaaccaaactttagtacaaacaacttgtactaaagtgtcacataatcaagctgaaattttaaggaagcaaactgaatcccagaacacatcagttgtttctaaaaatgtgaaattcaagtctacctgacttgggataataaggatgtaacctctcctttaactctttacccaaagagtaacctgaagtaacatgatgttaaacaatcagcttttgttttgtattattgtgttttcttgttcccaccttacaaaatccactgttctatgtctagtgggagctctcattctactctgtagaatagatgctgtcctaattcatgaataaaggcctatttgatctataaataaatgtgttgttattttgttttcaatagtgtaaatattcatagtgaaataattattatagttaagcaaattaacataaccatctcctcacatctcctcatatagttacccttgtgtgtgtgcatgtgtgtgtgtgtatgtgtgttaagagcacctagtctcttggcagattttcagtatgttatactatatatatatatatatacacacacacatttttttttgagacagagtctcactctgtcactcagtctggagtgcagtgatgcaatcttggctcactgcaacctccgcctccagggttcaagcgattcccctgcctcagcctcctcagtagctgggattacaggtgcctgccaccacgtacagctaaatttttgtatgtttagttgagatggggtttcaccatgttggccagggggggtcttgaactcctgacctcaagtgatccacccacctcgaccccccaaaatgcagggattacaggcgtgagccaccatgcccagccatgttgtacaatattagctatagtcatcatactgtacattggatttctacaattattcatcttatgtaactgcaactttgtactctttgaccaacatctccccactcctcccctcttcatatcttcagggatcaacattctactctgtttatgtattttagtacaaccaggtactaaataatttatttagttttattgtttattgtctacattacccctgctggaatgtaaactccataaaagcaaagatttgtctttgttttaatgttttctttcctacctataatactgtttggcacatactaggcatgcaatgaatatttactgaataaattaaataatattttagcatagtctctgggatagcatatatgctcaatcaaaagagctataattattgcagtagtaaataataatatatcgggtatatgcacttaaaataatatgggtcctgcaggtggcagttctaggtttggaatttaggataatgagctgaacataaattaacatggtaatgcaatcaactgaataaacaagatctcattgagaagaatactaagagaggaatgccatgacataggagggtagaatccagggatgcaccgacatgggcatgtcgacattgtgaacccaggaaagatactgaaagcaagtatccagagaaacagagaaaggaccaggagtgaggtataatggaagtcaatgaaaggtagacattttggaaggacgaaatgctcaatagtcatcacacgcttcagagtagatagtaccacaaaaatggtaaacaacaaatgctgagatataaattattaaaactgtggggatatttaatgattagagatgaatcttcagaataaaaactgtctaaaaacagcaatgaaagatttttcaagattgttcaaagacaagaaaattcacgtaacacacgctctttacatttgattctctcaaaaaaagaagtgatagcataataaaaagaatacaccttatgtttgaatttatataactagaggttgacataagtgggccaaggaggcagaccccaggctcactgaattgagtggggtcttgcacagacagatgggtagtaggaagaaatcatagatctcatcttagagttaaaatctgagatcaaaaatgcatctaaaccagtaaaattgccatatttcaaaataagaatataaataatacaaaaattctagaagtcttcaagacaacacttaaatgaataaaaacaacatttaaattaacctaaaatgtaaagtatttttatatggctctcattttatttaattaatcttatttaccataggatgtctaataaaccttacatgaagaaaggaaatttagaattagttattgctatactcagcaatatggaggtattttcttttcctctatttttgtagtttgagaaaatgaagcatttttaataattttgtgaaataaaggcatttaaaatacaaccagtattttacagataattagaatcataagtggtacaaaatgagtaatatgattaatttctaggttgacctttagaaaagtatttttctatcatttcttagttgttataattttattatatcaaatggaagttccagccatttaatttccatgttgtttttcaaaatgagaagtgcatcatggatataaaatagtttgttttttaaaataactttaattttcaaagtaatttgggttttgaatatgaatattgtttgaatatctgcttctcttcctaccaaggttcgttcttttcatagttactttactcatgcattttcatttctatacttattgaattaagtaattattttgcaggtagttaaatttattgttcaataaaattttttttttaaaaaacagctaatagcagtgcataactttcttcatggatgtgtcatcattttaggtagcctctaacctagatgagagccctcaacattgcagatatataatgtgcatctccagcaaaattgcccataagaataacttcattattctgggaagctagatctataaaatatataaaatgttgaagtcttctgcctttacaattcctggtaagtagcagcacgactaagtgataaaacctgagtcagcgtcatttcaagcatatcgttctagaaagcgtattttgacagaaggaaaaaggaaatatagtggacaaaggtgttctgtttcagagtaacgacgtattttagatctatatacttctaccttgattgatgaaaaattatctctagaagcttttaatggtatacgatactgataagtcacagcaatcctaagttatagtagaatgataaggaaaaactcaccagtaccactggacagattgttgtgggtggtaaaatatggtccttcaaaggtccacagtcacattcaggttttagatgagaagcacatttattatgcagctagaaaaacagaaagggggatagtatcaaattctacatgacaacgcctaacatgggggagattatatttcaatcgagatacagcaaacacattaaaagtacaataaagaaattataagaacaaataaacagagtcataaaggaattcataatacatttgtccttatatatgaaccctaaataaaccatctagcagcttctgtgacccattctatacattttataattctcagaaatgtttatattaaaaatgtactttaggttttacaccaaagaaccctgatttctttgacaaacacaaattattgtccattacagttcttcctttgcttatctgttagcataatcttgaaaccactgtgcctgtgtatgctttttttttttttttttgaccctcctgttttctcaaagtcattccaaagtgcacagctcagtatggggcataattgatcccatcattagttttaactttgtaattcaatatgtaaatgtaaccagagattcatctcagtaggagcaggatataaataaaagaagatgattatgattataaaaatttatctgtatattgtatttatcagctcaacgttaagttagtatataatcatacaatgtcctatttattttttaatatgtatgagcccaaactaatatttttattaacctggtcataagtttacattaaggtgttacaacgtggtgttttaaatagtgatgttttaaaactgagatggtagttttttaaagaattacacagatttggtaaaataatacttgcttgagggcatctagagatttctccctcctgcactatgcattaatttgatatgaactcttcatactttagaaaaaaatatacatttcaataagataacatgttatgttcaaaacaaaaaagagccacattatttttccattttgaatcaaaagctacctcatttaagccttggctgcattaatttccacaacatacatacctttgtgagcagttaattatcaactaagcataggagtctaatgagagttgatttatttttagtaatagaacagtatcaaagaggtatttctgcggtcctagaatctaacactgctgtcatgctaactccctgcattggagttaagatgacttgtactgtaattaatgcccattaggttacattacatgaaataaacgtatctttccatgttcatccataattagcagctctgcttctcaggggcatataaacttctctataaaaaagtgatttaattgtattaggcactactggtctttgtcaagaggcaagaagtgttgaagatagagaagcagctgaatgcacaatagaactaaataaactgatactcagagcaaattaaaaggtatagtttcctcaaaataaaattagtgacttgtttaaaatgtattattaatttattggacctagtaattaactttcttagaatctgccatggccatggatgtttggatttagagttaacagattagcaagtgttgggatggatcaatttctcccaaaagatatgctgaagtcctaacttctgggacctttgaatgtgaacttaattggaaatacggtctttctagatgtatttaagctaagatgttggtttagctggaccctaatccaatgactggtgtccttataagaagaggggaatctggacagagagacaacggcacagagaggagaagtccctctgataacataggtcgatatctgagtgatgcactacaagacaaagaattccagggattgctggcaaccaccagaagctaggaagaagcagaaaaggattcttccagaaagccttcagagggaggatgacctgctgacatttggaattctagcctccagagctatgagtgaatacattcttgttgttttaggcacctattatatgacattttgttacagcagccctaggaaactaataaacccagtactatgaaaacggcactaaaaccaaagagagattatgggtcttaagactctgctgcactatggatgtcacagagaaagagctttggctctttaatcttgggcaacttccttaaaactgagaaaacagacgctaagaaccctctacaaaaaacagatctgagataaaaacctatttgtgtttacagcaagaaagtgttgaaatattattcttgattacagtgtaaagctaaacacgtgactctgaaggccacaggggcaggacatactgagtcttatgccaacgctgactacagatgcagtcagaggcctcagcctcctccacacctccatccatgtgtttccaacaatttgcaactgacatggtaaaggacgactaagctctctgtatagttatttgagggttactgatgtaagaaaggatgacaaaaataaaattaatttgatgatagtttgggggcatttaggctagtttcccagaaggaaggaaagaatcgaagactcagatagaatcatgcaatagatgagcttaccagagtgtgtgtgaaggggcaactctgtatattgggatttgggagtttcagagcataggtactgacagttgattccatgaaattctggtctttgcagagccaaataaatctagtatgggatttcccagtttgattgccgctgtggtcctgagttttgtctaggcggtcgtaaggcactccccaagacataggaggatctataagtttagtaaccatactatcatctgttaaacagagtcacacaatgcaagaaaattctcctaaccaagaagtctatatttgataatatgcaggaataccttatgcttgtattaagactagaatctggcagctaataaatacattttcttaaccatcaacattatgacgttgtttgtagccaagagtgttaaaactgagggcatcatgttaggagtacggatcattttacaagtcgtgaatcaaatttgtatgacaggtttagtttatgcatcatatttcttggagatatacttgaggaaaaaatatacaatgtgaaagccaatgtgaaaaatgtgtatcattttcaggaccacctataaagtgtaaaagtgaatatcatctttgctgtgaacttaaaattgctctaaatcataaagtctattttaaaaagcaaaaatcaacaaaattatacaatagaattcaaaagctacaaattttttttctttaagatactggtaatattttgtttcctgatcaggtactgcttacagaacattcatgtggggaaaattcattgggctctgccctttggatataaatgcctttctgtatgtacactttccttcaatgaaaagctttttatagtttgaaagaatgaataagacctactatgtgatagcacaacagggtgactacagtcagtaataatttaattgtacattttaaaacaactaaaagaaggtaattggattgtttgcaactcaaaggataaatgcttgaaaggatggataccccattctccatgatgtgcttatttcacattgcatgcctgtatcaaaacatctcatgtgcctcataaatgtatatacctactaagtacccacaaaattaaaaataaaaaaattaaataagtgaatatcatcaacaatagaaagttgcttaaacttatcatcatatttcgtggacaagaatataagaaaaagacacagctgggtccttctcagtgtaaataagatgctgaaggctgactattgttttaaagataacctatatcccaaatcagcaaaatcctaaacaccagggtcctcatcaagaatagaaatgaactacagcattgaagatgctgcctctttagtaaaataaccaatagcgcaccagagaaaatcaaatgtttactatttaaaatttaaaaaaacatttttgttcagttatctttgtatttttttcaagccaaggcatagaaatccttagctcatttttaaatatacatccagaaattcccattcatgttaagggattcagtgccatatgtaggaaaatcatataatagaaaccagcttttcctggaagtgaattaaacacttggaaataatttcagagtttatgacaacttccagtagcacctaatttagagccagatctatgtttattagaaaaagctgtctcaagatagaaagaaaaagaaagtgtgtggatgtctgtgtgcatgtgtgccagcatatagttctatggatggagttaggaagagtggctgcgctggtcagagaagaaaatgggatctgagaagtcaaaaggaggaaaaatggaaaataagtgttcataggaatttagaggaaaataagaagagaaataagctacttttctaaagaaaaatttgaagacctgatttggaggcacatatttactggttcacctgttacactggcccctaatattttgcagtttggggtacttcctaagactggcatttactgaagcagaaatgtttccatggcattggaaacctttaaacattactgttaggaatttagtatcttaataaacaatattatctctatatcatagcaaaagttagtaattcatttttatgaaataggtgttattttttcaagcctaaataaaatccctcaacttcccatcctggtgagtcctgcctgaccagtgagagcttaccttgacaagcaatgattcacaacatgttatacaacgaaggtcaagaaaacacagtttcagaagaaatgaacaggtataagcagtgggatattaaggatgttagtaatcaagacagaaaagagaactgaggtgaatattttgcctgtcacagaggattgaaatataaaacacagagactggttgcctaattatcagaaggcagttttccactgatctttcctaagcttttcgtatttttaattttgaagtggctagatttacaaatgaacagaaaatttcattctaagagcctaactttatatctacaagatagccaactagtaaatcaagaaactgcaagtatgaactgaaaaatgggtgtgaaaattgattcttaagtatttgtttaagtttacttgcatatctgatggagatttgagtattacaggatgatattataaaacaaaacttaaatagtacatatgtttgaaatttaatattctactgtaagaatagcatatcagagattaaagtgatcttactgaagacttttctacactcagtactttgtcaagaacttcaggtgattaggaaaaaatgtgtgacatggacaagcaacaggagcgggccacagttaacagtgcaaacgatgttagactatggtgtgaaaccaatggagagcatttgagtttttcctttggatgtggaatgtaagtacagaaactattcagaatcaagatatattagcgtcaagaaaaatttcaaggaagacaggtaacctaacttgtttcctaaggtatgattagaatttaagacaggtgcattcaagggaccgggatgaacaaaatagtaggcatgagggaaacatggcctccccaagggactgccaacagaaatacacagctatggcagagggtgtgtgtagaagaggaatattatatacagttatgtttaggtttgattctgatttctaaagaactaaaaaccaacttgatgcaaggggtgttgagggctgcatttattatcacagaactattatagattgctaaagaaggcatataacaaactagtattttcagaagatctttctggaggtggtatgcagcctgcattataggaaaagtaccttctgttagggagatgagccaagagattttgactctaatctagtcaagaggtgctaagagcttgcactagggctgcgaatgtggagacaaaacctcaaatctgagagagatattttaagtaggaaatgacaagactcagtgacaggttgtgtacaagagataaaggtaaaagacaagagtaaaaaaaattgacttcaaactttttttccagtgactggaagcatgacaataccaggtctgatagaatgagagagttgtagtaacagtctttgggaataaaaatcagtcagttgggcttaggatttagtgagattcaggaccacaggattctggatgtttttttgagtgcatgcaggtgctgttctgactcagactggacaactatccatccttctacaggagagagagaaatgacgtaagtgttcttcatggagtgccctctggaaaaccagggattggtttatgtgcacccaaatgtatttatgtatttcataatacccacaaatataattgttacttactaagcacttaatatgtatgaggtcttgtcctaaacatatctacagagaattttttgcccctttaatcctcataataatctaataacttaggtatcattaactccatttgacacattaggaaatttgtctaaactggttacataaatggcccaagatggcacaactagtaagtgaggagacgatcttaagaatctggttggtctgagttgcaacagtcaaatcatttccaaaagtcatatataaaaggaagtaatggcttttggacaaaccctgaaagaaagccaagcatcattctttctgtttctctctacaatatattcttcacggaacccgaatttcagataggcctttctgaagccagcactggcagtgccatatcccattactcccataacttctgctagctctttgttatgtccatagtactttctggaaagtgtaagagcaaaagaaagtacattcagttgtttaaaggcaagcagtagtagtagatactcatcagtcaagagcagatcaattttatgctgaaattttcatgcaatggttcaatagaaaactataaatactactaaatacataaatgttctgaggtaaatatatcctgtttaaccaaggcacaaaatcaataattaagtaaatgtgtccctaaaattgcttaaaattaaaaatccggaactggatggaggctgaagtgacttttgagaaactgatagagtctcctggatatatgataactttttaaaaatttgcacaagttgtgttttatgaacttaatacccataagacccctaaagctcattgtttatagaaaataaggctgaggatggataaaagtctcaggactttagagagtttagtaagagggcagcctttttttttctttctgactctgccttaactccaccagagatccctggttagccttgtttcctaaatagagctttgagattgattaattgacttatttattaataattttgaacttggggatttaagacatttgctgtttatgttgtgctttgccataatgacaaacaaaatcacattcagctattcaatggtatttagtgtaagaataaaatgttaagggtatattgtcttatctgatttgagacatatgatatttagatttttaaaagtacagtctattgaaaagtgatatcctttttcctgtaaaagaaactgcctcttttcctgtaaggctagggtcaggatcaagaccaaagaaaaatgaataacttgtgaatggtagggctaggtgtggattctgaagtaccagataagaagaaccattaaaacaaaaaggaaaacaatgagaaaaacaaaaagcaaaaccatgaggaaaacaaaatggaatataatacaaggaaaggaagaattttaagatgctttgtgtaccagtaagagaccactagcaatggtaactttgaggacagtggttctcatgactggaaagggtagaagacagacttcatggagattaaatagagaaagaatgagaggattcaaatacagaaaattctaacagctttgaaagcttttccattagaaaaggcagcaatgcatgtttttagagggttcaaactgagtacacacttaaaaacattgattttttaagaactaaaaaagaaaatatgaataataaacctaagacaataagtttgtaatttatgaagaataggtaaacaattggagatacaaagaagaaattatttctaatattatctaatctcagcttatgttaaagttaagatataaccagtgaaatattcactatatgaaaaaaataagaggaagctccctgcaaggtctgaaacaaaaatgacatatgtttgtaaatgcttagcaaaaaaaaaaactggtttttaaaaatctacatgaatgtttttaaaaatgaagtagttatgatcttcttaaaactgggaattcaatgtttgagtaattcatgtgtaaaatttgaatcatcgttagacattttattatactaaccaaacacttttaaaaaactatctttcataatgagaaaatttcaaatgtaaacataatttaactaatagctgaaaatgattgcagaaaatgtattcatttaaaggaaagtacttaattgtatttttgaaaagtaagtcagttgtttttctcatcattctgtatgagtgtgcatgtgtgtgtgagtgtgtgtgtatgtgtgtgtgtgagagagagagaaaaagagagcatttaagagaattgtttaagccctgggttgagggtggggcacttggggacacagtggagacagttatttacttaactgattcagtgcctcctactgttttattttgacaaaagtaaaaactttagtcctgtaacacgaatactcactctaagctgggaaacaaaacctcagccccataaatattttgtactacattatcaaaaatagctattattgaaaatgtgtgattctaattaacttacagaaattacacatataactgtagaagtaccatctaacaactgcattcattccaaaaattttttcaagctagatttgacagtcattcaaaccaggtgaaattcccaagtgtcccagaaaagaccaatttatctcttcttacttaattgtgaacaccatcaagacaagcatttacatcagtctctcttataccccaatgcatgatttaactgaaagaggaaggcaacaatatgttggaagaagcgtaagatgaatttttagatgcatcaagacctgaataaaacacggtctacttgcccttctatctagtcacgtggtcaaggacaatctgcttaacttttttggtcttagtcttcactatgtacttaaatcattgaagctcattgttcatttttctaacccttttaagcccatagattttatgactaaaataagtttacaataagcaaaccagaaaacccttattaaacagggttgtggagtaaagggagagctgagttctacccaaacagtatcctattcttattgcttactcctagccatggcctctgattaccttcctgggaacctctaacactccatggaacacagtttaaaaaccataccatggtatcatctcttagattgtcaccagctctaaaattcaggactctatggggacaaatctgaccctgagcctatctctttgcaaacaagctgaaatgagaagtttccatggttttatgcttacactcagtttcaggaagcccttctagggtaggactttcagagagtatgatatacacgtcttcagtgtgggtgaatgctgggatttgttttccaatttttactcactgtgatctgacaccaaacacaatgcagtcctgtcaggccctggtaacatttaacagttttgtggcacttatcacacttggttgggcagttaccttcaacccagtaatggtgcatgacctagaacagaatgacaacattgtgataagaggacacactacataatggccaccttcagaaagcaagcatgcacacaaacttacatcagtgttccttttggacttcacataggtcttgatgcaagagggaggtgctcgagccacacagcgctcatggactgtgtacttgcagactgaaaggaaacaggtacacaaattcagagctaatcctggtcctggttgtaattttatagagaaagaatgacattaacagaacctcatttcatatccactgctccctaatcaatccaatcagccacatcaaggagaagtccaagtcgactgtttttaccatggaatataaaaggccaattagtacaggaaatattatgcatgtgaaaaaccaaggctcctctatcatggcatagcaggaaatgcttaattaaatcagtcctcactcaaatttttcacaataattcccagatgacaaaaatattaaagacaaattgatgactgccaaatggcttggtgtcatttgctagaaggaagagatctatattttacaaagtataggcatgagagcagctggcgggtatgggaataaaagcccatgagtttatgttattttgtctcttatctaaatcttaaatggctgattagtctatttccagagaagagatttcatcatacatgccaggcctttggtgaaaattcatccttcacttgccatcatggcatcgtttgtccaaaagcaacagcctttgctgggcggcatattgtatacatatggaaaaatttatgtcactatgcaaatgtatacctacacataagcaaatatatgtatctatgtatatatataatacgtgtcagaaaaccaagacatacatttttggcatcttcaaattctttatggtttgagtctgaatatgatttagggtcaactacatgtgttcttttaataaaatgttggttccagattaagggttctaaatgcataaatatataaaacagtacttaaaaataaacatatagcctcctcaataaaaacaaaagcaaaaaactaaccactgcctcaaattaaaatgaaaaacactaaatctaaataatatttatatagtaaaactctcccaaaatattcatatctgtgattttctttggcaacattgagggagaaaacatgttttctcttctcctccgtattaaaaataatattgaatattgcattcaccacactaatcagtaaaaacttatgagcaaaattctcattcctcatataatatcactcatcttatttgagacttatcattttgttttatgtgttcttgttaacagactgtaccataaaaattccttttcttaaatataatagaactttaaaaacaaagtacttcctttgtatagggagaatgttctagtgtaactaacatgtaactaaactttcaaacgtagctgtcagagactatgttacacatggcaaatttcaggtaactttattaaaattcgtaaatagttcagaaatcatatgcatatgtggcattaaaacatggtattaaatttcaagtaacacagctgagagaaaggaaattctcaaacatattaccaaagaagctgctagctaacgacaaacaaacaaacaaacaaaaaacctataaaccatggatggtattggaagccagtaagaaattagatttaatgaaatgcacaacaatggaatgtatctaatgaacttgacagtttcagtaattctgtacaagctgaaaaggttggggagagataaattgatggattaatggagaacttaaatgaaggggttataatatctacccttttttatcaggactatcatggattgtaaaattttctcaggtagatatgctgtagatttaaaattacttaggtgattttataaactaactgttatatacactataagaacattctaattggcagacctgagttaacagaataaaatgaaaattgcaaagatgggtgaactgaaatttttaaaatggccacgactcattaatcatcaatgctctgcattccaatgtctattaaccatatatgaagattttctttctgttagcattgaaaataataggcttgaggtgtaaaattagttcgtatatcttgcgatttcctaattttaatgcaaatctatttttaatcaattaatgtaacttaaacaaaatacccaaaggaatcaactcattataagatgttcatgtgaataaagtcactaacatgtggggagggggggatgaatatgaataagatgtaagtatgaaaaactagtggaaatattcaaaataatccctgaagaaatgggaaacatgaataaattaaactacagtggaaagaaaattgctgaagacttggaaaatgtccttcatttttttccaacggtaggtttttccaaaactgaagaaattagagtaacctaaatattcaaaaacacactacaggaaaatataaatcacatgtacagagacagtccagatcagatcttaggtctccatttacaaataagactattccatgaaatcaacctttcctcacttgaggagatgatgtccaggcagagcaaatgtactcacaggaacagcagaggccctgcttccccacgccaatcagcatgttcaggcaaaggttgcaataggcaggtttgttaaagtgcttcagtcgccacacgtgctgtccatcatccttcacgttctgcatgggacgtaagagaaacagatttcacttaatgaaataaacagtgaaagatgtaagtgccaatgaaattcagagctggactgaagcatgtgaagacaatctgttatttcatccctgactttctccaagatcaccgcagagcctttagaaaaacacatgtgctccagtgaaatgagatagtgctaacaaatcaccgatgctatagcaacccacaaatccttgtctaatattaacagctcaacagcgtaccccaagccatcgtcatgacctgccaaatggatcagggacgtgattgcctcttctttaaatactttatccttagcacaattccataaacaaataaataaataaagagaaagagaaaatacccttcagtggaacagcctgacaaagaaaaacctgcaaagacgtcattaacccttgcttactagtagtaatatacaaaattcatgatggtgatcaggtcatgtaaggtggcagaggaatgggatgggatggaaaactaatactaaaaggtaagttattggtgacatactagggcttcattcgaggagtccttatactatattccaatttatattaatacattgagtatgccacaaatagtatattttaaaaggcaaactttttaaaggatttcattatgttaccattttgtttacccccttataaaatataagtagttttaatctcacagaaagatggtaaaaatattaaaactgtattaatatttttatttataacaatcactatggttatttgccacaatacaaccttgggtttaaattaattcccactttagcaaaacactttatttttttctcttctcagtaaaactctctatatcataatagctactcctgtaggtatttaatcacagctgcattgttcaagattaaaataaaatgaaataatatgatgcttaggaatttcttgaactccttacaagaaggtcaagatattaaatgaaattattatatattattacttttgctaccatcattttctccattaacatgtactgtttgtagtctaatcatcaaattatatcaaacagattaacatttattggtattctattgaaaacattatttgccataactttccaggttgtccaagttgtcatatttcttggaacacattcacctaataatttctgagcatgttttaagtgcttgggcattaacgttactcctgtggtagtgaggcaatataaatatattcagatcatcttgtttctcttgataataaaatattaataataatgctcctaactacctttcctattcccagtcaagggataaaccaccagatttgtaatactagagaaaatctacagtaactaattcttacattagaaccagaaatgtcaaatttgcctcacaacatgaaacattaatgaaatgcttcctgggcgataattcttggtgggtctcttgaatttcttcatgttttgcaaacagaagcactgtcctttctttttctttctttcttttttttcttcttaagactatcttttcaaagatgtttgagtaacaaacagcctagccttggacaatagagacatgtctccctccagaggagagggccagtttgcttactatacttacagtataataaaaataatcactcccttgtaggcaaaggtgaaatgggcttgtttcctacacattataattcatttagttttcttaagtcagggtttccaaaacgtgatgctgtgcacaatcatcaattgggtcccactctgtcgttcccatgagattttggaggcaaggtgaactcaaacgtgaagctcctgttgctctctttgttgtgaataacaaagtctattgtctctgactcaggagtctcatgtcctctggcagcatccataaaactgtggcaagctaatacattaacttccaatagggtaaattttggaccctttacaattcttgacattgctcagatttacctttctgacaaggggctaacaaagtctcaacaaatacagctacgcaggtgtcatacagaaaacttcagaaaacacaggtgttttaattttctttcaaaacctaagaaataggctttgtattaatttctgaatttcctattttggtttcggtgagtcatagatttctagtagctttatcacgtgaatagaatactttatatatttaactttgctatattttcaaaactgcctacattttaaaatttatatcccctcaaataatatttaaacatccttatgtggaaaggttaaatatggggttgttaatttttaaaaaactaaattaatatttaaaaaattaaaagtagtagctaagtgcttaaaaacatttttaaataaaaaggacaaaaagctaattttcgtatatattactgttcttgtaattcttgtcgttttatttttaaatgattgtccattacatgtgaataagcttcatcctttgaagagcacatatggagtaagttagctggcattttccttatcaaaaaataaacaagtctgaacgtgggtgttctgtcaatcagaacacttagccgtgttacaggctgcaactgatgtacaaatccattacccaggcataaaatgctttaccaaaaaacaaattaaatggctttatagctcttagctggatacattgccaaaatatgcaagggatgaaatatgtatgtgacttctttaagagaagaaattgaaaccaggagccaattacttctcagcagtgcaaattatactccaactctctattttcatgtcttgtcttgtttatcttacttagatcgtaaacttaatgggggagggaaagaatctgtcccttctttctatcagccagtagagcacattcctattagtccttccactgcaaatatatatttattgtcaaaaaagggaatttattttttataaaacaaaaataagcagggcatccagaaaggcttgattcctagcctactatgaaaatgtgaataagccatttcacctttcttcctatttcttcctattttcctctcgaatgaaaggaaaatacccacttcccttttccaggccgtggtgtgaggtttcattatacaacacctgtgaagttaatttggtttctcagaagacgggtgttatataaacagcaaatattatcaccctcattgggttgtgttgtgtaacatcccaatttttcagtcaaaataattgagaaagatacctaaaatttcactttatttcattaaaatgtgctcttttttcatcaccagacataacactgtgtattgtaatgaagctgttcaggtccgtgtttatgacagataaatgcttaatgaatcctaggctactccatgctgagaaggaactttacattttccccaactcttagttgcctacaaggcaaagggatgtttcaaaggaaataatgctcttcagaacttttaaaacctattatcctagtgattctaaagttttagtttttccataaataaaaatcattatcctagtgattctaaagttttagtttttccataaataaaaatctttatcctagtgattctaaagttttagtttttccataaatacttccaagatcacataaaatgttcaagtgaactagggctactataaataattttttttcagaagacctcaaggagaaatttcattgatgtcctaacccacatgcttctctccccacacctagttatgtttcaactgacttaacttatatagagagagagaggagctaatgttacaaataattacttccaactcattaaataacaaagaacattaaattaccttactttttgtccaaggtctccaaaaaaaaaattatgacaatgtgacagaaactcctcttatttttttttttttttttttttttttgagaggagtctcgctctgtcgcccaggctggagggcagtggcgcgatctcggctcactgcaagctccgcctcccgggttcgtgccattctcctgccttcacccactgcgcccggctaattttttgtatttttagtagagacggggtttcaccgtgttagccaggatggtatcacctgacctcgtgatccgcccgcctcggcctcccaaagtgctgggattacaggcgtgagccaccgcgcccggccgaaacttctcttttagacaaaaagatgagctctattaggcctgggcaaagagaatgcagagaaaagttttaaaattctgagtggagctgtcatcaactgttcatctccagaccacacattgtaaggtcacctgtcattcctgaggctcaaatgcaaaatcaacagcaggttacaccacgtagtcatttttcttaaatgacacaatctggaatctcaagaatttttgcattcatctagttttgtaactgctttctacattgagcaaagtatagacagcagaacaaaaactcttaaccaaattaaaaacttttaaaaatcgatgtgctgaacatcagctcccaaaatataatacatagtcttctattctccatcactcaggaatttcatcagagaacacactgcatattactttactgagagtcaagaaaaaaatgtgtcttaaacaatctcagtcaaaggcaaagtttaaatgacctataagaattgaagaccaggatttttggcacacatatagtgagaccaaagtataaaccatccagaaaccatgcaggctagatgtgggtacaacaatccacaataacaagttaaggtatcgctatttcaagctagtctactgcttaaatgtacatttctcttttccctataatataaattcaggaattttccttgaaaaaattaaatgacgatccaaagttagagatttcagaaattgaagccttattaattatcttgttcatgcaggaaaaggaaatgttcaaactgaaagagtattaggaaacactaacttctcttcttggctaacttctcgtttttccggagacagcaactgcctggtataaaaatgacctagttagttaataacagagctaaggtctgttatctgatcaatttgatgacgttcactgctcctatgctttctgtctattagtcctcatgtcttgctgtggttgtccgattgtgccaagtaaaaggtattagattcctttcttccaaatgaattaaaataaattaaaactttttctgttttttaatctgagaaatgagtgatagaacagatcagcggttggcaaactatggcactgagtcaaacctggccagcaacctgtttttgcacatgcagttttattaaaacatagcttttgtggttcatttacataatttctgcgattgcatttgtgctggaacagcagagtttagcagttaaggcggagaccttatggccccatagccaaaattacttaatatctctccctctgcagacagtttccaatcactggaacagagtttacctctatataaagttattcaacaaaaaaagtgttttaattacattggatttttttaaaaaacaattctccaatgagatgaattctgaaggaagaatgaataagtctcaggtataaattttcattgtggtaatcagaatcacaaagccatccaaattctcaattttccttcaaatctaagagacactaacactctataccatttctgacccattcatcttgtattttgtaaagtttgtagagcctcttgtaagagaaaagatatggctcttgctctctgctatttggtatagaatctggtccccatcaactccatttctgattttggtaccaaaatagatattctttaaaatagactagtttttaaactgctgttgctggagaaaaataaattgcattgaaatcgtaaatgttgtgccttacattagaagtgaagattactctcccaggactacttccttttctgtgtaatttgactaggacaccacagtcactttcaaatacactgtggtattttacatgcaccatcaattagaacctactccccgagctcataattgacaatagacaataacatataggacaacctaacaagacaagcttcacaacaaatggccaacttcaaactgcagtatctagattttcaattaaataagcaaaggtgaggggatagattcatggatcaaattctctacaggtaataatgtaacacattaactgcctacagaaaggaaataaatctcaattgctaaaaaaggttctcatcactcagttgtcttggtgtcattcttgctttttaaaacaattaccatgccttagaattcaacagctctttctaacaaatagatgctgtattttgtgatcattacacatgattatatggcttatacattttattaaaagacagcttaaaatgtaggtggcttacttttttcacaaaaatgaaagaaaagggaaatttcttcttttaaagttgttctttacagagatggggtggggggcggaatttagtctcagatttaaggtggtctcttgagattaaataaggtgcctctgccatctagcggccgtcactggtaacacaactctggaacacagctctgatagctataataaaaccttagatttctcctatttagctccagacactcccttttactaaaaacataaaaaataagtttacaaatactattaaaaagtaaattatgtacagttaatagagtgcacattaaatgcatagaattgccttacaattgaaataatactacactagaaactaatgaggtattatattggtttaaaatactttgagttaaatcatatagatttgtggactctattacctgtgataatttttataacttcacaaatatctatatttataaattaaataataaataatatatcagcagtagtttccaaaaaaaatcatcatttcaaaaaatctcttgtgacatttaaaatacgggcaactgactgtccctttctgcacttttctatctcaccctcgactaccagatgatttacttgctcattcctgcatcttccctccttctctcatcctagaatttacatagatgcttagaatatacaaagtttagctttacaaacataaaatgtccttctcgggaatcattattattggaatttcctgactaaagttatctgacaatttttcaggataaagtatacattaaaccttaaaatgtcaacattttgtcaatttttcttttgttttctcccagtagtctgatttacataatggtttttgtcataaggtacatgaacaattaaataaatattgataatatagagctaaatatggtattataaaaaaatactcagttatgtgtagtataagaaattcaggtacaagaaaatactatttcacaaaatttttaagtgtagaactacatacttattaacaataatatatatattatattttgtttaaataaattagtttaagggtaactttccatatatcacttattagtattttattgttttccatcctctgaccatgtcttggatcccatgggcctcatgaaaggtaagcttcaactgagtttagaagaaatttgaagacccaggtaaaaaagaaaacaaatagtaatctcttgaaacctattattttttcctaaacttatacatattccttaaccctcagctcatttgtatattcctaaagcccatttatatattcctaaacccatatgtgccaacatatttttatatatactcatatgtttcacaaacacagacagtaagttatcttgagaaatgacttttaaaaatttggtgtcttgaataactatgatatagtcttgaatctgtaaaaatatttcagctggtaataagaagtatgaagagttttgggtttggcagcaaagtggtgaatactatggtcttacaccttaaaactctaaatattacaatttcattgttctttccacccctaatgttctttgaaattaagtagacatgttattctatacatagtatatctaattattgcataactattaatgctgaatttaaaaatctggcatacactatagatttcatcagatttttagaataaaaataactgaaatctgcttcaagtctgggtcagcaagatttgctttcaaagtcattattatattacattctcatcttaggttgatttattttattccttcacaatggtatttaattgcaactagaggaactactccaagaaaacttttgacaggcgatagaataagaacctggctcctgctgatacaggaaaaacttacgtttatttaagttggtgcaaaagtcattgcgttttctgccattaaaggtaatggcagaaaacgcaatgacttttggcaccactaatctttaaaccactggagatatttaactgcctcctccaagtatcagttttcaataaaatagattacctttataggtaggaggaacattgaaataatgaagcaccaaaagaactgcaaaatacaataatactggagagcctcttgctttagataatatgaggaggtcagtaacttaaaaacactagattgcaccttcaacagaggaaaacaaaagagagagaatatatttttaatcctgaagtaatacctggagtgaatcaatatgtgtgtggcaagtattactacacaaggagttactgtcaaattgcaccgtggcatacttattaaaagttccaggcactcactgcatgcttaatggtagaaaatggtcacatcaatctgtaatcaaaatgtgtaatagagagccccactgactcaccaccaggccaccctcctctgtggaaatgcttacattttctaagcccaggagcacaagaagtggaatcgttgtcattcctccttgaatccattcctccagagacacggttccatcatgatcatagtcaatttcttccatcatttcatggaggatctggagtagaggagataagggaaaattggtggtcaaccaataaaataaatttcataggctacaacatatgaaattgtgactaacagctaagtggagagttgggataactgtcttgctaactcagtacaacattaattctattactgatgaagagcgactttgttagcatttctaaacctggccacttaacactgatcactttttagaaataagtgcttaacttttcaatatttttcccatgaacagcacagctaaaacaagaagaatctttaataagtgtgaaagtggtctttaattactttcttcatattattttttagattcatatatatgccagaaaatgtctgaacaaattaacttcatggcaaagagctcatataattctttgctaagtagtaaggggcgaaggaatttagttgcttttaattgcctatcagaatttaatagagtcgagaagttaaaggatcaaatcaagtttaattaaacttcgtttctaaagatgacttgcacgtaatgtcttaaaatgttctctgcagtgtttgtttgcaatacatttacctctctgtggtatggtggcaatatcagtacttacctagaagggctgttgtgaggattaaataagctaacgtattataagcagacgagcccctggcatacagagtcagagtcatatagtgttgtttgtgctattattaatggaaattatatataagttccaaacatattacccttggttgctgggaaagcaaagtacttcccatctaatggcgtcaagatggcaaacatggtaagaattctaatgaagaaaggaactcacgtctttatataatacaaaaatgttaatcaatttggaaaaaagagaaatgcagagagcattggaacagagattggaaaagatgcaatgcatgaaatatttgatttgttggtagaagtattgtctgcctagacactcttgtgcttggtgtcttcactcaggaagtattgtatttgaaaattagattatttttctcctcttgcctctcaagagcttgctgatgaattagtagaaatgtatcaatcataagagaaataaaacaatgacatttgtttcagatgggtgatgctttcctttttgtacctaataaatctcatgttaaagccatcctctgaccgtgtctcaaatcccatgggcctcataaaaaaataagattgaactgagtgtagagcctgagttaatttgataaaaacttctagggacgctccagtcttccctactactattgtaatcaacctcaaatgttcatttctctctctctctctctttttttttttttttttttttttgagatggagtctcactctgtcgcccaggctggagtgctgtggcgcaatctgggctcatagcaagctccgcctcctgggttcacgccattctcctgcctcagcctcccgagtagctgggactacaggcgtccgccactacgcccggctgattttttttgtgtgtgtatttttagtagacacagggtttcaccatgttagccaggttggcctcaatctcctgacctcatgatccacctgcctcggcctcccaaagtgctcggattacaggcttgagccaccgagcccggcccatttctctttatttatatatgcaaacctatgagaagcctgctgatgtgtacatttgtttacaatgagaactactgaagccttaggcaagatgacaaggcagttcccatgacagcagacataatgtacaactttgtaccatttcagctccctggaatagtagcagacttatcagtaacacacatgtcaaataatgctatagtttattacttgtattctccattcaataatctgacaaatacactaggtatttgttgtagaaagactactcagccaccagctttccccttcctcctagcatcctgatgtcctttttctcaaatctacaaacacaccccccaacacacacaccaaaaatgcttttgttgagaagtgttagtgcccgctgtttagaaacctgaatggaggccgggcgcggtggctcacgcctgtaatcccagcactttgggaggccgaggcgggtggatcaggaggtcaggagatcgagaccatcctggctaacacggtgaaaccccgtctctactaaaaatacaaaaaaaattagccgggcgcggtggcgggcgcctgtagtcccagctactcgggaggctgaggcaggagaatggagtgaacccgggaggcggagcttgcagtgagccgagattgcgccactgcagtccgcagtccggcctgggcgacagagcgagactccgtctcaaaaaaaaaaaaaaaaaaaaaaaaaaaaaaaagaaacctgaatggaaaaacaaatccccctcccactctccatctaataacaagctggcttgattgacagatgactaatctgcacaggtagaaaggtgagtaggagaggagaaagctgttgtcgattacaagggcaacagaaataatcagaaattcctggctttcagtgaaaatattaaggtgagtcaaacaataaattaaatacatgttaccatctactttattattccacatacaaatgacaacctgttaatgacatctgccactcactagaagcacagcatatgcatttcccaatagctgctttaaaactggaaaaatcctaatcccagtaagacaggaaaatgctatcagagttcttgcagcatatactcatgccattatcctgttgtttaccgcatagatgtgaacagaggttaaatatacacttcttgaatttgcataaaatgtaaaatcatttaaataaaatttatttgcattgctttattcatatacactttgctaaaggttttaaaaataatataaactcaatatctcttatcaactttccccaaaatattttttgtggccaaagttatggtttcaagtcaagtatattttaatatgtattttaataatgttgaaattttgatgtttattcaaaataagaattctatattcttaaaagcatttttagatactctttctctaaacaatttaattaaaaattcctgactagctgaagagctttgggcaagtaattttaacatatttgggtctcaatttacttctctgcaaaagggaaaaaaaatagtgtatctacctcagagagttgaaagcaatatataacatatacacaaggtaacatgatgcactgtgcatggaaaactaccatcttcttttatggcatggcatggccttggcagtgtctatcaggaccttctgcttatccacatgtatgtaagaccaccattcaaaataacttccacgaggaagaaagcaaaagttactgttaacagcttcagaaccccacatataccttgttatcttattcagaatccactttgacttctgattagaaatagtaacttagttatcaaaagataaaatgaaatgacaggaatatatcagggtcccagacaagagaaaaaaaaagaaaaagaaagaaaagaaaaggaaggaaggaaggaaggaaggaaagaaagaaaaggaaggaaggaaagaaagaaggaggaaagaaagaaagaaagaaagaaagaaacaaagagaaagaaagaaaggaaggaaggaagaaagagaaagaaaggaaaggagagagagagaaggaaggaagggagagagagaaggaaggaaggaaggtaggagggagggaggggagaaagaaagagaaagagagaaggaaggaagagagagaaagaaagagggagagaaacagaaagggagatagaaggaaggaaagaaagaaagaaagagagagagaaagaaaaaaagaaagaaagaaagaaagagaaagaaagaaagaaagaaaagaaagaaagaggccttccagaatttagccaatagtgaaatcattcatatacctactggattaagttcagtgacatcccactcaaggtattctgcaacatgcatcatctgactgatgatattttctagctcctggaagagaaagagagataaaaaatatgaatacaagatcttagtgagttttaaatctttcacttgcagaaattgttttgttcaatgtgtagctaaaaaagttaaatgagttctatgggaatatatatatgtacataatcctttttaaaggtctaattaactatataaagaaaaaagaatcctgaatataaatttatcttgtacattgtctagaaattttcaccaggagagggcacaactttacaaaaaatacattttcttctactaaaagagagtgtctgaagaaagcaggaccaaatacatactgtcacatgtgatttttaagacactgaattccctgaacctttggcttgaaaatagatgtgaaagggtggacaaatcatttgaggacaactgagaagtctatttttatcttgatacactgagaatatacattgactgttttagtcatgtattgaataatttgctcttgaaagaagagtgttcagggccaaggtttgcaggacaagtatatgcagcatttattttgtgagaggatgaaattttagtttgaatttccatattattctgctcaattatcaactctttgaagaattgcaagttaatacagatgacctggctaaattaattaaaacattttcctgcctatttatctaatgttttaatttttctctacctacagaaaagattaaacatggctttgtgaaatgcttgtaatttcacatgaaaacattacataatttgaaaagtggtgttttaccgtatgatttaaaatgtaagaagtataaaagaataaagcttgaaagtgcaatagtcaaagagtattctactcaaatctctaatctaatatatgtagtcgatgttcatggaatagagaagaaatacgataaaacagattctcttttgggaagccgtgtttccctccgaggaactaatgaaagctatactccctctctccagaaaaaaaaaatataattatgaatatgttacttaagtaagacaggctgccccagaagtaatacaaagataaatgtatttattacagattaacaaattttaaaacataaatccctttgaattataggttaaaagtgtgcatgtgtatgcacacatgcattactaatctctcacctactccatctttgcttacatatgccttaatggtttggaagtgttaaagttcccggatatcttttaagaacagaaactatttttggtggactgttacgtaggcatgtgatattaggtaagccaccccacctaagactcagttttctcgttggtaaaatagctactctaactttacctccttcatagaattgcttcaaaggttaaacatgttattatacaaaaggcatttattttgttgtttgccgtattgcaaatgatcaacaaatcttaactattattattagaaatagtggacaattttcaaattatcattttctttctgttttgcctccagtaggtgaactgctacaccttaaaggtaccaagacacatgatgtcagaaggtacaatttaaacctgacagcgaaggaaaaatattggagtagtagctattgtggagaaaaccctagaaatgaaatccaggcctttaattacaaaaaaatagagactagtttaatcaaaactaaatatatttatccccaactcattgtttaatattgggactatagttctaaatattgctagtagtctactgtatatgctaacaaaaaatgggcagagacaaaaaaaaaaaggactatttgactgaattttcaaatcaactgccaacccatggctaaagcctagtaaagaatcatcattttaatttaattaaaaaagaaacattaaataaaacaactctccttgaaaatagaatttgcattagtgtagtcacaagtgctatactaagcatattaaagtatctagaagaaattaaaatttctagtcgtgaaatggcaccataaaatgagcaaatttattatgtagcttggtatttctaatgggaaactgaagaccactaggcacttaaaaataatagcatttgaaaaaaaatttttttttttttttttttgagatggagtcttgctctctcgcccaggctggagtgcagtggcacgatctcggctcactgcaacctccgcctcccgggttcaagcggttctcctgcctcagcctcccaagtagctgggattacaggtgcccactaccacgcctcgataatttttgtatttttagtagagacggggtttcaccatgttggccagctggtctcaaactcctgacttcaggtgatcgcctgcccgtcttggcatcccaaaatgctgggattacaggcataagccaccacacccagccagcatttgaaaaattactgagacttacagataataaatcccacaatcacagcatcaattcagagtgatggtcatttcctagagtaggagttatatattttaatctctctctggagaagctaatgtaccattatcctactcaaagttacataaataggcttccaacctcattgctttgcttttaaaagtctattttagctgccatagggtggtctatcagatgacgagaaaaactcactcattttcagagatcatgtctatttcagtcattattaaatatatcaaaacatttgtttttaataatattaaatacattaaaaatggtacacttcaaaatttccaaatgacacttattctattaatattcttatatttccttgatagaacaagaaataatataatatgcaaaatatgttaccaaacataaggtagattattggatagaacctgagatggaatttcatgcatggtactgatctgtgcactaagactaagaactactttctatttctctgaaagctagcaatgatttccatatattacaaataaacgtttaattattcccttcagttaatcatataaagatggtattttcttattttttatgactataactatacaatgtaaaatgaatattaaactggatgagatattttaaaagcaaagtttgtgaaagcaatctgtaaatacatttacctatttcagccgcatataggacaaaagataccatgtaaaactgggaaaataatgagataattaaactgactttatacatccttaaaattctacttatagtctcaagtttccttaatgccaaatgttacagatagtttttccctcattctaaatcaatggtttcaacttaatcttatgttttattcagacaaggctggtgcctttcttttttttacctaacttcagtgcaggaaaaataaaattaaaaaagtcatgctgtggtatgcaaaactattcagtagaacaattgtaatcccaacagtttcctcagatcactctctcgcaaaaagtcaaaaagataaaaatgccatatgagtggatgtaaattacattaagtgtgccttctgtggtaataactacaaatttattcattgcattcttcagaagaaaatctttgaagttttcacagaaactttgaagaaaaaaattaccgagctgtccaggaagccattcccatccgtgtcataaaggcgaaacataactagaatgaaagaggtgttgaaaacaagattataggcaaataagatcaatgttagtttaaagtatattcattaaaatttagtttgtgttgaaaacaaatactaaattcctctcctgctccaaacaattaatttgtgggattatttctcaaactaaattgaaaatgaattaattagttaatagaaatactggatagcataaagtctatcaaattttgtttgtttctagaagacactaaaaagtactattatttgtttaaactctttattacaagatcattaaatgtcaactcaaaactaaaagagaagaagttgaaatattcaaagcctgggtattaaagagcagagtgcataaggaaaaacaacaaatgtgaaatttagaaatcaactataatttgaaatccactattcacaattataagagcttggtcaaaaacttttctttatctgtaaagtgagaataatcattctaccataacacatattaactgtgaaagttaagggaggtgatagacacaaaagtgaatgtaagccatagatcatgatacaaatagatgccattgttaggattgatccccaagcagtatgggcgaggaaggcggagtgcaaaataacaggttctttctgatggaggaagccagcacagaaaaactgcattatgatcatggctctcatggtttatttgtttaaatctgaggtggagcttcagagggtaactgatgtttgaactaatcaagtaagggaaaggagaacattgggtctctgttagggggttcaggaaagcagatgacagaggtccctgatgggcctgaggattcccttgtataattcacacatccccaggaggctgtggaggaggccacaggtgccattttgagataaatagagaagacagacacagctgtaaaaatagaagaatggaagtacgggtttgtcttgggtttgtataatttcctgaatgatcttgatgtctgaagtctataatattaataaagatgttgattactaagcagcataattatataatgaccctgatggtctatttgtaggtgattatttttgtatttaatggttactgcatttcaccaattctaacatattattattaataagatgcataattagtctatatattgctaaaaagaaaaaaagttagccatgtcactataatattatatttattgtaagaggcaaacaaatgttaaagatgttaaagtgtaagaaaacaaatgtctgtctattgacttaagggcaataatactaaactggctaaaagacttaaatatctgtattgtaaatcatggtaatgattccttctcatacagtcaataaataaaatgcagaaggaaacagcaacttacaacattgtggatactaggcatttcaagagattgtagtgcagcagcaaatagtgaaaaatatctttgtaagtggcaagaattgacggactactcagagaaatgattaactaccaggaataaggcaaatatctagaaaagcctaaatatatttcagattgagggacatttataactctgttaacccttactggagtaaatgactgcaaaatgaccatttcacgtcgctcaaatttgtggaaaccctgttctgatttgttgaccttaatgggaacatgaactcaaagaaacacacatgggtaggatatatatagataatgggcattcattactgacagtgtctgaaacttcttcctattttctgaaaatcacactttatgaagagcattagaaaatgaaaactctagataccttttctttactagcctgacttgaagctagactgtgtgcatggcccaggctccaccacacagaagcacagtcccaggttatcaatcagatgctagtgacctaagcaaaagaagcttgcacagaatcccttctggtgatgggaggcggcagtgatttcagagagaatatccagggttctggatgagtcaggggtgtttcgaggcaaccatcccagcccaatttaatacttcatttggtcatcgttcctgaaaaggcagcctctagaatttgttctctacctctcccagtgattctgcatgctcctaaatatcgcttaaaaataataacatgctttattaaaaacaaccagttgaaataaacccgtttctatgtctttcccaaggatagtgtgtacttaacgttggttttaaaaatgaacttactattgtaatattacacttacagataaacgtattatttaacaccttattaaagtgtacacaccaatgtaactattacctctaaatcgaaaaatagaattcttactaacaaatcagaacccctttcatcctcccccatcattattttttcttctctctccaaagacacccattatcttgacttctacatcttttcttttgaattgaattgaatataacatttagaaaatgtttgccggccgggcgcggtggcttatgcctgtaatcccaccactttgggaagccgaggcaggtggatcacgaggtcaggagatcgagaccatcctgtctaacacggtgaaaccccgtctctactaaaaatacaaaaaaaaaaaaaaaaaaattagccgggtgtggtggcaggtgcctgtagtcccagctacgcgggaggctgaggcaggagaatggcgcgaaccagggaggcggagcttgcagtgagccgagatcacgccactgcactccagcctgggcgacagagcgagactccatctcaaaaaaaaaaaaaaaaagaaaaaagaaaaaaagggggaggagccaagatggccgaataggaacagctccggtctacagctcccagcgagaccgacgcagaagacgggtgatttctgcatttccatctgagctttgaagggagcagtggttctcccagcacgcagctgaagatctgagaaccggcagactgcctcttcaagtgggtccctaacccctgacccctgagcagcctaactgggaggcaccctccagcaggggcacactgacacctcacacggcagggtattccaatagacctgcagctgagggtcctgtctgttagaaggaaaactaacaaacagaaaggacatccacaccaaaaacccatctgtacatcaccatcatcaaacaccaaaagtagataaaaccacaaagatggggaaaaaacagaacagaaaaactggaagctctaaaaatcagagcgcctctcctcctccaaaggaacgcagctcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagagctacgtgaagaatgcagaagcctcaggagccgatgcgatcaactggaaaaagggtgtcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcgagaagagcaactccaagacacataattgtcagattcaccaaagttgaaatgaaggaaaaaatgttaagggcagccagagagaaaggtcgggttcccctcaaagggaagcccatcagactaacagcggatctctcggcagaaaccccacaagccagaagagagtgggggccaatattcaacattcttaaagaaaagaattttcaacccagaatttcatatccagccaaactaagcttcataagtgaaggagaaataaaatactttacagacaagcaaatgctaagagattttgtcaccaccagacctgccctaaaagagctcctgaaggaagcgctaaatatggaaaggaacaaccagtaccagccactgcaaaatcatgccaaaatgtaaagaccatcgagactaggaagaaactgcatcaaataacgagcaaaatcaccagctaacatcatgatgacaggatcaaattcacacataacaatattaactttaaatgtaaacggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatacatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaactcagctctgcaccaagaggacctaatacacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacagcctaacatcacaattaaaagaactagaaaagcaagagcaaacacattcaaaagctagcagaaggcaagaaataactaaaatcagagcagaactgaaggaaatagagacacaaaaaacccttcaaaaagtcaatgaatccaggagctggttttttgaaaggatcaacaaaattgacagaccgctagcaagactaataaagaaaaaaagagagaagaatcaaatagacgcaataaaaaatgataaaggggatatcaccaccgattccacagaaatacaaactaccatcagagaatactacaaacacctctatgcaaataaactagaaaatctagaagaaatggataaattcctcgacacatacactctcccaagactaaaccaggaagaagttgaatctcttaatagaccaataacaggagctgaaattgtggcaataatcaatagtttaccaaccaaaaagagtccagggccagatggattcacagccgaattctaccagaggtacaaggaggaactggtaccattccttctgaaactattccaatcaatagaaaaagagggaatcctccctaactcatttgatgaggccagcatcattctgataccaaagccgggcagagacacaaccaaacaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtatcgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacagagagccaaatcatgagtgaactcccattcacaactgcttcaaagagaataaaatacctaggaatccaccttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaagagagacggcatcgccaagtgaatcctaagccaaaagaacaaagctggaggcatcacactacctgacttcaaactatactacaaggctacagtaaccaaaacagcatggtactggtaccaaaacagagatataaatcaatggaacagaacagagccctcagaaataacgccgcatacctacaactgtctgatctttgacaaacctgagaaaaacaagaaatggggaaaggattccctatttaataaatggtgctgggaaaactggctagccatacgtagaaagctgaaactggatcccttccttacaccttatacaaaaatcaattcaagatggattaaagatttaaacgttagacctaaaaccataaaaaccctaaaagaaaacctaggctttaccattcgggacataggcatgggcaaggacttcatgtccaaaacaccaaaagcaatggcaacaaaagccaaaattgacaaatcggatctaattaaactaaagagcttctgcacagcaaaagaaactaccatcagagtgaacaggcaacctacaaaatgggagaagattttcgcaacctactcatctgacaaagggctaatatccagaatctacaatgaactcaaacaaatttacaagaaaaaatcaaacaaccccatcaaaaagtgggcgaaggacatgaacagacacttctcaaaagaagacatttatgcagccaacaggcacatgaaaaaatgctcatcatcactggccatcagagaaatgcaaatcaaaaccactatgagataccatctcacaccagttagaatggcagtcattaaaaagtcaggaaacaacaggtgctggagaggatgtggagaaataggaacacttttacactgttggtgggactgtgaactagttcaaccattgtggaagtcagtgtggcgattcctcagggatctagaactggaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaacactatgcagccataaaaaatgatgagttcatgtcctttgtagggacatggatgaaattggaaatcatcattctcagtaaactatcgcaagaacaaaaaaccaaacaccgcatattctcactcagaggtgggaattgaacaatgagatcacatggacacaggaaggggaatatcacactctggggactgtggtggggtggggggaggggagagggatagcattgggagatatacctaatgctagatgaggagttagtgggtgcagcgcaccagcatggcacatgtatacatatgtaactaacctgcacaatgtgcacatgtaccctaaaacttaaagtataattaaaaaaaaaaaagaaaagaaaagaaaaaaaaaagaaaatgtttgccaatcttttcttctcctattacaaaacaaaatgaaaaacaaaccaaaataacactgctggatttctaatgagattgtactgaacctatagatctgtttgggggagaatctttaaaatgctgagtcttgaaatctacaaccatattatattcttctttatttagagctttaatttctctcaataatatttcatattgttctgtatagagacctttcaaatagtttttaaagatttatttccaggtatttaaaaattttgatttgataaatggtaaaatttcttaaattttatttacctattattagttgatgtcatacagaaatacaagtgatttttatttctaccttgtaggcatagatcttgctaaacacacttattaattcaagtacttgatctatctatagattactgggtagtctataataaacaatgaatttcaatttcttctttcccattctcataaacttcatggatttttcttgccttattgccatgagcaatgatctccaacagaaagttgaactatacttagagtagtggccattcttgtcttgttcccaatatcaatgagagaaacttcaatatttcactcttaaatataaagtttgatgggtgtttcttatatatacacattattagattaatggagttctatactacttttatttcgctaagaatttttgctattacagttgttttgtttttaatcatgaatagaatgcatatggaatgtgataaaatacttttatgattttcttctttattctcttaatgtggcataatacattgtttcattttctaaagttaagtcaaatttaaatgcctgtaataatcccaaattgaacctggacatgttattttagctactttacatatataactgtacttgattgctaatatcttgtttcctttctgcttgttatctggaaaaatatatgaatggcttgtactttaatttctttaattaaatggaaaaagccatgcttccttctcccaaatatttgccctaaaaatccaagttgctttgatacttccctgaaaattttgaacaggtttttaaaatacacattcgttccaaattttccagttgattccagtaggaaggttggtctgaaaatccctacttcactagtgactgaagaaactaatattttaaataatttattcctaaacacattaacaagagttaatgctctataaatcctgtctaattcatcaaggaagaaagtttggagagttttaagctctagttaatataataacaataataaaaatatcatacatatattgagtaccaagtaccatatactctaaatattaccaagtcaaggtcaaggatagaacttttctttcatccagaagaagaaagagaaattcaaggactttaattttcagtgataagtctacttttctaatttaaaattgtagctaggtaatgcaaaacatgaagtattgaacacacatatttaccttggttttctattgaagtaccactatagtaacagtaagagatgaaataggtataaatctataagcagaaataaaatatgagaggagaaaacactaacacaattttcaggagctggagaaaatatgtacacatgtatattgacttagaggtcttagaaatataaatgtaagctggcagaggagaagaagcatagatttgcttagaaagggtggtgagttggaaaattaacagattatcttcacaggatgatctctggggagtatgtaagctctcttccccaacagaagactagatctttgagttctgcaaaagtgaaatgaaaggaattctgggctaaaggtactcaggaattctgagtataaggatacaataccaaaacaaggtaattatgtgaaagcgaatataccgaatattgagagaataagtccttttccttatccccagtaagtcaataccatccgtatggatactcacctatacaactactaccatcagaaaagttctttcaacacaagtagtttggaagaaaacaacaaagcagggaggaggggaaaccttataactaaaaggaaagtttcaatccatgaaatacaaataggaacacataaggatcaagctgagaataaaatggattctctgtgaagttaaatgtaaggaaaaagtgggaaaaatctcatcaccaggtataaaagatgtcccagatatggagtgaaaaacataagaagaaagaaaagaagatggaaaatagaaaaagcaagaaaaaatagtaattcagagttctgtcttggatgttcagcatccaaataatattggttctagaaagagaacaactaaaataaagggtgaaagtgattatcaatgaaaatattcaagaacaaatgaagaacgcaagtttatgaacataaatttatggtggagaatttgggaattgattagttatagaaatagagaaaatgaggcgggcggatatttgaggtcaggagttcaagagcagcctgaccaacatggtgaaaccccatctctactaaaatacaaaaattagccaggcatagtgacacatgcctgtaatcccagctactagggaggctgaggcaggagaatcacttgaacccaggaggcagaggttgcagggagccaagactgtgccactgcactccagcctgggaaacagagtgagactgtgtctcaaaataaataaataaataaatagaaagaaaaataattaagtaagaaaaaaggcaattattaactccatggaaaataaaagttgtttggcctggtgagcctataaaacctttctcttttaaaactatatttaaaaataatatagacattattaatattgaattttcaaattatatagtaagactatttcttagtattcaaaagtaaagtcaggcccaaaggtcaagggaatcactgaacaaaaggatcatatttttaaaaacaaaataaatatatagctgtttggctgcaaaaatttaaaaagcccaatgttaaaattattctgacaacacgacagcttccaaatatgggtatacctgcttcaatgttataaactagtttaacccacattttttcctatttttatgctcatgtcatttcactttatatagaaacaattatgcccacacacgtatttagttaaaagatcagagcaaaggcatattatgcaagataattttttatatccaaattttttttccttccaaaagatttgcaagtttctatctgttttcataatgaatatatcctactatacacactctggtgttttgcacttgccattatgtgttgttgatatgagcattatatgatatatgttattaatataaacaatgtaaaatatatttagaaaaggcacttaagctggaatttctttaattcacttttttccactcttgtatattttgatactgatttaataaactttaaaagcagaggtgaaaaaaatcagctgcttaggtgtgtttgacatccagtttaatggagagagattttcgccttttattcataagagaaacaacaataagaacaacaaaagacagcttttcaaaataaaaagagccctataaagtagctcagaaattatggattttagtaatagctagataaactggtggtgtaattaataaccaccctctcttggtctttttttttttttcattgtcaaactataggaaagttgactagatggtctttaaggtctcttcattattaaatctcatagtttctaaggttaatactgcacagggaagtaacttttaacatgtagcttactattcagtctccatatgtcagttatctactttctgaatattgattccctattgattttctctttagtgatacattttaaggaaatgtaagataatataaaaaattcttgttaaataattgataacttgataagcacaaattcaaaagtgaatatcatgtattttaaagtcaaaaatataaagttagtattattcaatatcttaaatagttgatgttatttttatattttcaagcactcattgactttatttttacccattgactttaatacacttccatttaactatcatttattgagcatatacctgttgaaacacacacacacacacacacacacacacacacactgatgtaggtgcaagggtacaaaagagagcaaaataaatccaattaggagatggcaagaagattcatgatgcagggtaagcctcaaatgtggactagactcaatcaaatatacactgtggggaggcagggggttgaaacccagcaattgcacattgtaatcaaagggatcaaagtggaaaagttcagggtttgtctgatgatagaaaagttaacccttgtgactaggacatggtttgtgcatatgtgtgcaggtcacagccaaagcaagcctggcagagtaggttggggtcaaactgtggagtcagatcggtgtatgcacgccaagttaagggtttcaattttacgcattatgaaatcaggaactatcaaaggggatttttcactctgaatcagaagagaaacagaaaaaaaataagtatgttagttgataaggttttaagtaagatgaaaggaagttgcaagaacatacacttaatgagtaagatgatgattaaataggtaggtgtttggaaaaaaaaacattatctggattaatttttaactagaaaactagacaagagaaacactgagcactgaaggccagctgaggttttgagtagagctataacccaaagaattatatttttatttcactaagtctctgccactcagtatagtataggagcaaataagttgaatgtctgaaattaagtgtgaaaaactaattgacatcatggattatgagatcagtttaaatttgaaaggatgggcaaccaaaagtcagcaagcaaattcaagagggagtaaagtgggcaagagtaaaacagttttaatttacttttatttcacctaacatgcatttatgggaagtaataagtgtgaaggaatgtatgtgaacaaatactagtttaatctaatcctcatagttatcccatgggacagagactatttaatgatctcaattttacagttgagaaaactgagtcctgaggaagttttaaaaatgaactcagatcactgagacagtgaattctcaacctagggtttgcattcaatcattataaatcaagagtcaaggtttttaattattgtactatgcaataattaaattaaaagtaggaaagtgagaagttaagtgaacataggctgggatcaaagtaaaattgacagtttagttttggaataatagcagttctcgacagttacaaggcttggagtattgtaacagaagtgaatggctgaaagaaaatggaggcaaagccacaggatttgagggtaaaagagaggttgttgactttccctaaagtactatggagcacttgaagttagaagggcaaatcagccctgagaccatgtccttgttcattcacagaggctgttggtaattggtaccaacaaggagagataaaaatggaattccccacaaccccaacacacacaggcacacatgcacgtatgcatgcatgcaaaagcacacatccaagggtaacaaacaccttctacctgatagagccttgggacgggaaggtcctcagagagaagaattaggattgcataaaggaaataaagctgaagacatggcttatatggtaagtcctcaatatgattgctagatactgggaaactgtgacttcaagcaaaacaatgtacagagggttctcgaataacaccctttccttctatgacattttgttataacattgataagcaaaaagtggttttgttatatacatttctcaacttcaagtcacagcttccaaaaccctattgaggatgttaagtgaggacttcctgtaatcagtaaaacatttgggaacttttgtttgttattctttaacggaataagctttataataaacatggtgtaaatacctggcagaaaagacaggcaatggaaagtggcgggaggcactgaatagattttaaaaatatttggggaaacaaagtattacttatataaacattgacaacagtgtaattcgtttatctaataacccaggtaaaatacctaacaaatactgccactattcatcaactccaggaaaaacaactgttgtgtcaggtgaattccttgtgtatatgtgttttcactggacagaaggaattgcataagccagtgcttctcaaaatgtgatccctagaacaatagcatccgcatcacctggaaacttgttagaaatgcacattttcagatcccaccccaggccagctgaatcagatataccagtcctgcaggtgactctgatgtgtgataaagtttgagaacctctaacctaaatcaaatttctttctgcttagctaccctggaagtatgagccaaattcaacattgacctgcaaaagttaattttaggtacttgttcacatctgtttctgtgttaattataattgctttttcttattttcattcttctggtctatattgtatttagtaaattgtaatccttttggagtatttattaaactaacaatcaacacaaatttttgaagtcttactgacaatttgtttttaaaaatctgtaactgtaaaataatacatgttagtaacttttacatatgcaattttagaagggtaaacatatgtggtaaattgttaagaaagtggatgaggaagattgattgttatttaattgacacaggaaagagccaggcattggcattaaaaaagaaaaagaaagaaaaccaaacttcggatgattctgatgtatagccagggtaagaatcaccagattagaagataggagaaaagagacctacggcatcatgtattttgaagagtttggtgaaaatgatagtgataattctgggccataacaagactgcctataagaagagtctgaagaaatggtttaaaacaaaaggaaaaggcaatgcatctagtgtaagcttgaaaaaaagctgggaaactcaaagaaaaaaacagagagaagggggttgagaacactaaagaaaagtaaatggcaggtcagtggatgagattcatcatgtctttttgaatagtgtggtgagtcaacattctatctgcaactgtagacaaaatctatgtgggttcaaggatgcacatggaaaactcaaaagcattcttcttaggaattccacctaaaaagcaatatacatccagctgacctagaaatagttaaacagcaagactaaataccatcttggggaggatggatggggcctttattcattttcagatgtggaaaaaatgtttgtctttatatgtttataatcatcccaaatgtgctcctgataacacctgagcaaactttctctctggctgtcacttcaatagaaattcactgaacattaatatttactttggaatgagacagatttctgtaagttcttaggaatacaaaataaatcttgaaatgcaaatattgaacatttatgaataataaatatatatttaaagatgatattcatatggtttattcataacctaagcatgtgtgactcttaaataatcacattacagtaaatcctttatgggaagaagaaatattatcaaaaagttactactaaatttaactaaaaatgccccccaataataattctgagacgtcatgattatttacatttgcttcagaagtgttaaagtttagatttgttatcttcactatcattctagtagcaagcatttttcattaaatttaccatatcttatataatcaaatttatcaggttattgagtaagctgccaggactatatttagaaagaacctcagagatagaatagatgatcaaatgatcaggtttagagtaaatgcttgaaaaatattttcttatattgcaatgagtatagttagccaccagagagagctcagtcactatgttttattaaagacagtaattatttactttcaactgaatagaaattctctatccgccatgtcctaaatttaagaaacaaagctattgtttaatgatttataatatccagaatcaaatactataaatgacactttcaggtttagcatttgaggaataatgtgtctctgccaacaagagtgttagtgctgaagattgcaagggagatttccactggggaaaaggtgcaggttgcatatttacaggcaattttcttactcactaatgggaaggtttcttcacacactagaaatacatgctttatgaaaacaacacaaaggctattttctaatagcatcttgttaactccagagaactgaggaacagctttttaaagtcatatgacaaacataggaaataatcagtagtaaatggaacttgataaataagaacctgaaattaatagatcttaatatcttttgtctgatcctcagcaggaggaaatttttactattaagcaggatcactttattcaacaaaaattatacaactatactaatgcaattttaagttaatcaatatccagtcctttctcctgcccccaatcacgataagtaaacaaaatgaagaaacacatacactcaagcttatcctcaggtcttcctctttcaagcagagacaggtaacagacaatgtccttcagatggattacttctggggaacacgtatttgcaggagaagtagtccggggaggggtgatggcacctttattcattctcagacctggaaaaaaaattgtctttatattttgttaattatttacagtgatctcaaacagaaaacaaattaagaaaatagagaacacacaggctacatagaaatttatattttttaggcatagaataaccaaattctctgtaagatcggtacagcagctagacatagcctacgactgttgtagatgaaggagagttctttgggatccacagacatggcactgccctatcagccacggatggtatttgggtcagaataatattaccctaggtgagttggtacacatttgaatgcttgaagacccacttccctattccacttttctgtgctttaggtagtgacagctataaatcatttgggaagatatttaaaatggactttttcacaaaatactaaagaaaaaaatgtcagtctttcacaatataatttctctattcataataagtaatcatccattcataaagtcatatatttgtttcaaatatttgccaataccatgaagaagacatccttttttaccatcaagggacttgcccaggagtaagaataaagagaacataagcaaaactctggataaacatgatggatattagagaggtaaaaacatatgagtggtttggtttttaaatggttctgactttatttctgaaacccattatctgtgtctgttctatcacaaggatataggttgcttattacctgtctggtgataatctaaccgaaatatgttcacagtaacttgttagttctgtcttacccagaagccactgaagtcagattgtgtgtatctgacaaggcctgaagataaaccgcaattatcccttgagggatatatggcatttttagaggtatttgggagaaataactaatgggttgagtggctactagattcctaatcaaccaggagctactgtaaggaataatttgaaccaaacacagttctagaaccctgttcttagcacagatctacctgactgcgtatgtctcactctactttagtttttcaatttgtaactttccatgaatacctatcacctcgtcaagccatctcaagattcccaggcatataattcaatgtgttgtgatatgtcccaagttagttttatcattggtgatgttgtcactaataaagggaactatttactgagtgcctaatatgtggctgaaatcatggtagtagctttaacacatattatctcacattattcttacgtgaacgctgtgaggtagagtgcattttccccactttacagattagggaccgtcttacagattttaacttcccagagtttcataaccagcaagacaaatccatcttcctgtttctacagtggtagcttacaaactatttttgttcaaggccaatcataaaagtgtaagaaaaataatttacatcttaacacagcacacacacacgcacgcacgcacacacacgcacacacacattagtgggattcataattgcccaaatattttcttttctatattaacctactcatattctatcctattctgaaaatttttctcaaacaccatctaaattgagtttactagccaccaatggatcaaaaatcacagtctgaaaaaacacggctttgggtctttccatccttttttatttttaattttttttatttttttgagatggagtctcgctctgtaacccaggggctggagtgcaatggtgcgatcttggctcactgcaacctctgcctcctgggttcaagtgattctcctgcctcagcctcctgagtagctgggattactggtgcgggacaccacgcccggctgatttgtgtgtgtgtgtgtgtgtgtgtgtgtgtgtgtgtgtgtgtgtgtatgtttagtagagatggtgtttcaccatgttggtcaggctggtctcgaattcctgacctcatgatccatccacgtcggcctcccaaagtgctgggattacaggcgtgagccaccatgcccggcccctttctttttaaaatgaagtcttatttatttcaaatgtggctttatgttttacattaattctacttctgtttataaagttatcaacagagacatatattgtaaacggaatttcctttttaatagaagtatcagtgtatgtctaatacaaactaatagttatttatgaaccaaagaaggcagggaattgaagacaatcctgagctttaaaaaaaaaaaaaaaaagaccggaataattgaaactagccaactaaagcttagccagctgcaggaataagcagttccaacttatgataaaaaacattttggcgctgacccttgacatgaccataactttcagacttggagaacacagcacttgaattatggtcggataagctatgacctaactcatcctgctgatgagctaatcctcttttccaatgtttccccctgtggtactgaaatgatttaatcagcttgatttaactcctttatagaaaaattcagaacaaaacaaaaaagaaagaaaagaatatgctctgacatttatttgaaagaaagccaaatatattatagatcttcacttatttagaacatggcatgaccatttgtacttatacaactaaggtagatggtgtttaattatcagctttcaccatactgaacacaaacaattgagaacgtaaggatcacataattttgtcttttctgtatgtaatgtataaatcgagtatgaatgtacacatataatttgtatttagcatcacgtttttgaaggaatatgctactgtactaaaattatttttgtttggaaaaatgagtaatattttccattttcttttcatgaaatattgttaactgaacacttaaagctgtatcatgtatttatcacatggaatacggttaaatgaatatttaaagctgtatcatgtatttatttccatgaaatattattaactgaatattaaagctgtatcacatatttaattgtgtcacagttttacatttaaatagcttaaagcttatataaaagaaatatgggcatatattcaatctatacattgaagaactaatcaactcttccttaagtccaatagcagccaaatttgagaggtaaaatatatatttttggaatgatttatagagtgcactgaagaagaagataaaatgtcaaagaccttttattattattacttgataaaaagaaaattgtagaacaggacttaattctttaaaactattcttttttaaaaagtttgaggctcacaacaaaattgagactgtacagagattgaacactgctttatatctttccttcattttcttcactcaagtcttgcttacttcaaatatctctctgtgtttcacattaattctacttctgtttataaagttattacccactacacatgcatattcctccccactaccaacattctccaccaaagtagtacgttagttacaactggttaaactacattgacacctcattactatccaatctctataatatacattagggttctctttttgttgtatattctatgagtttggacaggtgtataatgaagtgtctaccattatagtgtctttcagagaagtttcactgccctaaaatatttctactctgtttatttatctctgccctcccaacaatctctgaacctttcattttctcccggattttgcctttcccatagtgtcatagagctgaaatcatacagactggctatttagactggcttttttctgttattaatatgcatttacatttcctccatgtcttcttatggcctgatagctcatttctttttatcactgaataacattgcattgtctggatgtactacagtttatgcattcatcaacttgattaaattttgaggtgtttaattaataaaaaagcttggccaggcaccggaactcatgcctgcaatcccagcactttgggaagccgaggtgggaggatcacaaggtgaagagatcgagaacatcctggccaacatggtgaaacctcgtctctactaaaaatacaaaaattagctgggcgcggtggtacatgcttgtagtcccagatacttgggaggttgaggcaggagaatcgctggaacccaggaggtggaggttgcagtgagccaagatcatgccactgcactccagcctgggcggcagagtgaaactgtctcaaaaataaataaataaataaataaaaataaaaaaactcacagatttattcctgctcctaccacctccccaagatcagcccactttttttaaatgtttctttatattatattttcatttagttttctgaaagcagaccctggtcctcaatctatctccacaggagttatttttacaccctactctaccctttatttatttatttatttatttattcatttttttttcttttgccctttccctaaatctggctgaagctcactacttatcttcctcgattgcagttcactaccctgaaaaaagtcctttttccttttaagaagtttgcactaatctaatggttattcagaagcttaggagacaacatgtacggcaaccaaaaagttgcaagcctgacttcttgactacagctgagatggtaaaatgataacatgaaatagtaagtgagatcctttctagcagcaatagcctctggtgaggaagctcaaaattctatttttaattaacaaaggccaattttacacacccagtcatcagtgaaattctctctttacaactaaaatgaaacataaagctgggcaaaacaaaagggtttgtttgttttttggcctcaagtgatcagagctaaatattgcttcagagtaaatattgcaattgacacttaaagtagtataatctgcagattcttctacttgccctaggctatactactttaaatatttcatcacaaaagtgaagcaaatgtgtgtgtgtgtatatatatgtgtgtgtgtgtgtatatacacatacacacacatatatatgtgtatgtatatactacaatagtacaaaataaagtgaaaagtaagcattgtaattagagcgtattagtcttttaggaataattatcttgtacttagcatttatttctgttaaaataagttcattatatatacacatacatacatacacacatacacattcttttcttcaaagctttagttataaaaagtagttagcattagtcatatcgaatgttgcctatgattatcacatttctaagcacatgattttcattatactccaatctagacacttcatttcttgaaacaataacctcaaaagttgtatttaatagataattttaattccagcttcaggttcaattattagcagataagttttgggtagctgttaaattagtgcctctggtccagtttgtttcattttcaaacacttgcatttcatataatgtaaacagtgacattttctctatttcttaatgaaatagtcaaaaacaataacatggatcacatttctaaatttataaggcaatacaacactggcaatttagctttttcttttaaaatattggttcaatttacagaaacgtatcagatttatttatcacatagtataattatatttccaacatccatactattggtcataatgagtagcatagataatcagaataaaaatagttgatattagtattgtcatatatttcatgatttttacacttaatctttcaactatgcttgttgtagtatattataattatctttcattctttatgtttacccaaaccggcagcaaaattaggtagatggcattttcagtgaataagaaatgtaatagagatggtgattccttataaagagaagacagactgtgagatacagtccctgatatgaaactgggatcagacaaacctctctgagaacatactctggttttcatctgtttggacattggcaaaaaccccaaacaagcaattacagggagaaggacttaaagtataggtctttggggataacgttttaagagcagagtaacctctgtgaaggaacaacattaataacagctctggttgtgtgcaaacaatacttttgtacagtggtcttatttgaccctacaattctgttttaaagatgagaaagtggaaagtcagtaagtaaactgttcgtgatcatataccagtcagtcaacggagcaaaaaggtgaagacaaatcatctcattccaaactttggactctttttaaaagcagtaaaaatgagatctgtctacaccagtgttatccaataaaattttctgaaggctgagttcagtggttcacacctgtaatcctagtgttttgggaggccaaggcaaaaagatcatttgagtccaggagtttgagcccaacctgggcaaaatagggaaacttcatctctataaaaaaaaatttttaattacccatttggggtggcatgcatttgtagtcccagctacctagggggctgagcaagaggatcacttgagcccagcaattcaaagttacagtaagctatgatcacaccactgcagtctgggcaacaaacagagcaagattctgtctcttgaaaacaaaaaacagaaaacaaaaaacaaaaaaactttctgcactcttcaatacaataaaattaactacctatgtctatttgaccaaaattattaatgaatttaaatttaaatagcagtggatagctagtggctaccatatcaggttgtgcaggctctatactgtatgcagatggataattgaaagttatttaaattattctcagtaatttgaatatatataagtatgggacaaaaataattaaaccaccacatattaaaagagcccatgatgccaaattttctgtatttatcacatgaaaagaaattccaataatctccttaaatttcactgtacagatattgttcagaatgtataatatctttaaaacaaaaaggatatgttgatttttttttttttgagatagggtctcactctctgatgcccaggctggagtgcagtggcatgttcactacaacctccacctccagggttcaagagattctcccacctcagcctccaagaagctggaattacaggtgtcagccaccacatccagctaatttttgtattttttggtagagacggagtttcaccatgttggccaggctggtctcaaactcccgacctcaagtgatctctgtacctcagcctcccaaagtgctgggattacaggggtgagcaaccacgcgcaaccaatatgttgaaattgaactttatgctatgtatgcacaccaaaacattgaaacataatttatttaatgaataatggtaatgactggcatttattaagcatttataatgtacacaatactatttcaaatgaagtacatgtatcctgtttttcttcagtctcacaatagttaataaaatacatacacatattatccccattttacatctaagaaaacagaggagagaacaagttgcacaggtacgactcaaaatgcagtctgaattggagttttattatttatttatttttatttatttatttatttatttttgagatggagtctcactctgtcgcccagactggagtgcagtggcgcaatctgggctcatggcaacctctgcctcccaggttcaagcgattctcctgcctcagcctcccaggtagctgggattataggcacctgccaccacacccagctaatttttgtatttttagtagagacggggtttttttatgttggccaggctggtttctaactcctgacctcaggtgatccatggcctcccaaagtgctgggattacagacgtgagccaccgtgcccggccagaatcggagttttatactctaagcatgattctgtgaggctggacagagaaaaataaatcagaggaaactgtcttctgcctctcaataaaagacctttgttttaagagtctggttttcaagactcttaagggtggatacattgattaaatcataaacatttgaaagaaaattagaaaccatagccagagctaagaactctaaattttcatcttccatttggcccatgtcttgggccatccatcataatatgtttgtgaacatgtatttatatgtgtgcttgcatgtgtaaacatgcacatatatttgccaaatctttacgtatgatttttcttattgctcatctgtgtttttgatagatatacaactagccctttataatcataaacacaataaatattcaggacccttaagattagtcatgtaaaaccagaccccaggtactgaggataaagcatggaacaaagcaggaaaatcccatttccacagagctttcattccaggggatcaaagcaagtgtccaacaccattgcatattttctagctatgactaggtgtttttatgagtgaaataatgttatgatggatttgggcctctgcagggtattaaatctcttatttccttttgctagaatattacaaactgtaaataaatatttttgaacatgaaagtacaaaaatgttaagacaacactattatttagtatgcaaccattaagatgaaaatgaaaatacagaaactcctgtgtgttgggtgaataaatctaataataaagtaaaggtggaaaatttgaggaccaaattttacttggaatattcagatggaagaaaaaagaaacctgattattcaagtctaacatattaaaaaccatttaatgattaaaggagagacttgaagagaaatcatcccttactggcagtaattatgttaaaaacaggaccacaaaattattgcaaggaagaggttggcaggataaaatattttttgaagtaaaataatctgtggatcattacttctaatgacaataattagaagtatgaattcaatactacagaggtacatcaaatgtaaaggttgatataaataaatatgaattggccagtagacagaatttatttcatctgtattcctggagcatttctgtgtcagtaagtttattacctcaacagtaataagtatatcgacattaagaaatacaccaatatattttaaatatctactatgtgtcaggaattcccctatctcatagtcacacaagctatgtagtctgttcagtttgtgttttggggaccctgactttccttgtttgcattgtggaaactgaaataactgatcagttataaaagacctgttaaggtacagcacagtaataaaaaatacacatacacacatatatatttaatatcctcaagacagtcctaataagagaaatatcttctcagcacaattaatgaagtatacctttcagcaagaacattcagtaagtctatttggtgaaagaacatttctcccaaggttcaagtatctcattctcattgtacaattttctgttcttaattgattaacttcctgacagacattttccttttctatctaaaataagtacttggggcgtgactcaaatgcacagaaaacataaaatgacataatcctcctattgatattatagcttattgatatgtgtagcatcacagtgcaaattaaccattgcctcatcaaacaagcaatgggagagttggggaccaatgataaggcatctaatttttttcagagatagctgttactactctcaatctgaaatatcttctggacccttttataccgtcagcctcattctccttcatgatagctgccacctcactagcagtgtaattattttctggcttaaaatctcataatggctttccgatttcttctggataaaattcacaacttagcatgacaggcaaaactcttccccacctggccttggctacctctctcgcctcttctgcagaagcacaactggagtccaggccagatccagacctctcagtgctcctaacaagtctatcttcctccagtctcctaaggtccttggggctttgaccttgccaggccctctttcctcattccactccaggccatgcccgatacttacaaggtcatgagcatcatctgctctgggatgaacagaaatgacctttttgaactcctatcttagtttaagtgaatcatgaggatcccacattcccagtcatcttcagcctcaagctgcactttccagcctcctttttttttttttttctctgagatggagtctcgctctgtcgtgcaggctggagtgcagtggcgccatctcagctcactgcaactctgcctcccaggctcaagcaattctcctgcctcagcctcccgagtaactaggattacaggtgtgcaccaccacgcccagctgatttttgtatttttagtaaagacgggtttcactatgttggccaggctggtctcaaactcctgaccttgtgatccccccacctcagcctcccaaagtgctaggattacaagcatgaaccactgtgccaaggctccagcctctttttgtatacatttttgccaatactacttactaccatctgatatggtacacgtatttacttttctgtatgtctgcctctccccactagaatggaaacgggtttcattttctttctttttttttttttttttttgatggagtctcactctgttgcccaggctggagtgcagtggcgccatctcggctcactgcaagctccgcctcctgggttcacgccattctcccgcctcagcctcccgagtagctgggactacaggcgcctgccaccacatccggctaattttttgtatttttagtagagaccaggtttcaccgtgttagccaggatggtctcgatctcctgaccttgtgattcgcccaccttggcctcccaaagtgctgggattacaggcacgagccatcattttgctcactgatgtatccctaacaacttgaacagtaaatatcaatttataagtgatgaattttgaatctatgaatactgaatgtcttacagttcatacattgccctttgatgggacattaaaaaatttttgaatagaaatgtgtatgttgatttctctccttggaactcctttcacatcctttcccacccttacttactcccctctccaactttacctggataactccaatttacactggatgactcctgcaacggttcacctcctcttttcctctagttttatttgggctcctgtaggcacctcactcttttctccacatagtcagttcaaaagtggtttacaatatttattttattataatataactgaacacataattgttcatctttttgcttgactttaaaggatcctcagctttcctgtggaagttctagcatataatgagtttaaataaatagataggatgcatgaattaatgaatgaataaaataaattactaaatggcacacctatcaattgagtgcctattattatttaaagggggctaggaaaatcttctctttctttcttataaaacaattaggaagaaacaacaacaaaaactgttacgctgacctgcaacaagtaccagacattttctattacagatgcaacattttggacattgtgtagtccaacagaaacaaacagtatgagtgtttaaatgagttaatatactatattacgtcctattttaattactatattattaaagaaactaacagttactaataattgctgttgattgctatcttatatgtaaagaaaggtaatttctctgaaggcagttaattcagttaatgaatactaaatggttggagttggcatgggtggcgatggagaagggacagggatgctacaagggacaaatggtgtcttgtaaaagtaccagagtgccagggtttcttcccagttgcacactccaggtgtgccatcttattaatcattgaattcctagtatggaacacaccgcgtgctatttaattaagactgacactttagctgaggctttaaggaagcattgggttttcatgcgataagggcaaagaaacattatgtaagaaaactcagtcctgagtgagaaaagcaggtttaagtcacagcaaatagttggatatggggtgcatagggcagggagatggagcgaatagggctgtaggcagatgctatagcctacgtgacatggtgcttcatggccatggaactctgattttatcaccttcttcactgtgactctggatcctggagtctcataaaggttacttcaggtgggaatgaatgtctcaaaaggtggggatgactgcaactccatgtactcatgtatctccagcacccatgcccttcactaaagcaactctgctttagctagctttacatattgaggatttaagtttgcttgaaaaataagtttaattaaaaaatgctctgacagttgacagtgaaggcctgaaatttagaaacccaggagtaatataatcaggcttctgtttgaaagaacgttttggagatgggaagtcagggcctgctctgagagcctgctaattgatagtttatgatgaattaaactatgacactggcagaacgtttgggaagaagcagttacaatgagtactagagagtattttgtgattaactaaatatgggaagtgacgcagcggaaggtgggaggattccagtattttaggactgggaagtggatagattcttggatgctattcaccaaaatagaaggtaggaatagtagcaggtttgtgcagaatctaattaatgaactttcaaacacagttagtttggtatctaactgtttgaaagatttggacatccagacaaagtgttccatctaaaatacagtacgtaaatattatttgtgagctgtgtaggttgtgtggggagtaattgaggtacgttatgtctgacagtgccaatttgttatatgatgcaaaaaaagtcatgtgttgaaatgagaagacatttagataaactttaaaaagtttaaaaaatcaacataattgatctcggatacagtgccaataataaataatttttacattgttttaaaaaaactgaagaagtgttaaggtcatataaacatcgggtagtaggaatttatagtgacagatatctgcatatttattaaatttctcttaggttatgttgagtgttcaagttgtagggactgatatgggagatgacaattttgattgacggttgaggttgtgagcctcaaccatctttctgcaaccatgttgtagaaaaagaaagattccaactgattttaaaagtgtataaagaaggaaattaacaaatggtgggccccaaggatggaagcaatatcagaaattggtcattgaactggcagagacgagagattagagacctgacatttgcaatgacacagaagtggtatgaaaaagctggagagataatgcattagcgatatcttcaaaaatcaaaagtcaaatatggaaacagtagtagtgacatcatttttaaataggtgataagaggcacttatattacaacaaattatattacaaaaataagtcatcttcttcatgaaatgccaaatggatcattacatattacagtcaaacaaaacccagctatacatatgcatatgtataaatacatacaacctttatgcctatttataattatttttaaatttttattctataaaaactaaatgttttgcttttactatgtatcctgtaattgattatcattcagtagtgagcataattttttttccttttcagttttgttttttcttgagaagcccttattttttagttgctgtatagagtaaaagactacctactctattcctgctggaactgtggtaatgaaatatggtgaactataacagcataaaccaaaccagattgtagcccctctctgttcaaaagtctgttatttttcagccacaaaaacacctcgttatacattagataacagattattgcaaagcaagattctatgaatggaaaggcatttcttttgtcagtttctgagtcaaggctacttcagccttgaaaattttattgttgtctattgttccttcttcctcaggaaaaaaaaaaataactatcaaaggtgggtctgaaaaaaaaatagggttagatatagtcctggacaagacactatgtacttagttgtaaaatgtggaggccaagctttgaaaaggaatcagagtttaattaatcattgctgcatgaggactacatagcccatattcctttcatgtagtctgtgtagaatgcgtaattttcccaaattcaagtacaatctgtttttcctttttttttccattttgaaacctgatttgatttttacccctaataaatctggcatcttctattcagtagataatataggctattagaagaaaaggaagttttaggtttgaatttcttacaaaatcacctaatttatcagaattgttctctttcttccatatgtgatacagttatttagacagacaacattatccagaaatattttctcttctttctcaaaactcaaggacaatattgtatcttatagaattaaatacaggacaactttcttatttaattcaatttaaggtatgtgtgtgatacatttatagcatgcagcagagaacaaggaagttttaatttctagaatcattttaaaatgtccaacccaaaacactattaaactgtaatactacacattaagaatagatccactgaaactcattccgagaaaaacagcaagtgcggtgaggcctctcaattcatgattgaaagagaattatttaagaatctaaaaatattttctaagaagagaaaaatgatgataaacatattagtcaccatacatcttaaagggctatcatgtggaatatgtacacttgctttaaaaaagcttctatcaacatgtgattactttatgaaaaataagttacatcattaatagatgggaaggccagacgccatggctcatgcctgtaatctcagcacttcgggaggctgaggcgggcagattgcttgaggccaggcattcgagaccagcctggtcaacatggtaaaaccctatctctactaaaaatacaaaaattggctgggcattttggcatgctcctgtagttcccaactacttgggaggttggggcaggaggatctcttgaatccagaaggcagaggttgcagtgagccaagatcatgccactgcactcaagcctgagaccctgtgtcagaaagaaagaaagaacaaaagaacgaaagaatgaaagagagaaagagaaagaaataaagaagaaagaaataaagaagaaagaaagaaagaaagaaagaaaggaagaaagaaagaagggagagagggagggaaggagggaaggaaggaaggagggaaggaagaaaggaaggaaagaaggaaggaagaaaggaagggaagcagtacaacataaggcttaatattatggactcttcatcatattgtctaagtttcatttatggctcaaccatctatttcttaattacatgttcttgcatttttatttatcagaatgtccattattgaacttatctctataccaacacgtgtgtgtgtgtgtgtgtgtgtgtgtggtgtgtgaaatggagtctcgctctgttgccagcctggagtgcagtgatgcgatctcggcttactgcaacctctgcttcctgggttcaagtgattctcctgtttcagcctcccaagtagctgggattacaggcgcctgccaccatgcccggctaatttttttttttgtatttttagtagagacggggtttcaccatgttggccaggctggtctcaaactcctgaccttgtgatctgtccacctcagcctccgaaagtgctgggattacaggcatgatccaccgtgtccggcctctataccaacaattctatattctactttgtgatactagagctgggactcgctagacttgtggctctcctgggatccctgagctccttgcaggagatttttaaggtcaaaataattttcataacggtattaagatattatttgcttttcttactcttattctcttttgaatgtacagtgaagttttcaagaggctatatgacatatgatccagtaacagaaacatagcaccagatgtaatttacccagctgtcttccatgaagccaggcattaaagagatttgcaattatgcaaaacaatgctacccttcttactattttttgtttgtttttgaaaatagttatttttcataataatgggttattttttgttaacaggtagtggtttgattcttgttatttttggaatgtcccatctttaatatggcaaatatcaatagatatcatccacataaacataagttccttcaggtcttcaatttttaagagttcacagagtcctgtgatcaaagagtgagaaacactgctgaagacatttcttcattgccagtggattcctgttctatccatagagggcgctagagagagacgagaaggcacaggggttggggcggtggggtggggagtcgcgggagaaggggctggacccagcaagagaacctgctgctcctgttgaatctctgcagcgtttcagcccggtggcggtagcatgttgtctctacctgcagactctaaagcagtgtaggctctagtctctagctcatgtccacaccaacaaaagcacaatgagctccctgctaagcaatctgggacaggccacggtgatgcaccctcctcagaggtctgagttcctgggctatagactagtcttgaattccccagttaccagaggcagccaggaagtatcacttccacaaaagtccaagggctaggtttgctaggcaacccctcacctcagaatttcatcctagctccaaggaatcctttcctcagggcttctaggtggtgattactgccatctaagggcagcacatgtttccttgagtctatctacatcacctgtcttctctttttgctttttcaatcctttgaaacagcttaaccaattacactgttttacattgggtaatacagtgaaatctctgttttcttgactggagggagattgatacaacaggtattaatgtaagtatgcatctctaaaaagctacccataatgagagaatcaccatctctacggtgacacaaatttacagtatctaaaagaaaaatcaaatctctgttctgagcttacaaatctaaacatgtgaaagtatattggcaattagcaaaatagatattaaatattatacctttttagatatagttgctttgtgaccacattttcaaatactcagcaatctatacgtatctagttatttaacaagagcagttttccaaatttgatggaaatatgtcttcaaattattacctatacatagaattctaaagcaagtgatagataaggataaattatattttctctaattagctataattttactggaaacattttaaatgagtcacacaatcttattgtaaaagtctaaaccctgtaacaaaacaatttttatgcaaatcatcattcatcttttatgataactagatatttatttagcctttgaaatttgtactatataaatgtttaaagtaagtaaacttaccgcctgataggagagcaggcttactttttaccattggactagaatgaggaaacttgttgctaaatgacatgaaaaggtgtgcagtgaaatcatcaggaagctcggcttccaggaatgtcttcatgaatagtttgaaaccttcaaaatctattgtctggaaaaaaaaaatgtaaacatgtattttaagatccaaccaaatgttaaaattctgtgctgtgttcaaaatcattagaagtagaaatgacctcaaaccatttttatatccaagtttaacaaatggaaagtgcctatttgagaaatagggtgggccgtcctgggctaacactggcaatgggatatgtttgtcttacctgtgatggcatagcaggaagaggaagaagtttctagttagatatttctatttccacagtatctgtaatgccttgaaaaatgtactgtttgaaacttagtttgctcctctctaaactgggaataataatcccaccccacatagttgttgcagtgattaaatcaggcgatcactgtgaacaagccaatacagagtcatataaacacagcaggcactcagagagaaaggaattttccatattttttgcttgtcactaatggtgattatcgcttttgacaatgtaaaaagaggttaaccttaatgtttcaactaaatgccaagctctattgataaacctaaaacttcatacgcagactttccaaagaaacatattttaagatcttactctctgatactcattgcagaactatataaatgattagacatttatttggagagaattgtggtggtgttaaggttctccatgcccattagcggaaatggtgatggaagacaacttccaacctcaagcttaatgagagcgtttcacaggagccatagtgaagagcttggtttctccttgcagatgaaggcagtgcaccaggatttgactctgcctaggaaattgaggacaagcacatgggtgctttggggacaaaggcaagaaaatggtactattttaagttggccaaaactcctcgttttggactgcaggaacaatggtgcatgagtattttctgggaaacagatgtagaccacatggaggagaaggccagtggagtggtcttgggttctatccagtagggcatttgaaaggactagaagacctacagagaagaggctggaataaagccacatatgtccagatcaagagagtgcaagggatgggctttataggtagcccttgaaggccaatttttttttttttttttttttttttttttacccagtttaatgtgctgagatgcaagaggaaatttggctggctgatgctcttagttttgttcacattgctggcaggtaagaataaaattaactttggaatagaaagtttgtttttcctatgtaataatactgggggaaagacatggagattgaccgaatttattattgtattatttgggacaaacctaatattaaatgtgacattcaggaatatcattagacatagtaaatttttatagatttgatcatgtgccaattaagtttacatacgatgtttgctttttacctaatagaatctcaggcaataaaaccaaacactttatttatcaatagtcccaagattctgcctataccttaatctaacttttttatttagtttcactttgcttattgattctcacaaggacacttcagatatttattttgctggcagtaaaaagacttcattttcttctatatttcataaattactaccaccaccatagaatattgtcaattctagcccgggaggtggaggttgcagtcagctgagattgtgccactacactccggcctggcgatagagtgagactccgtctcaaaaaaaaaaaaaaaaagaatattgtcaattctagtagtagagtgaactatataactaaaaactctgagtaatataaaaaatgtgaagaatagcctcaggtaggagaagtacttccaaaaaagcaatttgctacaatgaattcagccaacacttaaaaacatggcgattaggccaacagtcagacatgggatccaaatagtttccttgaaaaggaacacctactcttactaagagagctccttagagatgacctattaaagagaagtattccacattcatttgggtgagtgaccaaaattgatagctaatcttcaacatgtatgaaggcccatgaggaaccaggagttgattttattgcaaagttgcaggaagtctgtgggatgaaaatattcacaagcattgtggttagaagcaaagttacttatggtagcgcttccttctgttcctaggtcttccataatcagtattttgtttagcaacataacagatgataaggggcatggtctttgaagtcagactacctggatcaactcttgaatccaacacaagctgtgtcactgtggacaatttaagctctctgtgcctcaatttcttcatctataaaattagaataatagcacctacttcttgatttgttaggaggaacatattatttactatttttaaagcatctgaatgacatctggcacatagtaaacattgtatgtaattaaataaatttttgtgtaaagaatatccattttaaaaattcataatttgaaacaatatttgaagaagaagcctcaaagccacattacttcacatgttttcatatgcatttaacaaaccatgcatggttcattgttgtccttgttgctgctttaaaagctggtaataaaatgtgaacttccagaagtagtaaaggactagaaattggtgaaagtttttctctggatctgcttttggaccataattataccttaaaacagctctttcaagccaagactttaacttggtaacataacaaacaaacaaaacaaacaaaaacaaagagttcagaataaagcaattgtgtttcaaattctaatacttccactcaccacctaactgataaggggcaaagaatttatctgctcttttgaaggaaaaatatgccaagtcccaagtgtatgctctttacagagcctttcagaacccatgtcgatgctcattaaaatcgctgcctgtaatttaacgatgaaagccagaaaaataaccaaccaaaaggaaaaatgaactttaatatctaacgatagaggcaggacacagacaaatgtctaggcaggtaagggaaggtccccggagaacctccaacctgcccaggtcactgtgcacaggaggcctgtctaaacacgcccatggtgaaaaattctgtcccataacacatgctcagtaagggaaataaatcagtgtggggtggctcagactaagggctcacatgtgcactggaaaaatggggtggagctaccagaaattcatgctctatgcaggggagaatcttggcctcttcagctcatgtgtggtggcctggtattcaatttgtgaggtggaaacccgaatgcaggaccctctctttgttgagagctttcctttctcttaataacttccaccctctttacccttcaatgtgtccgcatgtttaatttttcctgatcatgagacaagcacccagatttagctgaattaagaagcaaaaattcctgcatcatttgatggcctatatggggatatgaggaagagcgagtaaaatgcgaacccaagaatctctttcactttcgtttctgggccttccagtcctcagactttttctgaaggcagaggaaactgcaccccttgcgtcactcttgggtttgggaatgtcggcctcagtccaacccagtctttgctatggcatttttcttcttttttttcccaggactgtaatggcacctatcttttcttttacaatatcaggagtgttccaccccaaccccaactgctgccacataggatagatgcggaagtggtggctccctgccctcccccacgttcccgccgtgctggggcacatggccgtgtgtctgcgtgtctgctgtatgtactttcggcatccaacagccatgcagggcgggactgagccgcagctgctgcccaggccccagggcaatcttgggggctagaggccccgtgcagacagctggccagcgttccccgccatgcatccatacagtcttcccctcccttggccaaggagtccagctcagtgggacaacaattaagtttctctctgtttgcataagaacaagaggtttcttccccaggcatttccctgccctacgcttaagccttttttttttttttttctccacaaggtcaggagttgatggattggtgtgaaggtagttacagtttttgctattacctagattggcagggaccacagttgattttgcaccaacctagtaacacagccctgtgagtacagggggcttctcaatgccagaggatttttcttgaaaagtgttttattaggccaggactccaattcacaggacacccttttctctcccttgtttgagaggacccaattttagagcttcaccttagcatttggcttatgacaaggaggcaattcttttgtcccaaactcaattccaagctttgggttgaagccctaggaaagaaaactggatcttagggatccagaggcagacaacaatggaagttaaaaggcaaacaccacagatgagcatgactaattcctgctgattaagccaagcctcccatatcatggatagaggtcatactagtatccatggcataaattaggtgtagggaactcaaaggctacttatagcagggggaaaggcagtgagtgcacggggaagtgcggataatcccaccccctaggcccaactgttaacatgagtgaaagctgcattgacacccatgggtggcaccctgttgtggtcaccaggcctcagggatataaggataaaagaaggaaagaggaagctttttccttctctctctcatgtaccctgggcattcgataggaagagaaaggaaccagggatgccttgctcctctttctagatgagtagccattcgtcttcagtctgtgcaccttacagatgcattctgagctggggggctcctttgaaaaaaatgccttctttgtcccccttggtcctctcttcacagatggttaatcctgtctccatactacaggacactcctctcggatgcatccttcaaactgtgaaaagtttatttctcaacccttaaactggttggcttagaattgagctcaggggaggggaacccagaaggctgacatgctggcaaagagataaaatattttttaacagtcagacttttggcctccctctccctgtgcaaaccagtaaaaggaatggtagggatatattctccgtaaagttttgattaatcaaaaagtatttatgaggttggtctcaagctgtagccaatctgttgtgctctgcatgtctttctatatggttctgtcagaaagaggagtaccttaggatgggataaggacctaggaccccatagcccactattcaagtcagcctggcaaactgcctagtatgttgtttttgtctccgctattttacggtggcagcctgggatcaatcctggcttagggaatgagtagtttctggcaaatacctgtgtgacttctaccatttgctgattctctcctgctccatgaacagcttctagctttcttttgtgaatcttcctttctctgagctacacttagacgttctagtttttgtaaaaactgcttaccacccctttgaaaataccttgtatactcgcagttaaatcataactttttggggcttgttggtttcacctgtaaggttactgttggtaaagttcaaaagccagaaatatgagtcatctggcatggctaaagttgggtagctagggatttaaaaggattttcttaaagaacgctcaagttaattaaaagtggatatccaagctataggtatatttaaaagacctttatgtttttttcttcatggatcttgtttttctgagaaaggttttttccccagtcaactgaattgtcttcctccattttatcttgccactcttaatgaactcatgagagaccctaagataatttctgatgaacagagactacttgggaaaaatggaaaagatataatgtattccatttttggagaaacctctgttttcctcatggaaccccagtaattagaggcagatagatccctttcaaaatctgtttttgtcttccacctgtatctgcttattaggtactgttacctctgtttcttgaagggctccaccctcaggccaattatccaattaggagattggcaaatgaaaaatcttacaactactggatcttcttctgtctgtctatgtagttatatatgtgatttttatataaaagcactctaattaattggcctaaagaaaaataagcattagatcaaatattttttcaaggaaaatacaagctgtagtaacttttagttcatgtagctttaatctttgagaaataaaaagtcttaaagattattggtaaaattcaaatgtcattaaaatttaaataggtggtctacattatggaagtcagatactaggttcgctaaatgttttaaggttgtaaactgcttctttggccttagagaactgttcaacttgcctgctttacaacttggtaaggcctgaggacatactgaattaaccaagcccttgaacaggctagaaggaatcaaactttattggtgcctagtacataattaaaacaacttatcagattttacattaaagtttaaaattgctaagagttaccattataacatgtaattgagaccaccactgaaaatagattgacatgcaaggtgtgtaagaagagtaaaatgtgttttcaggaaaagattgtaagaaggcatggaaatccaagtaactttttgcctagggttaaaggattgttttaaattagataaggtcaagctaaaggtttaaatagttgtggaaggtttctaaatttaatattgcaaaagaaatcctgtgtatgaacattgactaaactcaaaggatattatatgtttttttctgtaaactgagcaatgaaataaaagcacaacaaggttttcttaaggtactaatctgttctttagcaaaatgtgtaaagggttataaaaggtttttaagaatcttacctcatggtccaactggcttagattggatagaattgtctataaggtttcattagaaaattgggattaatagtaaactaatgtaagggtaaaatttggctctctctctcccttgttgaagatttctatgtaatattaatgaataatgaaagattttcatgtgccttgtaaatagactgccaaggaaaagaaagagaagacaggagacaaactgtttggaaagctaagtccttcctcttgatgagtaaaggttttccctattttaaaatttttgagtcatcattttaacaaaataaccaactgggattgtatttcaaattatcaagtgttttaaacctctaacatttaacaggcttccccaaatcaaatttcagcttcaaggttgtctttcctgacccctagcttttggatgctacagagggtccctagagcatctagaagaagagaggtaaacagaataatttaacatggttaggtacatgggatctccaaaatgatgtttaattttcttcaggttatattttagtgaataatgctaacatatgttccagaattttatgggatttctaaaattctaatgtttgagtgtatgctatcaatcacaattaaggttgttatattaagttattgtaagccacagagataaccacattttgtcaatcacatttctgactgtaactaccctggtcattttgttattcataaacaattgtcttcttttgatccccttcaaaagatggttaataatcagctataaaagtttgatgggtgttctccaatacaagtttctgataactttggagactctaacactggactaaagggaaaacgtacaggactcatgaaagagctgaaacattcacgaatatcaagcagagcatgagttaactgaatggactgaactaatagaaaactgaagtaatctttttttaaaaccttttgcttgaaacattgctggtccttgttttgttattcagagtcaagaaaacttttattttgagctatttacagtctttaataattgagtaagctatactcatgtgaacaaaatttggagcatacttctttctctttgcctggttcttctagaatttggaaactatctgtgagtattcttaacttatggcaatatggttatttgcatcagtgcaataggaattcattttctctggcaacagtacacagttggagagatgggttgttttaccaaggctttgactggagaggtgtacttccttttaaggaatcaagcttgagttgcagagtcaataaaagccccttgggaaaactggcctcataccttgtctacacagtcctcatacagggttcctaatctgtaatgagtaaagaatgtcactttctaatgggcccaggaactctatattctaggaacctcaagaagagaggaattcacccaattcataggtatttgagggtgctaacccatggctgggctgggctttccaaagtcctatctgagattccttatggaacagaattccatcaaaagcaattttaaaagtgtatgtaagaataattattcttgctgcactttatgcaaactgtcaggccaagtataagactgaagtctattttgcaaacaactcagtcctatcatgaattgtttttaacaaaaatgaggactggggagataaaaattatgtttcaaaacttaccacacatttgtcattaaattctagtctcattagttgttttgaatttttttttgcctacattttacattaaccctcttattcctgtgaaccaaccagcaatttctggctacaactcagaagaaacaaaaggcatgggtaatgtaataatctggatcaatattttaattctgagcagttatcctgctaatcctgacatctgataggagtaaatagggtgcccataacccagaggttcctctgggaaaataagaccaaaggagcaaaccaaagccaagccccatgcaaccaatcttagcaggcataattatagccaccagttatctgggcatgctgacagccttgggatttttcagctgcccttacccatccctctttgtttggttttaatatatgtcttctaataactccgtttgtctcttctcaccttcaggccatcaaactccaagcgatcatgcaaccagagtctcaaacaatggccccttttaacagagacccttaaataggctttcgagagagttatgactgccatatttccaaaacagtgccccctaagagcaggaagcagttaagatcagtcttcgtccctattctaactgcagtacctcttgtgtaccactttagagggaagaataatagaagtaggaggcaaatgcctaggcagataaaggagggtccacagagaacctctgacccactcaggttattgagcacaggggggcttgcctaagcatggtcacagagaaaaattctgtcccttaacacatgctcagtagggaaataaatcaatgtgtagtggctcagactaagggcccacatgtgcactggaatgattgggcagagccaccaaaaatttgtgctttatgcaggggaggagcctgacctcttcagctcatgtgtggtggcctggtattcaatttgtgaggtgaaaacctgtgtgcaggacccctctcttttctgagcactttcctttcacttaataaattctgccctcctcagccttcaatgtgtcgcatgcttaatttttcctggtcatgagacaagaacctggatttagctgaactaaggagcaaaaattcctgcatcactggcatttctcctaataagcaacacatttcttcttgactcttcttttttcagcatgcaggaaaactttctgaaatttctaaagtatagttctctctggctcagcaagcaaaatactgttttattttctgacagctctaagccttaattccctctatataaagtggtatatgaaatcattcattcaggctgggcatgctagctcatgcctggcactttgggaggctgaggcaggcagatcacctgaggtcaggagttcaagaccagcctggccaatgtggcaaaaccccgtctctactaaaaataaaaaaattagcatggtggcatgtgcctattgtcacagctacttgggtggttgagacaggagaatcacttgaaccttggaggcagaggttgcagtgagctgagatcacaccactgcactctagcctgggtgtcagagtgagactccatatacaaaaaaaaggaatcaatcattcagagttgtcccaatatgataaaaattgatgtaaagcacttagcatacacttgggcacataatatataaaataaataaaaggattaggttaaaggaagaactgtcctcagcttagatacatttttaagttactttaattttcctttttttatttttttgagacaaagtcttgctcttccccaccccatgctggagtgcaatggcgtgatcttggctcactgcaacttccgcctcctgggttcaagcaattctactgcctcagcctcccgaatagttgggatcataggtgctcacaaccacgcccagctaatttttgtatttttagtagagacagggtttcaccatgtgggccaggctggtcatgaactcctaacctcaggtgatccatctgcctcggcctcccaaaatactgggattacaggtgtgagccaccatgcccagccaatttgcctttttattggtacagaaaactgtaaaattcattgcatctttctgaataaaaacttcaggttttgtgtgtctcaaatactttgctataacatttctgtgtcagataacagagacaaataacaacttttataaggcaataattctaaaaaaaaaatcttcctttgaaaaataaaagcctattacagatataagaatggagtaaaaatttcctcaattcttaaattatttctacaagatgacatcacattatttattgctgaagtgttactgacaatgtaagcttgtttctcaaacttcttcactgtgttctttggagcaaaattaatttatctcacattttctggcattagatagggcttgcaatgtgggaaaacacaaacctctttttttttttttttttttcctaagagaaggtctctctctgttgctcagattggagtactgtggcccaatcatagctcactgcagcctcaatctcccagactcaagcaatccttccacctcatcctccccagtatctgggaccacaggattgtgccaccatgcctggctaatagtttttttttttaattttctaactcagagttttcaattcattgagaaatgtttcttcaatgtgtttcctggttaacccgtcccttttcttctcttgttagtaaaatcttttcaaatatctcctaaaattctatgttgtccacattattagacatttctgataaatggatgatatcttcatctgtacattttccttagatcatgacttacaagaaaatttccaaatttaggcatcagagtttctattgctgtcatgtaacagcattagaattgctttttgaagactgtgacctttaaatagaatgagatcatttatatgcatatcaatgaagccattaatgatacaaattgggtcagacttaactgaatgactattcaaaaattgaattgctgtgggctcaaacacatccacgcgcacgcacacacacacacacacacacaaatgttcaaaattttaaaaactgctttctcatttttttccttaaggaacagccacagactatttagggagataacagagaatttgtaaagaagactgactgagggagctgctcagatgtcgctgccaaattggcacagattcaaggcacatttctatatgcctttcattattatttctgaccatctggatcctttgtttttaaatccctgttaatactaaagagaagacactagtattcatccatgcagattcaaagtgaatgaaaataaatgtcatcactctatccttaatttcttttggtagttttgggttgtagattttctcatattcagaaagtgttctttgagcacccactctgcaccaggctctgttctaggtgtttgggtaaagatgttactagaacacacaaaattccttccatgagggagcttatcttctaatgaaaggaataagaacaacattaatgtgctcaatctacaatgtctaatggtattaaatgctatagaaaaaaaataaagaagaaaaagatttcttgggggaatgtgcttgcagttttttaaatccaattatcaggaaatgagaagctattctttgagtaaagatttaaaggtgatgaggcacatatttgcacatatttggagaaagcacatttcaggcagagaagacagctagtacaatggccctgaggtataatgatgcccctgtgctagagaaatttccactggagccagtgaggaggagcaggaaattggagcaggagtgagggaggaccagagtagtagaatacaaggtcaaagactcaagctgtggcaatgtgtggactgggcagagcatacaggatattagatcatcaaaagagagttatagctttaatgtggagtgagtttttagtaggaaattccatgatctgactcatattttaacagaaccatgtgaccattataacacttatttgtatcagacaaaagatagcctatcatcagtttttatgtttttctaactagctcaccactaattaataagtgactcctaaaacacaaaaatgaatcattcaactattatagataaagcaactgtttgaaaccacaaagaaatcactttatctatcaaccaatgttgactgagtacctatatgtgtaaaatactatgcgcttactgggcaaagaactctgatgaaattaactagataataatttaaattaatcagagttttttttacagttccatttctatttcgcattctaatttatatcattaactaattatatcaaactcaaaaattgatatgaaggtcactgagcaaaagtatattgattaaatatgcagcatggctatcttactgagatttcaaaatacaattttttatgttaaaattcacttagaaaaatttatattttaaatattgcatttcttatgcttatcttgcactgcaattgactattcattatttcaaatttcagagagttccttgatagtcccctaaagctgtcatatagatagttcctttgaagagaaagagtacaaagtgtgaaaaccttgaattttaatttttaaattagttttggcaaatgaaaactattttagcacttcagagtcacatactccattaactctacctttacctaagactagaattatgaagactcagtagaaagacaattagaaatatattattttagtaaaaaataggaaatggccgaaagataatgctactacattctactaattacaaaaagcaaataatggattcgaaaaagtttaagcagaatatttttactatgatttcagtatgtcttttaatcaaggatctatagctaactgttttattcttcagctgaaatctattttaatctggtgtgacactgtcttgtcacaccaaacattttttggtgttgtcactaggacaggagtgagtgttactgaaacacacacataaatcctctaacattttctccttgaaaaataaaacccaataaaaatgtcttggaaacctttgtatatataatttcaattaataagatcagtttttaattattccttacttgtatgttcacttttaaagaaaatctccacagggggtttttataatgcacatatgagcagacagattccatgcaaaacttctctttcctgaagggctatatgatccaacacgactttgcatcactaagtgtatgacacagtcttttaccttacaggtcctcattatgtaacactatccaaatgttactatgttttaggaactgcactaaatatgttatatgtgtgctatcatttagtcatcacaaaacctatggacaaagaaactaaggctcagaaaagttccttaaattgcccaacaccacaagcttctaattgacactgaagacataaatatttctagcttcaatgcacattatgttatagttaaagcataattttctaaacagattttgcaatattaacacatggtataaggtaatttcccactggtttatcagtattagatgcatttgctgctgtgtcaaattggtctgccgtttgagaaaaaaaagatatacacaaataaggtataacaattaaaagtaatggtacgattattcagtttcccactcttgaaaacgttgtgttgactgtaactgtttttgtaaccttcgatgttcaaagtacaacctattactttgggtcgtatacctgaaatgtgttcaaatctgcccgcctccatctccattctgatgcccattgtcatctagtgttcttacttgattggactgcttccataactcatatctagtcttctcttctacccaagtccatgccccacattgctactggaggtatttttctaaatagagaatttaacttgttcacctaaaaatatgatttataatttctttcacctataaaacttaaaattcgtagacattctaagcctttttaccaaaatgtctagatttatattcctttagtaccctgcagtgttctttcccttgaaaaagctatttctatttctttttttttttttttttttttttctgagacagagtctcactctgttgttgcccaggctggagtgcaatggcgcgatctcggttcactgcaacctccacctcctgggttcaagtgattctcctgcctcagcctcccaagtatctgagactacaggcgctcactccctcacccagctaatttttgtatttttagtggagtcagtattttaccatgttggccaggctggcaggctggtttcaaactcctgacccccaaatgactggcccacgttggcctcccaaagtgctgggattacaggtgtgagccaccatacctggccaaaaaagccatttctaatgatgaaaaagcacaagtaaaaacaacagataaaccctaaaaataaaacttagatgtgacagagtaatgttggttttaacttatacttggaaaagtacaaaaagatcacctaaaaaccccagcattagtttttaacttctatatcaattgtttaataaatgttattaaagaaatgaaagaacaaacattctacagtgtgaatttaaataccacttttcaaagttggaatttatcattaaactaaggagagttacttgtttatttatttcccaaatgtatttatgcttgatttcaaaacttgtttgtaaagaaagcaattgatcacaattggtataattgtattttataattgtaggtagatttgataagaagaggaacatcactgaaactatattgatggtaatagtgaagagaagcagaaatactggttaacatactatttctgttccttgctaactaactgtgctagcaccatgcagttgtaggaagtgaagcaatacaacagacaatagctctgctatcagaacagcactcaggattgtggccaggtttgggaggggaagcaaattacacgtcatgttccccactcctaccacatggtggaaggaaattacttttgaatgcagaagacatcagagttatagttcctcaatttaaaatgagaaaatgaggtcctgagaaaataaaggaaatagaatttgttggtggtatatctccaatattctcactttcatctttggcatgttctctagaacttttctatgaaatcacattggtcattaaagtatgaccacagccactgtctctaaacattagtggaacaccttttatgtgcaagacacagagctatttattatacatacattttagaacctaacccttttaacagtccaataaggctgatgctctcttccttttataagtgaacaaactaaagatagaaaacttgtccaagatccgttaagatgaattcggttcagtcagactcctcagaccatattttctctgttatactttccttatcctttccataatggaaagggttgaatttggttctagaaggataattatagattacagtaaaaaggtttttatatcattgttaataattatatcagtgtcattatccttgttaaagacatttaaaatattactttaggcagcagcactacaaaaggtaggttttgaatccccaggttccttattaagggtaaaagcatattgtctgaatgcaaagggtatacacattaaaagaaactacaatacagagtacaaagtgcgaaaataaagcaagcccctgtggagttatgaaagcgtaactcagcctcaggccaaggaacatctactgacaggaaacatgtacggaggaaatcctacactcagagaacactgatagacaaagagcacacatagagcagtaatatgtgcaggctgtcattcttctccccttgaacaccctcagttttgtcaattctttctattctgtaactgcaattgcttgcctactaagccactgcacatgaaacaaagactgggcaaggaaaaggaaggaagaaactcactctgctgactctccaaaaagctagagcttattttgacatgaattttcagacagcctctagtaaggatgtaggttgtggagaaaggtgtgtttgttgggtgctcaacaaaagtcatttaatagccgagtcctgaaaatgtagacattcttgaatgactacattagagtaaatgaaaacaaatcatttactccaagggattgcctcttaagtgtcataaagcctatttagtccatatttggggaaacaagtttccagaaaagtcagagatgaaatcaggaaaaggccatgctctgaaatggaggctagtaaatctcgccacagtcaatgagttgccatgttaccaatgtctctttatagaatattgtaagatgtaggatctgtatctaagtccaccagtatcattctgatgttataattgtactttacgtgttggacatgaaattacagtggctgttgtcattaaaagcatcaaacaatttaagaataagaagaagctagtacatatccaagattgcccaaaggagacaatattacggttttagataactcatacattttagcaagaaatatttctacagtggcgaagacaattgatatagctactctagtgtgattaaaaatgtccatttagagcacctgaaaatgtgttgtaattctgtgcacccaactgaactactgttctaaaacttaatttacaaaacagattttcagggagagtggttgaagcaacagattgaataatcttcccaggagggcaaaatcaacaactctttgcttatgtttcccccacatattctatcacagcactgtagacaaaacaaaacaaaacaaaacaaaacaaagccttatcattgcattttaaatgcaattttaaaatttcccatggtaaattaataaattaagacttttactaaataaaatataatagcacagccttatatatcttcatgaaattagaaaaataaattccagagtctacaaaactgaaggccacacttgagaccctttttgtctattaaggtaccagctcctattaaggcacgaaatcctttgatggattaaaaattttgtcacatccagcttagttataacctatgagtattataggcaaccttgtatactatagaaatcatattggtacagaagtatagttcagtgatatggatgagaaattcatagatcatatcagaataaagaaagaaaagacagactttaatagaaaagaaaatgtcttacttggttaagaatgtcttgtttctgtgcatgcaaggaaagaaagaatacatgtgttaatgtaagatactttatactcattatctcatatctctgattatttagctaaaagttcaagtttacaggttgattttaaaacacaccctagatccataggcctcaaaaggtggttccgaaacagtggcatcagcataagttagaaaactgatagaaatgcaaattcttgacccccacctcagaaacactgaatctaaaactgcgtggggtcggggggaggcaggcagcaatccatgttttgacaagccccccggttgattctgaggtacactaaaatttcagaatcaatgactagatcaatctttgtatataataagcaaactgttctgacattagataaatataatatgtaacacatacagtgtgattaaaatattttagaggattaacagaaatataaccatctatataaaggtatattagattttgaatatgtatttcccattcctaagatatccttctattagcgtcacgcctagcatctctccatactcttaaagattaaaatatatttctatacacatctgccactttcttcccatatctcagctgtgagtggaacaatttggaattgaacttgaagtccaagatcaaaagaaaaaaaaaatgtgtggaatgctaaactggtttcccctcatactaccaaattctactgctctcaggagactatttacatggcctgactatgttttactgagaataacctcactgaaactggatctctgctacaaactagctgtaataacgttcttaacattatattatttacacaagagtaggtggaggctaataagactctctccccttgtcaggcatgagtcattaatatgtatgtgtactgggaagtgccacactcactacaaaagcaatgtcttcccatgccttcccctaacctttctccttcctatctaagaggatgttcctctcccctatggcttggtcaatgaagtgaagagcacagggcattagccttaaactgggattctagtcaattaggtttttgttgtggttactgtcacaagctagctggtgaatcttggacaaatcatttcacttttcttaaaatagtttctttatttaaaaactttgtaattttattaatttgggaatctcaagacctttgaatggtttttattcctacagaatctttaaggctattgtttagatttctcttattcatttcttcaaggaatgattatcaaatgatctttaaaagatgggaattaaaagtaaatgattcattcacatattatacttaatattttttctctattaaaatagacttcaacaggtcatatctttttgggttaaatttttatccccagcactttaaaacttcagtaattcaagtgaattataagcaaaatagtacatctacgatttaaacagctttatgttgtaggaggataagcaatttaatttttgcaaatacattttatgtaaatgatacaagctatgttccttttagaaaacgatgaattaattattcattccaaattcaggttgcattactcaattgtccattttttcttgtataattcagcatcattaactagtcatcagtgcaaacaactttggggtcaacttgaccagccaatgcagagtgataacttcacatgtgaattgacattaggaattctgccatattgtaagagtaattttttataaattggatgaggtcatgtattgaagagaactttaagggcataaagatttatttctcatcattagatattcttaattattttcaattggcttttagaagatacatactagttttttaaatggttatataagccttaaaattttcttccgaaggaaaaattttatgaaaattaactaagatcagagagtggttttgctcttaatttagaattgttcttgggttgtaatgagatctaactttttgtttttcaactgttcgttattttaataacatgtttcaacaatagatctgtacatttatgaaatgtattacattgttgaaaagggtgatatgtgtgtctaataatgatctaataactacctcaaaaaatgcagcatatggtgactgataattctcatgaaatatataattacagtaagactaagtcttgagagtcctataaataaaaaataattgaagcaaaaaggctgctttgcaaacaagatcacttaactgagtttgtagccagcagctatcattatggagaaaaacaggttttatctctgtatatagattagataagcatgtaagttttcaaatattgttgtgaatataaatattaatgacaatttttgtgtcttatagcaattcagtgctataattcatctttacgtttcccaccctgctttcttaggctttgagattctcagttttgtaagtttagctgctaatttttttttcctcctcctctatggcatctagaaaaatacaagggaaatgtaggtcaaacatctattttttttctaatacagaaaaagggaacggctttaaatagcctttattttctccatcatttataggcaccaaatattaattttattttttaagaagaaaataaattccaggctaaagagttttaaaagttacagtaatgtaccagaatgtagagagaataagaaaatatgacatgaaaaatagctaactacgagaaatactgataggaaatttcaaaacaatttgaatatcttgagggttatgataactaaaattaagttctagaaatcccagggaagtacaatattgaaagataactaagaagtgtgctcttgcaaacatacaaaaaaaaaacaataatagcaaaaaataagtcacattttagtcagcaaacaaatctatctagttaatacatcctgacaaaagggtcttttgcaaagagaagtatgaagcaacgtaaatgttgccttctgaagctgcaaatgaactaacagtaatgatgatcgaacatttaaaatgtaacatctctcaactaatattaaataggttatttaacaagcaattaggaaggaaaaggcattcattccagcatggtattcaaaagcaattgacaagacatgcaaagttttcataagaaaatcttaaagaaatcttaagcttactggtaaaaggtaaaatagaagattaaaaaaattcctccctttttgtacaagttggttccttaaggtgacggaccaggtataagcaacacaaaatccttctttggtcaaggaaataattgcctgaaaggggtaactccctacccctacaccaatatccattttggattgaaattcgtgggtcatagactgagagccaagcatactccttctctattttatccaatgctgtttcctgacttctaggaaaagaaccaacgctacacttaaatgattcatattctttcaagcatacaatatagaagagttatttgaacgaaaaatgtacaacatttaatatatcttctagaatagcactgcattatgaacttcattttgtttatgttatgatacatggtaaatggtttatggtgtgcatatatatatatatacacacacatacacatatacatacatctgtatcatacatatataatgtatatgtgtacatatacatacacacacacacacatacatttttccaagaattgtttattaagaaataccctcttccaagcatatatacgaaactgatataaagaaaaagaagttttaccccttcaggattatactttgcaagcacaccattaccatggaattcttcaagaacatcctttaatttctttgtagaatctataaaaaacagaaaacacaaaaattgtttatatgcacatactgtggttgtgtagcccagtccagaaacagagaccacttaaaatgtaaataagcatcagcagaaactaaatttaaaaaccaacacataaaatatctcttgccatttttgaaaggctatttaattggaaaagaaattgcaaaggagcaaaaagatcactgcattaaataaaaacaatacagctggataagaaaaatatgggtagctaagcctcaatggtgaatccatttagagggacgctatagattttagtatctgtagatatttttaaggagaattttctctgtatacataacacaactaaactaaagcctactttagtaattaaagttttagtaagtaagctttaatttagttgtgtcacatattttaccctatatatgcattacgaataacattttagttttgttatgtataaattaaagcttaccctattcaatgaagaaacaaagcttagacatattaccaaaagaattataaattattttcttcaaaagtactattatttttaaacctttcatcttattagttggtgacaagaaattttaagttaataaaataatgtcataaaagaattatcagtattacaattaaagttaaatacattaatatgatatagatatatacattcagtctactaaaatatgctcattatacttattgaaatataatttttgatttagaaatctcagaattacaacgcatttttaagttagaaggaaataatagctaacaaatatgggtaagtcatctaaatatttaatcaagtttgaataataatgaaaaaacctcaaaattaaaatgtaggaaatacatggatttcccagttttcttttatggaacagagcatggaaaattattggctaccaattgaatataattcttgttgaccttccctaagagtcagtgatacttggactaccacaaaatatttcccagttccagaaaactaattcacaaattagcttttgaaacatcctgctagaaaactctctcatagatgcccattgaatatataatgcctatattttgtgaattgtacttttacttggaatgtaccatttcctttctttatattgtaaattctgtgggtttgtgtatgtgtgtgaaacaatagatagatagatagatagatagatagatagatagatagatagatagatacatagatagatagagtttcgctcttgttacccaggctggagtgcaatggcacagtcttggctcactgcaacctccatctcctgggttcaaccggttctcctgcctcagcctcccaagtagctgggattacaggggcttaccaccatgcctggctaatttttataattttagtagagacagggtttcaccacgttggccaggctggtgtcgaacccctgacctcaggtgatccactcaccttagccacccaaagaactgggattacaggcatgagccaccgtgctcagcctgtgaaacagtacttttaagtgagataaaattcgtgtcacataaaattgacattaacaatttcaaagtgtacaattcagtaatttttagcatattcatgatgttgtgcaatcattacctctgattaatcccataacattttcatcaccctgtaaagaaaccttatgcccattaaacagtcactccctgtattttctcccctctaacctctggctatcattagcctattttctgtgtctatggatttgcctattctggatatttcatgtaaattgaatcatataatatgtttcctttgtgtctggcttctttcacttagcttagtgttttcaaggtttttccatgttataacatgtatcagtacttcactcctttttatagctgaataatattccattataatgaatatactccatttaataaatctatttatcagctgatgtacattcaacttgtttccaggttttggctgttaggaattctgctatgaacattcaagtgtacacgtttttgtataaacatataattcaattctcttggctatatacctgatagtaaaattgccagatcatacagtaactctatgtttagtgttttgaggaactgccaaattgattttcacaacagctacaccattttacactcccaccagtaaggtgtaaggattccagtctctctatatccttgccaaaacttgttattttctaaccctttttttgttacagccatcctagtggatgtgaaatgattcgactcacatctgattagtcattcgctaatgactaataatgctgagcatctttttatatgcctattggtcgtttgtatattctttggcaaaatgtctattcaagttctttgaccattttttaattggacggtttgtctttttgttgtggacatcctctggggggtgtgtgtgtacgcacatttgcttgatgcctatacagcttcctatgtatttcctttttggtgtataatttgctggcattttccatattgtgatcagagttaattttttatgtcatgtcccttgctagattggaggttgttctcgggcagaaaatgtgtgttttcattttagcacaactttcaacttcatcacaaagttgaaacaatagcattgcaataaatattgagattaaattaatcagagctattcctaaatggcaaaaaattacaataattgcttctatatgtactttgttagacacttacactgcagagagagaccaaactgcatatcaaaaagagacatgaagctgaccccttattctcaaattcttctttgtgggtaataaggcactattctaagttagcagaactgcttttacttctttttatccataatcgtagatgcaacccatactgtgcagacccacagagacacacacatacacagatgcatacattctggaatatcatatctcgagagactatgtttattttaaccatatcttaggccaatgataaaatggaaggcggagaaaacaattttggtttctcccacataggcctgccccacaactttagagacactgcttagatggccttttcgtttcaggtttctatgagagtaaaaaacatattcagtaattatttataaatgactcagagaaggggaaagctcataaaattattcctacaatattttattagtgtactggtcatagtttatactgaatattcttagtagagaaatcatgagctaaattaacagccaaaaacctctagatatatgactgccctttccatgaactagggctcaacaatgacttggtctgagacaatttaaagtgctctagttgatattcagatgaatcactatcaattcaactcactgcctctccaattctcaagttccagttctaatatcttaatatttgaagtttaactatgacctgatctccactttacaatctagtttggaaactggagcattatcttgtttttgtattcctgtctcaataacatttcttgggcccagtttctctaaggctgaggccctgatttgaccggtcaatcttctaaagataaggatttgcgcatggaacaccagagagttcaggatatccataacctttcaacagcattgtttttacatgaattatctacatgtcttcttggacacccaaattgcactaggttgtgaaaatcctactgctatgttttaccttcttttggggggaacacacatttatcttatttgtaagttaactgcttgtccaaatttcttcctatggcctatcaccataaacattcctatcttttttattgtgccaactctgagttacattctgtccaaaactacactggggcagtggagaggggaaaggatctataactaggcctgacctgccttctaggacaaaataaacagaggaagttatacctggatgaacagatagtaagacgtggcctcagtcataattcagctaataatagagcttcgggaaagagcacagtgacagatactaggctgagcaatgctgagaaatccaggcaagcagccagccaggcaggcagctgtgagcttggagatcagtttagtaaatacatgtctgtaatgggagaaagaacctggaagattggccagtgaagtgctaggcagcccagtgctgagcagccaggttgaaaacagcaggtttagttcttgggataagggagctggacagatgcgcagcacaaaagattgggtctcctggaaagcaaaggaggggtatgacttggggaaattctgaaacatggggctaatttcagaggttcctatgcttggcttgactggcagggcaggatacttggaaaacaacagtgaatacaaattactgccctttgactaacatatccattttcccagcaagtaatttaatactataccaataactacagctgagacaatgggctgtctttttcatcactgtcagaatcaacttagagctgaaaatggtactgagcatgaaagcgggaggtgttttattaagcaaacattcttggaatgagctgggaaagaacaaagaaaatgtttatggggagatgagttgactttctcctatactttacctttctatcacctgctctggtacttgagtaattccaggggccccccaaaatgcacacaccctgtcaatcttctcatttcggctgagtcatgtaataaacaatgccatgagagttaaatgaactacattttagggatcaacgttaaatttttatttacttttaaaatgttcagaatttttaacgattttcaagaaaaattaaagaccctttacattagtctgaattgaaaataaataaatgactaatagcatttggtaacgtttagaaaatgcaaatagatcataaaaagtactacatgaaaaatgaaacacttagttcctctcacatctctttaggcatctgttacatcttgagtgagtctcctttgtgattttcctgcctctttgtctctttattccaaaaaactcaacacatacttgtcagattaatctcaaaggccccatgaagtaacggagagatttaaagccagctagatttagatttgaatcttggctccagaatgcttggctgaatgtccctgggcatatttttaacctctctatggttcagttttctaatatttaaaattagaataatgatagggatctggcaatactgtgtctagcaaagtgtctggtgcccaataaatccttgttcctttatttcatcctaaatgtgactttaaacaaatcatcacccttcaactgtttcctgttgcttttggattgaagcacaaactcctcctcttggcaccataggtgtgtcaaaatatgatccaaatctatcttccaacagttattttctgtatcttccatatttactattcaatatccattcatccaattgtgaaggcatcccatcatcccatgattttagagctcttcttttgctgatgatttttttttcctcaggaatcccgccaatgttgagtgaagttcaacataatgtatggcatggtttatctgtcaacttatccacaaaatctctcaggacctcctcaaacacagtaggttgtaactcatcctccatgggacaccccataataactctctcagaatctacatctcatttgtgcattgggcactagtaacactattaattatagcttgaatgcatgagcattttagagtttgcaaagtgttctattatctcatttaaaattcacaataatgttaacaaatattcactccacttaacacatgaagaaatcaaagttaaggaaattattacctacttaggatcacacagctaaaaagtttcacataatgattcaagctattgtatatgacccaaacccattctcgtcactttggaaaaagaacaaatacaagtttataatttggcttaggaacctcattattacaacagctaaaatcacacagccaaaagaatgtacagtagtgattcaaactcctatacagtaaatatattttaaagatcaaggccaataattttgccacctaaatagtagtcatagctgctgtgagaagactatcatatattctactgttaaagctaagacccaacttacaaaatgcatttgtcatttttgtaaataatgtgtttttagtggactgactgtaagttcattatctggtgtttttgtttttaaccaaaatagtgccatgtttcccacgttcagtagagatattggttttccaggctaatatgatagtttttacaaagtgagagaggctcaatgggaccatggaaaagtcatctttcgggtctctcaattcagtgctttcaaaagtttcctttaaaatctaagcctccccacatagctttttcctcttatcacaaaagatattcgtggtatagaagacttttcctgtgctcagcaaaaaagcattttttcaggaactatattaaccctgtagtagagagggctctgcaacttcaactgtttaaagagaagatttttctaatttaaatacttagctagcattaatgtgcagacgcattaatgctaagtatttaaattagaaaaatctttatcaattatgtcaatgttaaagttataattaatttatataatttaattgtataattgtatagttaaattgtattaattgttgtgcagacaacatagtagcattcagtccaatgttacatttcataaagtttcccttagctacatagtacttaaaagtagtgaaatagtgctttatcttcatttaacccagtaatactcaaacctggatccatatcaggatcatccggggatcttttaatatacactgatgtttgcactcaaaacacagtgaggcagatttaattagcctacatctccatgactggctagtcatgaggacctttaaaaaaggctctcagttgagtcttatatgcagctgagatggaattaatcactgctctgatccttaaatacatgcataaagaaagtgagagttaatcagcaatttttatcctgctaaattttcctatgtatgaatatatattttgtctgattgctacacggggaacttcttttagggaagaaaaaaaaaacctcatgagaacattttatttaaagatttatttactctcaccttaggtcacaatagcaaaaatagcattttggaatccagcagagagatccagaaaataatattgtcattaaatgaaattccccagatgatataaaagaagttctacttagagccagcagcagaaaataaatacctacaggactatagaataagagatttagagaactagtcaataagaaacagaagtttttatctacttgtgtgagaattttcataaaagtacaaagagattgaaaaagaaatatggaactattgttaaaaataataacagccatattgtagcagtttatatgctatttgaaatctatacacttggattttttaaaatcctaaaaataatattctaatgatactgctacagtgggaaaagctgtacaaaaaccaaaccctctattcaggtctttgctccaggctcaccacaggattctgggaaaatcctttaagctgctctgagtgcaagtcactctctacttgttcctgctaagcatttgggatcatcgttagcttaaaaagataatgggcataatatctttgagcaacctgttacacatatagcaataagtatttctacttagcaaaaataaaaactagttaattccaaaatgactacagatttgagaacatgaagaaaatttcctttctccttttcatatttattatcgttgttaatcctcttaaacatcagtttttattaactctttcttgtatttgctggtaatttttactccttcatctatctacatctaatgttttgatgtatgaatctaatccaatgccttgcacaaaatatttgtaagagtcatttgttttgatagacaaatatctgctaatttagccagcaaccctatccagacactaggaacctatgaaataatttccacctttatacgtattttattgtgtagaaaatacattaagaaaaagagtatacttgccttcgagccactcatctatactataactaaaaacttctattgaaaacataattgctaattaagagatactattagggacagaattgactggtgtggaccaatagtgtgctggtaaatgtttaacaactctttgggatgtgaagggtgcctactgtagtgtttgccaattgctgtcttgtaaatatttccaccatgacaatttcaagcctcccacatgacatcattaatgtggagttgggaaagaatgctaacattcagctctgataagcaataattaatgaatcaatctatatgtgattatttgtactttagaaacaataaataggtctttaaagacaaatctggagataaagaacggaaataaaaagcctgcagctatgacttcttaatcattctttcaaatattctcaagccacctattgagtttagaacaagtactgttccaactattggaatatatcattgaacaaaacagaaaatatgcctaatcctatagtttgtattctagtgcaagaagatagattacaaacataatacattattaagacaatcttatatcaatgcagtatagagatgtgatggcatggaggtgttagtggtggagtaggaaagatgaattattttgaaagtagagccaaaagaatttccttattgattggatatgggttgtgacagtaatgtgtcaagagtcccagagttgtagatttgagcaattggagggataaacttgccaataagtaaaatgaggaacactgcagatgaagcatgtttggaatgaggagtcttcaattttagttttaggcattttatatttcataaatatattagatatccaagtgtagccattaggaaagcaattatttatgagtgtggaacccaatagagaagcctgggctgaagaacgaaatttgagtataatttctatataaacagtatttaactggatgacatcacatgtatagtgattgtagatagataagatagcaaggactgagttttgagtctcagttcactctgcagttcaagtaccaggaaaagagatgcaatctgctaggaaactaagaatgaatgcctagtgaaatagcaagaataccaggaaaaataatgtatcccaaaagcaaagtgtcatgtaatatcaagttaaatgaggagcagatttagcaagacttttaagtttagccagaaggaaatcatttgtgtccctttcaagggctgtttcaattcagtagctgggaaaaaaaaaataaacccagagtgagtttaagagaaaatatgatgagaggaatgggaggcagcaaatataggcaactcattcaaaaacaattttttgccatagaaggaaagaatttgggcagtagctggactgcaagaagtgaaggcaagataaatttttttaaaaaaagagaaaaaaaacagcattctaatagaaattattcagtcgagagagaaaaaaataaaaaattaaaaaaaaaatttttaaacacccactagaatgttgtcctttagtgggtaagagagaatgcaatcttcttcatagcagaaggtctggcttagagtggaggcatggacagtttacctaagtaggaaggcagattgacaagtgctgcttaattaccattcactatttgtcatgacatcattactattggtaagtggatataataataatgttttctttgtccttaggctgggattagtagctggtgcatagtatatattcattgacagtgagcccttatcatcatcatctgtgccatcaggcttaagctaagctccggggatttcatttttctataaccttaatttcagattattcacaattttcttaattttcttttacattttcactagatgcttttaacttcctctctttaaccaacaacttgaatacaatataagatgtcttaaagttatatgtaaaatagaaattgtatatttttttgtgttgtaaaattcacttttgtgggcaatagaattaaatgcagacattttatgtgtgtaaatcaaaatgtttaaggaaatgcaagtatgagttacatttttgaatgtgtacattaaaaatatttaaacccacgctagttcagaagatgacaacttcattttattttttttaagttcttatgtgggttgcaaaacacttactggcaaaccaaacattctggcaacaattctgtattctctagtcacaacactaataacatcctgttttaagacaatacaaaatcattaaagttgacaattagtttctgaacataaaaagattcagctctctgtacacttaccaacaaacacaatattaggcaatgtggagaaaccaaagtctatttatcctgtgagcatatacattttaaggaatattatttgctcacatacatattttaaagaacataaaactccaaaatattgttcccaaatcttacattgagaacaaaactcaggaatgtgtcatatttaccttgtgactttatgcatccactcatctttatggtatgtccggaggcatgaagctttaatgtgagaaggaggctataactaactggacacataattaaatgtagttgaagaatttgcttccagatcttggctcttagatgatctataggatattcttctcacaaagtagaccttcattttctctttctaatacttcaaagaaacaatacttaaggactcttccaggtacagcattctctgattctatgatagtgcatatctccacatacttactagaacttgcagccccacatctcctaaacattcccttcccaattcagaaagagataattttctagcacatcaaattccccaatggtatcagtacctccagtgatatttgcactggtgttataattcaggaatatcttcagaattacagttattactctaaaaataatcatttgatcaagctctctaaaagtttatgttgactgtattaagctgtgaacattgcctacaatgtgacaatcaatctttacattttttaaaaaatttaggggaggagaactgactggaatcaaaacactgcaagtatgcatattgtttcttagttctgaaaatccctgtgaaatagtatttagaagggaaatctataatcttgatttgtacaaaatggcacctttcacaatctatgttcttacattggaacatttgttataacaaactttgtcataatttgctatcaaattaaaaaatacctgttcaaatactagctaaatgtgtagggtattttaaacgagatgatttatgatgtatcttagccgtatttcagacattcatctggtaaaaacaaagctacccctacactgtgtaaacatttttaaagataagaaagaaagaaagaaagaaagaaagaaagaaagaaagaaagaaagaaagaaagagagagagagaaagaaagaaagaaagagggagggagggaagggaaggaaagagaaaggaaagaaagaaagaaaggaagaaaggaaagaaagagaaagagagagagaaagaaagaaagaaagaaagaaagaaagaaagaaagaaagaaagaaagaaagattttgtaaaggagtttagttacaaagccagtttgatatggttttagagatttatagtccatgcaacattgcactatctgaaaatcaaagaagagcagttgcaatgtgtaaggctaaagcagtcttcaaagtgaattgtagaattcctttgaccgatgtgcttatattacaaagaacattctcagtcatgttgatattgggatttttttttaacaagcaccatctcataaatttatttagtaatgaaaaaaaaaactgccaagaacatcaaacataaaatctgccaaaggaaagcgaacactatttatttgtttcctagggctgctataaaaagttaccacaaacctggtgatttaaaactgcagaaatttactttttcataattctggaggccagaggtctgaaatcaaggtgtcagcagggttgtttttttctgaaggctctcataggaattagtttcacacctctcctctagtttctggtggctgctggaaatccctggcaacctttggcttgcaaactcatccctccaatctctgccctgtcgtcacatgatcttctccctttctgtctttcacattaggcttagagcctatcagaaatccaggataatctcatcgtgatatatttaatttgattatacttacaaatcacatcaaatgtaattacaaaataatttacattacttttcccaaatataaagccaccttaacagtatccagggcttaggatttggacatatctattttaaagtggaaactaattgaactcagtaggcaaaactttaaaggtgatgttcaaacaaaccttctctgatgcatagccctaaaatcctaatggaattttgtaaaattgttatgtggtatgttcatttagggcctctgagaagccttaagttgcaagaagctggtaggaacacctgtgaaggataaagaggagcaggagtaggcaaggagcgccttcagactatgacactggtctaacagcagcgagaggggacaagaaggtcaagaatcgggttgcaaggcttcatactgtggtatagctctgagaatgtctccactaggccaggaaggagttctccagcaacatcatccattgttgggattctctgttataaagaaatgtcctggattcaccatcacaactgcatttggtcattgcctgggagcagtccagggagagcatgcctccatgtcagaactgtagcaaatctaaagtgtcatgcctaaatgaagaatagatagtcaaagctcatgagagaagttttctgtaaccattcatcaaaattccaagaaaaattgaagaaggaaaattttgcaaatatagttcctttgatatctctagggaattctagaacatcccaggacatcattctaggattggtgattgtgagacaatatccaagagatctttatgcctcctagcaccactgttatgattagagccaagaggtattggcaaccttgaaggcatattgtggcaggccagttttcactaacagctgaacagacaggcctccatgacaactgttttagcactgactgagttgttaatttaaatattaaaagcggatagagccagtgctcttatacaaagggtggaatgtaacaaaagcccaccaagagttttgcctagaccattcctgggccttgaagcgtaagaagataatgaaggaattcttcacaggatatgtttagaattaaataagttttattgggggtatctgaaggaactcctcacacctccactaacaagttttattggggtctaaatgaactccccaaatctctttgatttagcatgagcaaaataagggtagccacccctggcacctggacccatctggttaaagtaaatttactgaggctccagaggaaggtcttcaggactctcagaccttagttatagattagaggttaatcacatatgtctttaggtaaatacaaacttacatgtagacatatagctaagaaggtatacaagctctgggaaactgtaattttcagttggtctggtgatattttcccagcattctccctgtacccggtaacagaaataaactctcttctttcccagtttgtctgcatctcgttattgggcggcaagaataagcagcctgaccctcactttagtctgggaacaatattacccaatgctggtgatgtagtatctaaagggggtgcttatatagatgactttgctttgatgaaggattaattaaatggtcttgatagcaatgaggacaaagctctgattttttttcttgcccaaattcttttctatggggtctagggaattgggccttacaaatcataaattctcatcatcagatgggttttatttaaccctgtatattgtgacttactttccagtctgattctggcataactagggaaaaaatcaaaatatattttccccaaaatatatttccctgccataccttgaaaatgccctgcaaagtctcttttgggaaaaatccacattcaatagagaatccccttccccctttgttttccttcctttctttccagatccaggagataatcaactaagcgccaggcacccttttaggtctgataagaaacattttacaacctgctgtctccctgaagtctgatatctgagagatttctctgcacagtaatacttgatctccacaattctttatcttaacctgaacactcctttccattgatcccaggtctccagataaactcaaccaattgtcaaccagaaaatgtttaaatttacctagagcctagaagcccccggctttgagctgtcccgcctttctgaaccaaaccaatgtatttcttaaatgtatttgattgatgtctcatgcctccctaaaaatatataaaaccaagctgtaccccaaccaccttaggcatatgttctcagaacctcctgagggctgtgtcaagggccatggtcattcatatttagcttagaataaatctcttaaaacattttacagagtttgactcttttcattgacagcaagtaggtactcaaattggtcaactgggctatgaaaagaatctcatgcctaacaataaataaagtatgaaaaaagaactggttctacagtttgtcgctaaacttccaaaatttttttgaagagaactacacaaaacagatatgttaatctggtgtggaggactgtcttaccacattggatagtaaaaatgttgaagaatttttatgaaatacacttacagaaaagaattactaaacttaattcttatgaattagaagagaaagcatgcatatttgatgaaaatctttaaagtttagatcacatagataaaataatgtagctattggatatgattatgacatgaatgcatcacacactcttcctatcatctgttacactgacaccaagaaagtgaatggaaagagatatccaatgtgaattttaatcctcccattgttgctgtctatggcatcagctgatagttgaggatggacagccatccatttccagagtcaaaaccaccaggaggaaatcatccattgttttcttgtacttggacatagccagacctcaggcatttactttctgcctttctcacccctcaccagttccctcctgctcatccttccccttcagcaagcagcagcactgactacatcttccagctttctcttttcaccgctgtacctcaattgggttatcttcaatgctttaatcttcaaaagaaacaaaacatgccttgtctcctatgttgctttgttaagagttaattctattccttgtgtttttaacatattatttattcttcaagcttctgcttagaagaaaaatgtaatttgtatctaatactttacaagacagcatcattgtatatagaatggatatgtactaataagcacataaagtgctaaataattaggtgttaaatgattaaataattgatactttagtgctttatattacgaaaaagtctttgttgagttttatatacatgtttcagtatttattattacttgggaaaatttggttgggtgttttcataggttgagaatgcattcttattttccctactaaaaataacagcatacaggcccctactattaaaaaaatcaatgtttaacatgtttacaataatgtgttcgattcagataatgaaggatatatgcattacacttattatgtagaactaaaaggtacagagtcagtgaatttaaagtaaatgaagaatgacagagaaggtaatgaagagaccacaagagtgagaaaagcaaaaaatagcattgtaagttaaccaagcagatgggacagtccaactaaactggaacagtgtagtcccctttgttagctgctctaaataaggggttctatcttcacatatatagtaatataatcaacaatgaggggcacaaaaacacatgatcaaaaccctctaccttagaaaaagttccagaaagaagaatgggatggcttttgctgtgggcaaaagctgagatcaccaggacatgtagatgggtcataaataaatatatatatatacttggcctacattttgtgggaaattcttttacattacatcctgtgttgttagtgctaaacagttacatttccatgaacccacattgccttttaagtgttttgtagtctctcggcaaagggggaaaaaggctcctacacaataagctcattttcctgagggtgtggcttttgcaaatggacttaaattactagaatttgtgacagccagctgccttggtttttgtttgattgtttgtttgtttttgccctgacactccattagtgttatttattctcactcataggcttgggaggagtgcaaggacaagttaaaaatctgtctgaatgactgggcagaaaagattttcaagccatagagaaatgtcttaggcattgttgtttctctaatgggaagagcctgagaaaacacttggaaagtatctcctccaaagttacagtcgatttggagaaaagctatctaaataaagaatatttcaagaaattacataaactttgattgttaccttgcaagaactttgcctaaggcacattgtccaagcactacagaagtataaagaagattctaacttgattggatatttgttccacttgaaatctgaagttacggaaaagccaaatagaggctgtatgaaatggaaaatgtcaaaaatcttaggtctcctcttattcacatattattatcactattactttgctatagcatactgatgattttacttgaatgttgctatgaatgagggtatctcattgatgacttaaaccactggtgctttgaaaatgttatttaaaacttggatcataattgaatatcaattattcttttctcaaccttagaatatatatagtcatatgcaacagtcttctccaaattattcgattttctcaggaaatccaagttaataaagacagatggtgaattaagtgaaattggcagcaaatttatctcaatttttgagatttttaaaaaacaatgtgttattgttttagaattctctaatttctttcctccctgtcttaaatcttctttccatcacagatttctttgcatgccttggctgtattgtccagattgacatcatattaagtggcatgtgtttctttgctattaagctgaagtggcttttatgtttacaggcaagatcattgcattttttatgattgtgtaattaaaaatgcccatttcataaaaactaaaagcacttaaatataagaatatataaccttccatgatttttctacctggaaatgactactattatcactgcagtgatatccttctagaatattttgaattcgtgagcataaatacatatttagaaaattgggatccaaaattacgaaaatggaattagggattacatggcattttgaagctactttttaatttaatatatttaaatttattttcatgttaatatatatatattcatactatcaacagtattgcttgaatggtaattcttttatagctgtaccacaatttcatttttcaagcagcctcttattttgagcatttaaataactgttaaatttgtattcatgttaacagtaaaataaatgtgatatacatacgttgatatggtttggctgtgtccccaccgaaatctcatcttgaattatattaggttggtgcaaaagtaattgcggtttttgccattgaaagtgaaggccaaaactgcaattacttttgcaccaacctaataattcccataatctccacatgttgtgggagcgacctagtgggagataattgaatcatcgagatggttacttccatgctgtttttgtgatagtgggtgagttctcatgagacctggtggttttataaggagcttcttcccaatttcgttctgcatttcttgctgccaccatgtgaagaaggatgtgtttgattctttttctgccatgattgtaagtttcctgaggcctccccagccctgctgaattttgagtcagttaaacctctttcctttataatttgcccattttcaggtatgtttctattagtagtgtgagaatggactaaaacagtaaattggtcatgggaggagtggggtgctgctgtaaagatatccgaaaatgtggaagtgactttggaactgggtaacaggaagaggctggaagaatttggagggctcagagaagtcagaagaatgtgagaaagtttggaactttccagagacttgtggaatggctttgaccaaattgctaatagtgatatggacaatgaagtccaagctgaggtggtctcagacggagatgaggaactgttgggaactggagcaaagattactcttgctagccaaagagactggcagcattttgcccctgctgtagatacctgtggaaatttgaacttgagagaaatgatttaatgtatctgatggaaaaaatttctaagcagcaaaacattcaagaggaagcagagaatgaaagtttgaaaaatttgcagcctgatgatgcgataaaaaaataaaaatccattttttggggagaaatacaagccagcagcagaaatttgtataagtaacaaggagctgaatgttaatcaccaagacaatggggaaaatgactccagggtatgtcacagaccttcacagcaggccctaccatcacaggccaggaggccttggaggaaaaaatggtttcctggactgggcccagggcccacctgctgtgtgcagcctagggacttggggccttgcattccagctgctccagctatggctaaaaggggccaaggtatgactcgggccttggcttcagagggtgcaagcccgaagccttgttagcttccatgtggtgttggtcctgtgggtacacagaagtcaagaattgagatttggaaacctctgcctgaatttcagagaatgtatggaaatgcctggatgtccaggcagaagtctgctgcagagccagagccctcatggagaacctctgctagggcagtggagaagggaaaagtggggttagagcccttatacagcacagagtccctactgtggcacaacctagtggagctgcgagaagtgtgccaccatcctccagaccccagaatggtaggtccatcaacagcttgcatcatgtgcctggaaaagccacagacactcaatgctagctatgaaatcagccaggagggaagctgtattctgcaagctacaggggtggagattcccaaggctctgtgagtccacctcttgcatcagtatgacctggatgtgagacatggagtcaaaggagatcatttttgaattttgaggtttaatgactgccctattggatacaaacttgcacgggccctgtagctcctttgttttggccaatttcttctatttggaagacgtgtttttacccaatgcctgtacccccgttgtatctaggaagtgactcagttgcttttgattttataggctcataagcaaaagggacttgccttgtctcagatgagactttggacttggacttttgagttaatgctggaatgagttaagactttgggggactgttgggaaggcatggttgtgttttgaaatgtgaggatatgagatttgggagagctgggggcagaatgacatggtttggctatgtcaccacccaaatctcatcttgaattgtagtttccataatccccacatgtcatgggagggacctggtgggaggtaactgaatcatggtggcaggtacctccatgctgttctcatgatagtgagttctcaaaagatctgatggtttaataaggggcttttcttcctctttgctctgcacttctccttactgctgccatgtgaagaagggcatgtttgcttctccttctgccatgattgtaagtttcctgagggttccctagccaggctgaactgtgagtccattaaatctctttcctttataaattacacagtctcaggtatgtctttattagtagtgtgacaatggactaatacatacacatttagaacatatttcatctgaaccttaccataaattcctaaaggtagtgtgaacgggtcaacgggctcacagaatttaaggtgttttttttcttttttaatatcctgcttaatttgcccttgagcaagtttgaactaatttaatttgtcatagcagtgtattagagggaagtgttggctcttgtgtatagaatctggaaataattctaatgtgaagcagatctatttaaatctagctacaataatcacatgcttcagtaaaaatgtcacattaattcagatttcatatcaccgtgaattaattaaagagacatcagtattagtaaattttctgacttacttgcattgtagtagagtgattactgaacaccctgttcttaaagataaaagactgacgaagaaaattgctttgaagcagaaagagaacaggattcagagttaaaagacctgtgcaagtggggcaaatacattccttggaacttattgttattttatctgtaaataaagatgacagattgagcaatctcaaggcttttccagttctaaaacattccctgtatgctatattgcagtctccattaagctaatacccacgacctgttttcttgtttttttttcatagaacctagtgcataaactaacttgcaaaacagtcatttttatgtgctacacgctccacattacaatatatttttaaatgagcatgctaggctgcttattaatcagatttcatttcataggattgtacaaataaaatgataattgattttccagtattaattactctgtagcccttggcagatggaatcattcttccagttgcttgattttttagaaggtaaagagaaactagaaggtaaaggtaaactagttaattgaggtctcatgcaaagtttactaacagaaaaacatacctaaactaagaaacgattggttttattcagttagaagggagaggtgaagagggagttgacttgtaaccttgacccttatagataaccaagcattttaaatgtagcttttagcacatttttgtgacttttaagtataagttacatagtagaaagagaaaatatttctttttatttttatgccaattgcttaaattaatcaaaataaattatgtgccaggcacagtggctcacacctgtaatcccagcattttgggaggctgaggtgggcagaaagcctgaggtcaggagttcgagatcaacctggccaacatggtgaaaccccacctctactaaaactacacaaattagctaggcgtggtggcacatgcctgtagtccaagctactcaggaggttgagtcaggagaattgcttgaacatgggagggagaggttgcagtgagccaagatcgtgccactgctctccagcctgggagacagagtgagactccatctcaaaaataaataaataaaatatgaaaagtttgtcatctttatttaagacacatagttgccctgttttaacattattctatttttaattgtaaaagcaggtggagaggggtggggttcatgcctgtaatcccagaactttgggaggccaaggctggcaaattgcttgagccgaggagttcaagaccagtctgggaaacatggtgaaacctggtctctataaaaaaatacaaaaattagctgggtctggtggcacatgcctatagtcccaactacgcaggaggttgaggctgaggatggcttgagcccaggagtttgaggctgcagtgaggcaagatcatgctactgtattctagcctgggcaacagaaaaaaaagaatatgattataaccatcaattaagattcagctagtttaagcaaaataatcaaaatattaaaaaataacaaaaggtataaaataaaaagtaaaggctcccacaaattccagaactgaatattttatccacttctgttttgtttaaccatctgtttcttgtcacaatatctatttatttcctgctataaaaggtgagaaatatacatccaacatacacagagagattcaaaattttactggttatatttctggttttagtcttctgattggcactttataactgtaaatattttactaagaactttatttgttaattcttcaactccagagtatctattgtctgttctctaccaactctgcaaaaaatggtttgacctagctttttctttctctcaccactctttttccaccttttcttaactatacctttatttttacatttgtattcctccatggagattcctcttcttctatatttaattttgttgctgggtgcatggccagttaagatgtagaaatggggcatggaaagtatggaagtgatctatgctgattctatgttgggacacttaaacagtgatgtgccttctgcatgctttctctgccctgcttttgccagctgggaaatgagcgggacctagacccagcctaaagcacatgatgaaagtaacatgagtctataaatgaccctgtgatggagagccacccacagatctggaaaattctccagctgactcttttgtgcaggaaggatataaatgtctttgttctttaaatctaggaatttttggtctctgtgctttagcatcttcgcccaccctaaaaaacacatttccgtattttgcctacttttttattctacagtttcaaaaccacttagcaccatttacaacaataggcatataatagtgttatttatttcttaaccaaatagtgtggctggcccctgagagagcagttgtgatgctaggttaattctatgccacttggagaatgttccaagcatcaggtaaattccattttcttattcttatattcaatcagtagctcaacccatgctgtattttagtttgcatagcattttgagcatgatgttccacagatttttttttcacactgcttatgtgcctttctttattcttactgaggtgcttactatatgaacactagaccttccatacttctcatattctgctctatgtgcaaaatagatccagggttttatatttagataattaagatcttattcacccatataagttgcctttttaacattctttatgctggcatcataacgtagtttctgagaaggcttgctattctttgttcccacctcagcatacacttacttgcctttttttatgatgtagctctaacaataatacatagaaatgcattctgcttcccaatggtttcttttccttgttgtcatgtgtttgttcagattcatttgtgtcacttcttattttgatgtttctcttcctggctgttcattttcttcaaatatcttgtgattcttgattaaacattccaacttgatggcaataagtacctatggttgatttctttcacagttttgtaagtctatttaaccataaaagcctggttctatcaaaaggtaacgtttcccttaagatgtgtggttgagcaaggggccgactaactcacagccttcaaaaataacaagggtggagggcaatatactggtataaagtgcttttgtgtatttcactcctacatgggatttgctttattctgcttatctttcaattcagtattcacattctgggtcctccataagtacactttgattttcaattagaaattagtattctttacaccagctgaatgcaaatactacacatccaacatctttgagtatattagaagagaagaaactgctgcaactcactcaccattatctcttctactaactattctggttgcctccccacagctctcctcacctgctaatattctgtctcaagccagtggtttctatattcattttctcttaatcacaatttttccttggttttcctttctttgctctgggctgtcaattaagtcacatttactttgcagttgtaatagaaattactcagagacttgttcttaatcaggaaatttgagcttgtctgtctttattcaaacaaactattctacttgaaaactatgtagttatttttacgcaccattcttatatgtaatatttgtattataacatataactctgggcttatcctcattactgtaccctaagataatatatttcacaagtttatatccttacaatccttttgaataatgcagtttttgtgtaaggccataaccagctaaatcagaaaatggtattttctttcctctctccatccttctttttcttctttccttccttccaggaagacacagagttttgccatctttaatccctagtatttagcacaatatctggccaaaagtagaaagcatttttttaaaaaaaataattgatggaattattttatttcatttgagacagaatcttgttgtctctcccaggctgaagtgcagtggtgagatctcggctcactgcaacctctccctctcaggctcaagcaattctcatgcctcagtctcctgactaactgggactataggcctgtgccaccaaactcaggcaattttttgtattttcagtacagaatgggttttgccttgttgtccaggctggtcttgaactcctggcctcaagtgatctgctctcctcagcctctcaaagtgctgggattacaggtgtgagccactgtgcccccggcctgaatttttaaatgaatgagttaagtaatgaatactatgattgcactatacttagactttaatattttgtttcttcaaccttggaaaaaaaactttcaccctctaactgggtatatctcatttgtgataattttatttttttcaagaatatttattcagtgcctactctgtcctttgctctaggcatgtggaataaaagcataagaaaccaaaagaaatattaacttcttggaaaaattcatggcgaagggatcagaggaaaaagaagacaaatattacaccaataatgataaaattgtaatagagaattacaggtgatgaaggagagagtgaattaaacaggagggttggagaatgtccttctgaagaagtgacaattcagcaaagatctagatgagaaagccccatagaagatgggaaagtctattcgaggttagtgtaaaggcaaagtggaagagtaaggaggctagtgtgattgtacctcagtttgctcacatgattatatatatatatatatttttaagacagatgcggtcttgttctgtggcccaggctggagtgcagtgatgatcatagctcccttctgcctcgaaattctgggctcaagaaatcccccagcctcagcctcccaagtcactgggattacagatgtgagcctgtctggctcacatatctggctatgtgaacatattattttatactattctctgtaagagtttatgaactttgcctttcttaactttccatttggctattatctaagtcttccataagttttttgaaggctcgatcatttcaatccttttcaccatccctggtaagtaataaacatatagtaacaagattaaatattacttgaaataatgaataaaagagctgattgtcaacctgatcaaattacgtgaattttaggcacatctacaggatatggttattcaaaatatggctcattcttataccaaagagaatacattaagcaagaatttcaaaactcggattcacttgtcacaccgcataaatgaaagaggaagaaatatgtactcctgaattactgatcacaagatatttcaaagatttttgaaggttttgaaacacttgcaagtatgaatgtggaataaagttaatttgccttcccactgcaacttgcccttatacctgaatttcctctcacttattgaagccatttcatcctgctttcgctgcctgattttgctgtttgacattaggcaattaatggagtggttatgtatggtcatttctatctcaataaattctgctcattataaaactccaatacaagaattattattgacattgacaagtgcaaatattttggccttccttttgtcatcattaaatttggcaattacctttctccacagactgtacatttataaagaaagggaaaaagtaaataccaaggatgtttagtgcaatttattttcagatgagagaacaggccttgatagattcaatgctttcctgatggcttctaaagtagagaatgaaagagatgggatctttttcatagtaagtaattacttttattatagagtatttcacacacataaaagaataagcacaaaaatgatcccttgttaaatttctgttaaatacttaaaattgatttgaggaaattttcttgttttcctggtttacaaagaattacaagaatcataaatattcaatattgaattttgaatcataaatataatgttgagttttactgaatgcttttaattttttaaacatgaatcttttaatgtaaattgtgattcttgcattcttgaagtaaatataattagattatgatatatattgcctttttttttactacaatctactgatgtatccttttcagctgaagctcttttttgttcttttactttactgctctgtgtgttctatcgtctaagcttttctttggttatactagagagaacaacatacattcttatgttattaaagtctagttttaatcatatcagaacaatataaacacctttttgaccatgttcaccatccgtccaaattatatgcttttttttttttttttttgagctggagtctcactctgtagcccaggctggaaggcagtggttcgatcttggctcaatgcagcctctgcctcccagtttcccaggttcaagcgattctcccacctcagcctccccagtagctgggtataggtgcacaccaccatgcccagttaattctatatttttagtagagatgtggttttgtttgttatgttggccagattagtctcgacctcctggcctcaagcaatctgcccacctcagcctcccaaagtgctgagattacaggtgtgagctgccgcacccagtttatatgctatttttgattaggatttttgttatctattttttagtcattgttagaaattattacaattacttatgcacctaagatctgtttaattttgtttgccccagggcaacctggcttcattattttacctcctgtgtcaactgctgtttttttttttaatgtttttttggcctttgggaattttttatacttcttgtgatccctacaatatattctatgtgtatttgttgctgaaatacttttcaatatgtctagtctgccacactactggtctctcattcttttatgatagcacagctattataaactaaggttatgtatgtatcacagtaacttgtccattatctctgtcaactgtgagatggaggtcacaacgtgctttctataaagaaagggcaataaagagtcaactaaatatcatgaacaattttatctgtatttttcatttccccttgacattttacacttattttatcacatgactttcaaagtctcggaaaaaatataaagaaaaagtaatgttatataaaatatggcactttaaaggtttataaataacaaataggcattttaaaattcttttcaagtatcttattataagtattttgtaaaaagtatagaaaacggcaggcaaactcactagctcattaaaatagcttcagtgtcattttctaatcttcttgccttgtcatttgatttactttggctcttaatatctattcacttatagattagttcatcaaaatcatatgtatacatgtatgtatatacatgtatatgtatataattttgtgcacacatggcataaacctcaaacgtcatgactaaattaaattaaattaaattatatccattcactgctgtacttttgtctgcagaactgaaagagacagaggattccttagaaccgaattaaaaattcaagaccacctgcatcaaaaacatgtgggagaaagcacataactggaaaagcatgtcacagagaactgtaagcctgctctgccaagctgaaattctaaaatagaaaattaaatattgaaacataaccttgaaatacacagccattgtacattcaaaagccatgagagccattatttctgaaacaccacgtgaaattaaccatttattttacactccacaatatagactacatcaaatttatctgaatactattagaaagtacaattttcagacattaaaggaagaagtttttctttttttttttttgcaagagctgtaagatctacggataaagaaagtcatctttcaagtttttattccataagcttaaagaattatttacaaaatagtttttatattccttggcagaaaatcctttttgaaagtcatccatctttcctttttttcgtcttcatgacatttgcaagcaattgtacagagatttcctgtgtcacaaacttcataggaatcaaagattagaaaaatttccaggaacatgtacacacacacacacacacacacacgcacacagccttaagatattatattctagtatgtagtggctagtttcctacgaacttggatatctacaaataactaatttctaactaatcctaactggttataatcggttgaatgtgtgcatgtttgtgtgtgtgtttatattttaccaatcaggttgtaatgtctttggaacatttttgccattcctccatatttaaactgaaaatacctaaagaccatgtcaattacttcccaaaacagactgatcaactcctgtaaaattgatggcagctgtggcccatctggagtggctgctgcaaaagagctggctgcagtggggaggcatggccagggctgtgtattccctggagccggggggaaccaggaacaggcggaaggcctgtccccttaagagttggtgggccaggagccctgcactcccaggcacagctgcggacactgtgctcagaagtacctgctctcactgcctggcttctcctcgctcctggcacccactgtgatttccgagcaaagttgtggctgagcctgtgtcacaacctggccagatgtgcatgcacttggggtgacactgacacatcagccccctgtcacctcagccccctccagattttgggtgccaatgagcacggcagggaagccaaggggccactgaggatggctcggcataggcccgcaggtgcccctttgcatgaacagctaaaaacccgagactcagtcagactcaggcagatgacggggtgactgcctgtggagaagaactacccactgtggatctcctctccactgagagctgcaaatatcaggatgatctgactgtggagaggagctatccactgtaagtctcttcttagctgagagttgagcagattttgggacaacctgccagtagataggagctaccccgtttgggtgtcctgagagctgtactgtcactcaatagagcacctcttcaccttactcaccctccagttatctgcacacctcattcttcccagatacgggccaagaactcaggaccagcttaagcaacaacagtaggacacaattttatagcggagtgtgggggcagaagatgtaccattttaattttttatatattagcaatttattaaaaattaattagcatttcacaagcaatgcaattatttagaaataaagctaagttcagagtcctacttattacacagaaatctgcaagagaatgtcacccctatcaaacagaataaaaagccttttaatctaaaacactatgtatcttttatgttaattccataagttagctgagacttcaaagcaatatggtgaaattaattccagagagtgacaagatccttgaaggacacatgcattgtttcaccactgacagaggccaagaagaaagggtgatagacgtagagatgcataaaaagaaaacaacagatacatttttaaaattcttaaaggtgaagtgtggtcggggtaacagtttagtctggagaactaagagtcaccagctcttctccacccctctctgaaggtgctgacaagaaataatgtgggcaggcaagtgattgagaggcctccctcctccaggtgacgtgagcatacccccagtgattggcttttgctgggaatcaaatacaaattttgcatagattcttcacacagagcaaagctgtctgttgctggagaagggacaggaaaacctctcctgcctgcatcctgcaatgaaacaaagcagttttctgctgctagcaaagaggaggaaactccctctcacccaagatccaccaccattacaggtcagcatttgactgcctttgaggcagaggcacatagggcctggccaagggcctggctaagactgaggttatgacaggagagtaaagacaaggcccgggccccttgcagcatcccattgagtaacaagccacagcaaggtggctgttgggaaagggtatcctctggtacctttatcccagacaaaaccttcttgctattgaaggatgggcacaaatagctctaatgcccatggcattgccctgatacaaaacagatctgtttgcgtctggagaaggatcaggaacacagaaagagccccatccctgaagctcaggtgtacagaatctttctaagcctgaggatgcagcagaagatctgaaagcttccaccaccacctcaaaatccaccaaagccttgtctattaactatgccttttattttctgtgttttcatgctttgacatcttggggtcttgctaatgctggaggaagtattcctctcaggttagctaattcctagggacagcaaaatagttgtctgtgagcattcctatcaaacacaaaccaatgaatccagtctacactccaacaccttttttaactgagctttcatactctgtgccactatccacttaccctaatcacctcagggccaggtaacagacaactatgggtagcccatatcactcagaacctgcagaaattatttaaactagcccatcccaagcctgatgagcctcttacttcccctggaaaacacaatcaagtttcttgcccaccttttcttctcaccctctctcctcctggtctcccctaatgcttccctgtgtactgcctgtcccatggtacagtgggttcctttctctcgggattcgtgagtgcaacaaactaccttcccaatggcagtcagttcctaatctgttggccttgtgatgcctaaataataaaacctgcttttaaaaaaaccgtatgcccaggaaaatacaatagcagtcttctccccaaaggtgggaggcagcacagataaagccccctctgtgtcacaggcactccaggcgtgccgaaggaaaacagtggagcagaaacacagaaaaattcagtactccagacccaaccttaagcacaaaaaagctgcagcttaccactggaggaattttttttttaattaaatgttgaaatttgagataactgcagattcacttgtagatataaggcatagagatctcgtgtgtcctttcctcattttctctaaatggtaatgtcttgcaaaattacagtacaatattacaagcagaatattgacattgatatgatcaataaacagaccaacactgtcaccacaaaggtccttcatgctgccctttagtaatcatacacaattccctctgtctctcacttcctcctcaacctctggcaaacattcatctgttcttcatttctataattgtgtcttttcaaaaatgctatgtgcatccatgttgttgcatttattattgatccatccattttttatcactgaatactattctgtggtatagggctaccacagtgtccttaagcattcaccagttgaagactatctgggttgttttcagttttgggctattatgaatgaagtgcttttaaagatttgtgtataggcctttttctctttttatgagacagtctcatcctgtctcattaaaaaagacacaatcttcgctcactgaagccttgacctcctggctcaagtgatgctcctacctcagccttcccagtagctgggacttacaggtgcatgttaccacatctggctaatttaaaaaaaaattttgcagagttatggtctcatacaggcttttatatgaacatattttcattcctcccagagtgcatttgcctaggaatgcatttgctgagttatatagtagtgccatgtttagttttttaagaaatggccaaaatgttttccagagtgctgaaaaaccattttgaattcccaccagcagaggatgactgatacagtgtctccacaccctttccagtagttgatgtcgttaccaatttttgtttagctattctaatagctgaataatgatatctctttttggttttgattgcatttccctaatgggtaatgatgtttaatagctttccatgtgcttatttaccatctgaatattctcttcaggacaatatctgttcatgcctttggctcattttctaattagattgtttgttttgtttttacttcgaattttgcgagttcattatatattttacatgctagtcctgtgatttatatgtgttttccaagtatgttctcccactgtctacctttttcttcatttctcttaacagaatctatagaagaccacgagttttttattttgatgaagtccaatttatttttccttttatggattgcactttcaatatcaagtctaagaaatgtttgcctagcgttagttcccaaagattttcttttatgttacatttttttcacccaaaaactgttcagttttatgttttaaatataagaccacatccattttgtttaatttttctgaggtgcacaatttaggctcattttttttgttgttgttggctggtttatttatttaatggatgttcaattactcaagcacatttgtttaaaagggcatctttctaatattgagctcttgtccttttgtcagaaattatttaggcatatttttatgggtttattttagggttctctctgtcattgttgatctatgctttaatcctgcaaatatcacaggcttcattaatgtagcttgtatatagtaaggtcttaaaattgggtagacaaattcctcccactttattcttatttttctaaataattttggccattctagttcttttgcctttttagcatacgctttaaataaacttgtctatatctgccaaaaaaaattcctggcattttgattacagttacattaaaatctttatattattttagggagaactgccatctttgctatgtttagactcccaaccatgaattgtatattgatcaatttatttagattttattatatttccttcatcagatttttaaaaatttttttctttttgtaaagaacggggtctcactatgttgcccaagctggtcttgaactcctatgctaaagcgatcctcctacctctgccgccttaaatgttgggattacaggcgtgagtcactgtgcctggcagaattttttagttttcaccacacaagtcttgtacatattttgttagacttacatctaagtattttggggagttgtaaatgatattgtattttgaatttcattgtcaatatatagaaatacaattggctttgggatgtttatcttctatcctgcaaactttctaaactcagtaattctaagaagctgtttttggagattgctggaggttttcaaaataatcatgtcatctgtaaacagtggtagttttatttctttatttctgatataatttttttattttctttacttgtcttattgcactggctagaaattcaagcactatgttgaattgaaaaagggataatggacatctttctcttcttcccaatgtttgcagaaaagccttcttttaccattatgtagatgttaagctgtgggtattgtatagatgctctttgtcaagttgaggaaattcccttctttttctgttttatcagagaagttttgtttcttgttattttacaaatgggtgttggattttgtcagatacattttctgtacttgttaatataattatgaaatttttattttcatcccattaatatgaaagatcacactgattgattttctaatattgaactaacctcatatccctgcactaaaccataattggacatgacgtatcattttatgtattcctgaattctacactagggattttattacatctttcaaaatccttttgaaagtcatccatctttcctttttttggtcttcattttttcattgtgttcatgagggatgctggtctgtggttttccatatttttactctttggttctggtatcagggtaatacaagctttataatatgaattgctgagtattcccttcccttctattaattggtagagactgtgtagaattggtattaattcttctgtaaatttttgataaaattcctcagtgaaaccatgtgtgcctagggatttcttttttggaagatattaaattatcaatttagtttgcttaattcaaaatctaccttttgtgttttctagctacatgacatctacaggttactcagcatctctgtgagcttcagctgtattatttgcagtaattatgctattgaattcaaaagaatgtaatgaaagttaaatataataatgaatgtaaggtatttggtatatattaagtgctttattcgtgttttaaaatagcctttattatcaccagcactcttatcctttattcataaattcaggtaatagaagtagaaagggaatagataatatctcttggaagccactcagggaaggcctgggactaggcaagtctcaactcaagtaggtggacagtgataggcagaagtaagaaaaggtactcatctgctttgggcaaaatgaatcttttttttctaatctttctgtaaatgacaaccctggttccctgaaatatcttcatacctacagtaaaaataagctggcagagaatcaagtgaaaagaggaacactaaaccaaacaaaaaaatatctgttgagcaaagtttgaagattattttgcaaacgtaagttaaaatatgttttgcttgcttaatatagttacacttcatctttttgcataatcttttaggaaaagacaccatatctacagtatgattattatcccctgacattttttctattcaaatacttccatttcaatccacttgaagaaatgtatctcataatactagtcccataaaaggaaattctataggaaattactgctacttttaattcattgaattcgtcaattaatgaacatacagattaactctataaaaatgctcttttggcagaaagactaatatttgagttaaatagagaagaaaaacacaggtatgtgaagatatacacagacaaaaaaagtcgtctgaggcaaaatcaccaaatgagatttttgcaaaaagactgcccctaccaaacatatgcgtatgtaatacacattttagaggaaagaaggtaaacacaggagccacagacttcttagaatgcttaatgggtttaataacaattctacataaatattataatgacacttaagaaaaatactgacattattctcatagaagactattagaaatgcattctgtaagatagaaatgtcatgtaaaattgtttagattcagaaaagacaatggttgaattgctcccccgccaatcctgcctgattgggtcatgcattcctaccacagctaccccaagaaaacattcctgtcttttcccctacgcatctcagttaggacactctaaatgccatattgctcctttctatttcctgaaaggattgaagatgctttgccttctgtctgctttgtattctatgcctaggctcctgagcctcaggatcttcagctgttagaaatcagggatgactacatactttttaaagtatcactcaaatattttctgtaattaatactcaacagtttttatgatgataatcaataatgcttgccaggaggagaaggatgtacataaacctctctgtgtttatgaagagtatatgcataagctgacagaaaaattgtgatgaaattaactatctctatgagaaattatcctattacatctgtgatggttggttttgtatgtcaacttggctggccatggaatacccagattaagcgttatttttgggtgtctctgtgggggagttttggtatgagattagcatctaaatctgtggactcaataaagtagattgccaccccactgtaagtgagcattacccaatccactgagggcctgagtaagacagaaggtacaggaagaaagaacttgcttctttttgcttcctgcctgcctgactgagctcatcttattttctccagccctcagataggaattcaccaactactccactagttcttagacattcagacttggactgaattactccatcagctttcctgggtcaacagcttgcagaaagcacattgtgagacttctcagcctctacaatcttgtaaatcattcttcacaataaatctgttctgtttctctgaagaaccctcactaacacagattttggaaccaagagtggttctagaggaacgtaattttaaagataagttttcaaaattggttctggagtttctagaattgattctgtatttgataatatttcaagacactaataactctattctcaggagtaaagggagcactgatagactagggcctaaaatttttatggagatatagaaaatatctgcattggatactcctaatcaactacttacaagaagtaaagagctagatacctctgtataaaatacttttgaagattttcagaaaactaactaataaaatgacactggttggttgttcctgatgttgctgatcaagtggtaaaagaaaaacataagctaaggatttgaattcccagctcaagtgctgcataaatgacttaggagcttccatgtatgccctgaagtatagccttatctcctagagctgcaggactgaaattgtcaaaaatccaaagcagagcattatcttgcaactggctgaattacaaagcaagttgagctttcggtctggcaggaggtctacagttaaaatgaaggcatttaattgaaaaagaatgggatcctctaagttggaaagggaacacgtgggatagatcctgatgaagctgtggacattgagcctctaagttctgatgagtcttcattaccagtaaaagagatctccccaacctccagcagaattggcctcctctacccacagtgacagcagtattcccacccatagtggtactggcatctctgcctctatagttataaaagattggccttacattgcctaaggaaactgtaatgacctcccccaaggcagatgccatacaagacaatgctgattctctgcagaaccgactctttgcttctagacctataattagactcaagtctcatcagtctcctaaaggtgaggtacaatgtgtgacccatgaggaggtatgttaaactcaaacaaactacttgagtttttaatttatacagacagaaatctggagaacatgtacgaaattgataactaaggatgtgggataatggtggaaggaacttaatgttggatcaggctgaatttggcatggactcattaagcaaaggttctgcattaaatgttgcagcttgtggagtttgattctaacaggttggttggttaactgctgagatatggaccaaaaggtagtccggcatgagaaagttgaaaatacttggcatgccttattgcaatgtagaagaaatacaaaggcttagggatatattgtaatgttagggtagatttgtcatttaaggcctacttacccatagtgggagagtccagaaggcatacctttcaccaatactgtgaataataaatttgtcagtggagccctgtcatccttaaagatctctgtgatcactgtctgtaggccagacctcagagtgggaactgtagtcactgcattgagaagcctaaaggcaattggagtaattggatcctggagtgggaggggccactcagtcaccacatacaaggtagagctggttacctggctactgtaatggacagtagagttaaagcagcaatcagaagagtctgatatgttgacctatggacctatggactaggcttactgattatggcatttctagacgtgaaatagaaaatctgtcaaattgttacttaatctgtacaaggggtcttttaaaagtttatttaaaagcatattatgaaaaactatgcatgaatttcaaaaatgtttgcaccaaaataaacttgtactaatgttatgacatgtcttaacaggatctaatttgaggcactaaggaggataagacatcagtttgaaaataacccttatctctaataggaattaattttgctctcaaaattaattctgctaaaatggaagtaagaacaaactccaaatttatggtaaagcttgggtggaagaatggtgaaatcactgatgctttacaaaaagttgatgggtgcaattcccagaataaaacagcagtttacaaacagataacttgctttaagaaggagcaagacaattttgacaacaaggcccacagtagaggaccatacacatcaatttttgatggaaaaatttatcttttgcattctctacttgaagaagatcaataattaacagcaaagacagtagccaacaccatagacacctcaattgtttcagcttacacaattctgcctaaaaaattaaagttgaacacactttccacttgattggtgccaaaactgttgtgcccagatcagctgcagaccagaccaaagctttcaatggaaattttaaacaagtgggatagagatactaaagcatctctttgaaaaattgtaatcagagatgaaacatggctttacccgcacaattctgaagacaaaagcataatcaaagcaatgaataccaagaggtggaagtggtccagtcaaagcaaaagtgaactgctcaaaagcaaagatcattgtaacagtctttggaatgctgaagatattttacttgtaaactttctagaaagtaaaaaaaaaaaaaaagtatttgcttattatgagaaatttttgagaaagttagccaaagcttttgcaaaaaatctcccagaaaagcttaaccagagagtccttctccaccatgacaatgttcctggtcattcctcttattaaataaaggcaattttgcaagaattttgataggaaatcattaatcatccaccttatagtcttgatttggctcctttgacatctttttgtttccaaaccttaaaaaaatctttaaaggcaaaattactcacttttctttaattaataatgcaaagagactatactgacatggctaaattctgaaaaccctcagtcttttaaggatggactaaatggttggtatcattgcttacaagtgcaacttgactggtggagtttatgttgaaaaataaagtcaatgtttttactttttactttttactttcatgtttttcatgatctttttgaagtcttcttgtgcaagcagcaaagttctaggtcaagtgaacaaaagtctcacctgagtcatggcccctcaatcatttcccatatttgagccagtttacaaacctagaactccttgaatgaaaggtagtccaggtcctcttgaggaaggaccccaatgcacttccaaaatattataatgttaatatttcttctagccttttcccaaaggacctatggcattttatcaggataattatactcaaggaaaccaaaataattcactcacaaatatacttctttgacatatttcaagatgcttatccagaagggctacaaatataaggataactgaaaagctgtctttcgtggaatatatttccacgaaatatatatccaaatctgcatggataaaatcaggctttttcagaggctctccttgtctggatctcagaaagttataacttagagtctgaaacctttaaaattctgaaaggaatatttaccatctatttattttttttttttcctgagggctgccatctgtgaggtttcatctacataataatgttggagcttgttctatcctgtagttcagtgagaggaagggagtagcatccagtggctttccttcttctctcccattgtttggtgagtgggagggagtggtgctcagtggctccttctcctgtttttcacagagcaggaaggagggttacagctattttactcccactgcccgcagcttggcaagttctgggttcttgtcccatgaccaagtggaataaggtacatggacaccggagagtgaataaggcagagtggaattttattgagcagcagaaagaaagctctcagcagggagaggggacccgaaatcaggttgctgtctgtgaggccgagtccacagttaaatgggcttagaatgggggaatgtgtgctgattggtccatgggtggtcttggaaagagcatcattcgattagttaaaagccataattcagaagggagcaatcaagagagagtgggtacgatggggatggaagttctcactctggtcttggactctatccggaactgtcagttgtgttttcaggatttaaactgtccttggcttgaagactgggtttttaccagggacctgtccctgtctgcctaggaatttgtctgtttcctatcgctatcaataagactacctttgttagtcaggcatcttctccctctcccataagctattttgcccgtataacctgtgttgccatgcttcaagctccacattattgctgtaaccacaagatgagtataaaagtgtccaccacctggccttttgagttcttatattttgtaaacctcctttacatgttgataaatttgtatactttccatcctgttaagctgacttttttcagttgatttttcagtgaatcattagagagcaaagggggagttttcccttggtccctacagtacactggggaaaagaaaataatcagacttttggggactgctggacactgactctaaattgacactaatcccaggacacccaaaacatcactttggcccaccagttataacaggacttatggttctcagtggaattttagctcaggttcatctcacagcaggtccagtgggtccccacacccatcctgtggttatttccccagttccagaatgcctaattgtaacagatatagtcagcagctccccacatttattccctgacctatggaatgagggctactattgtggcaaaggccaagtggaagacaatactaccgtcaatatctaggaaaatagtaaatcaaaagcaatactgcgtccctgagggattacagaaattagtgccatcatcaagaacttgcaaggtataagggtggcaattcccaccatatcctcattcaatttgtgtatctggctcatgcagaagacagatgaactttggagaatgatagtgcattattataaacttaatcaggtggttactccaattgaaacatcggtaccagatgtggttttaatgcttgagcaaattaaaacatctcctggtacctggtatagagctgttaatctgacaaaggcctttttctccatccctgtccataaagcccaccagaagctgtttgcatttagctggctaggccagaaatacattctcactgtcctacctcagggatagataaattccccactctgcctcataatttagttaacagggatcttgatcacctttcccttctagaagataccacagcattccattacattgatgacatcatgctaactggatgtaggaggcaagaattagcagctactctagatttattagtaaaacacttgtatttcagagggtaaaaagtaaatctgactaaaattcaagatcattctgtctcaatgggatttttagagctccagtggtgtggggaagttcaagatatcccttctaaggtgaagaaaaagttgttgcatttggctctccctacaactaagaaagcggtacctctaacgggcctatttggattttagaaggaacatagtcttcatttggatgtgttacctcagctcatttaatgaatgacctgaaaagctgctagttttaaatggggcccagaataacagaaggctttgcagcaagtacaggctgctgtgtgagctgccatgacaattgggccatatgaaccagcagattgggatggtgtgaggagcctttggtagaattctattggtgaagcacagtgtggacttttagtattttgatgcaagggcctgcatataattattctccttttcttttctttttttttttgacagagtctcactctgttgcccaggccagagtgcagtggcgccatcttggcttactatgacctacgcctcctgggttcaagtgattctcctgcctcagccttctgagtagctgggactacaggtgtacaccaccgcgcctggctaactttttgtgtttttagtagagatggggtttcaccattttagccaggatggtctcaatctcttgacctcatgatccgcccacctcggcctcccgaagtgctggaattacaggcgtgagccaccgcgctcggtctagtctccttttcaaaaacagctatggtcctgctactaggccccagtgtgatggttactaccgagtgtcaacttgattggattgaagggtacaaagtattaatcctgggtgtgtctgtgagggtgttgacaaaagaaattaacatttgagtcagtgtgctggggaaggtggatccacccttaatctggtgggtaaaatctaatcagctgtcagcaaatataaagcaggcagaaaaggagagactggcctagcttcccagacttgatctttctcccgtgctggatgctttctgccctcagacatcaggctccaagttcttcagatttggcactcaggctggctgtccttgctcctcagcttgcagacagcctattgtgggaccctgtgattgtataagttaatacttagtaaactcacctttttatatatgctatgcttgtctagaggtttggttctagagggagaaatgcttctatcaggagacccaatgtttctactgaactggaagttaagactgccaggccacttggacttttcatgcctttgaatcaacaggcaaagaattgagttacaatgttggcttagtattaccatggcccgtcaatggaaaactacaacaatcccaaccaggcagaaatagtaatggccccaatccttcaggaatggaggtgtgagtcaccccgccaggaaaagagccatgaccagttgaggtacatgttgaaagcaagagaatacagcatgagtagcagaagaaggtagctataaacaccacctaaaaccatgtgatcagctatagaaacaaggaaaaaaggactgtaatggtcataagtgtttcctccttactttgttatgaataagtgtatgtgcatgtgcatatatatatttgattccttcccttttttattcccttatcatgtggcataagacgtattaattctacatcataggacttaagttgcaggataccaaggagaagagtagacatcactccacgaactttacttccttttctgggaaaagaccagcgcattttcagttgtatgcaggatagttgcatcatgttaggcagaattatgatcttgttactgtctttgtttggagattaagaatggtttaaggggtgtgcatgggtgctcagctgacaaggagtggacatctgatggttagctttgtgtgtcaatttgactgggcatggggttcccaaattaaacatggtttctgagtgtgtctgtgaagatgtttccatatgagactagcatttgaattggtgaacttagtaaaatagattgccctccccaatgtgagtgggcatcatccagtctactcagagctttaatagaacaaaaggtgtaggatggaagaatttgtcccttttttttctgcctgcctgattgagctgggacatcttctctcattttctctagtcctgggactaacagttacactatcagttccccccgtctcaggattttgaactggatctgaattaattacaccaccatctttcctggatcgccagcttgtagaaggcacattgagggactttacaacctccataatcttattagcctattgctcataataaattagtttctctctctccccccgatatatgtatatgtgcatgtgtgtatctatatatacatgtatatatatacatatgtgtgtgtgtatatatatatacacacatatacacacatatatacatatacacacacacacacacacacacgcacacacatataccccacacatacacacacatacgtatatatgtttctggttttgttttcctggagagaaacacacaaatatatgctactggctcagtttttccagaagtccctgactaatatgtaatattacgattgctgtccaagtctgggaattgtcccacttatttatagtccttttaaattaagagtgggcttactttaacttttattacaaactataaagataattttaatcattgctaatcttgatttaatttccaatgattccaattattgccaccactaatactgatatcaaattttttaagtagtagttatgtctataattcacttttggctttctcatgttttcttttcttattaattttacaaaagcaatcatttttctggaaatgtccactgcaaacagtaggcaacagtgagtgttatagcatttaaattagtaggcccactaaaagctactcagcttaataaggtcagtagtatgttttctggcttctctcagactattttttgaagattttgcaagtattatttttaatttctgcaatgtctctgaagattttaaaaattttgttaacattcttgatataattcaatttataaaccaatgctgaattgaagtcttaccaaattatggtagatgaaattatcatcctattagaaatatttcaaatatacagaaaagtttagagaataaaaccatgaatagttgtgaacctaccacaaagatttaacaaatgttaaatgtttcattttcttcagttcatttataaaaatcaacataaaaatcacagatttactaaaatctgcacctacattcctcttaccttccctgaaaatagctacattcctgaaagtaaagtgtctcttcgccttgctaattttttatacgtttactgcatatttatatgttcacatagagaatgcttatttttctaatatttacataaatggttataaaagttttcaaaaacttatctcactcatacaattaaaaataattaaaaaatattagaaaacgatagtgctgtaataaacaaagcacgtaaggaaaatttggagtaggtgaactgggagtaggttgcagtttaaatagagatgtcaatgtaggccttttggtgtcatttgcacaaacttttttttttttccatttactcatttacttattttagagacaggatcttattatgttgtctaggctggtcttgaactcctggcctcaagcgatcctcctgcctcatcctctggagcagttgagcttataagtgtgagtcacagcaccagtcttgagcaaacaattaaaggagaagagagaaagtgatttattttcctcatctattattacattggtctgggtctccagatacaaggataaaaccctctttttccttagtgatgcttttatgttttaatccttgcatctaatactaatattattataccagttaattctatgtgagtgtgtttgtgtgtaagatgtaagaagtgtaaaaagtgattacaatgtaactaaacatctctcaccattattttacttttacctgtttatttttaattgtatgtttctcatttgtaaatttttggtcgattttaaagaatcaaatggctttctgtttcttcaacactgttagacactgtccctttcgggctgagttaggtatgtttgaatttattatgattgctttttaatgtaatttatttctgccacctgttgtgtatgcgttttggtctactaagatctttcctcgttcatttgattttcctctctggcttctgaggatagataaagctttctgtattttcttagtatttactatgggctttgaaaactgtgtataccatttttcaagttacttacccttatatgcttaatacaaataatcaatataattttcaacgaagtctaacgtagctcaatatctttattactgttctaaaagatacttagcatgctttattcaaaaatgaacatctcccttagtttctgtggaatcattatccagaattttagtactttcttttgaaacataaagaaattacttattattattatttataccactcaataactcatttcatttgtgagttatttcttcacattgacttcactttttgggtgtgtgtgtgtgtgtgtgtgtgtgtgtttagtaatttttttcattgagagcctatttgtactgaactttgtgactgcatgctttatttccctctattcctggactggttattatcaatttatagaattctattttacagttaatttgcttgacaattttggattatttttccattgtcttctgatgtctcttattgcatgggatatcttctatctttaaaaaacataggtaacatgttttttttctctagtcggttttaagatttttctccttatcctatatattttgcagtttcagcatgatagtctaagtatttattttctatgcttatatttttatctatttctccacaaacataaatacctatgtacgtatgtattattatttcgacctatttctgttaattcatccatccatcatttgtccatgcatgtctgtctttccaggtcagcactaggtgttcagttttaggtagaaaatgtgtgtcctctttcaattctagacaattcatggaaataatctttcaaatatcaactctcaacctccattctctttacttggcactcctaacagtcttattttgcctattttcaaactattgttggtatctgttaactgttcctttgttactttaacttcatctatgctacttttggggaataatcctctactctctttcaatccactaatctctttgattgtttccaatataggcatttttcccatctaatgaggttacagcacctcaatgactatattttcttagatttgtctcttttcaagtacacctgttatttttttcatttctgtttaattcattatttcttattgctgttatctatttatatgttttctttcctacctctcataatgtttagtcattatataattattaattctggtcttagagctgatttttattgtctgattttcattcaattggttttattagttattgtgctttgatgttttaggcacattttgagtagaagatgttcttctccttgtattattctcacttcttcctttatagaaattttttagttgtctccattcaatcctaaatccaactgccaaaaaacaaaatttatgttagtgaattgctatttccaggagtgcagcatagcgctatcactacacaactccaatggacccatttcattggactccaaagtgagtgatagcccagagaattgtgcaatatgccatctacacattgcaggctgctgccttaggggacaccattcaatagtgaaagtgggaataaacctgtgagtggattagtgtaagattctagctgcttctttctttttctctgtatatactgtcccaagcagcaggcacttcatttttaaagttcttttcattaactggttaaattcatcatagtacctggatctgacctttgaacctgcttctggtgtctcacttttcatggtttttttcagttgccatggatttaaagcaactgaagcttcagcctcttttatttgaacaaaaagcaaagtccaacatgtgtgcgtatttggctacatatattactttttattcctcccaatttttagtccatggagaagtctatcttaatctttagagaattttttttcctttttaaaatatctagtttatcaacatagtaaatgtttataataaaatgatatgaacttgcaattctatcttggcaagaatcccaaggaaattatgcttatgcttctttctggttctcaaattttccaagccaaaacttccatatagagtaattttaccaaaaatttagagaatttgagtctaaagtatatttcctttaattaaaatatattttatatttataataatattttagaaaatatcctagaccagttcaaatggtttcagattattctaactttgattctttttctaaaaattttcaagtaataatttcacgaatatttatatatattctaggatattaagattacagttcctcatattttactcagaaagtagttgagatcttttcttttataaatttacattacaaaatggcataaaattctttgcttcccgcgtcgtaggtttgcagagaagcttagtttctattcttgttatgactctagcttaatttgcagtcttcatgaagacctaactttcactcaaagtgctatgttgtgatgtttataaagatcaaaatatattcttcatccaattgatatttgaatggtttcaattaatactttcatatatttgttaggattattacctcacattgtactatatatacattatatggctatagagtctacaataaaattggtaaaaataatctgggtcttgtatacgtataaattaaaatttagttaagctcataacatttaatacctagctctttactgctagtgatgtaaatatgtaatttcaaattgagaaaatagtaaacataaatgggcaattaataattattctctattttgtaaaaatgtgaatagcatcgatattgttttagattttaacgtgaaaatatttaaaataaggcattgtactcatgttcttaactcatgtggcacctcctttatggatatatagtgtgtcttttatatttttctgtagtaccttgtaacagtcacatcttctttttctagacaatgaatatctgttatatttgcctatttggtattcataagctgccctccttttcctgataacatataaatttcctttaagaatccctgatgctgctattctcagatcattttgctccagaagtctcctttattacagggcaacagggataaatataacctaggcccagaaaattagagccagggcatttgttgtagggataagcaagtgtgctgagatgccaatttcaggactttccctgaaaaattaaaaacatgatagcctattctgccaagtttgcaaactagttgggtattcatctatcactgctggagtaatcctgttgtcagaaggagagacaaggaagttcttggagaaaaaaaaaataaaaagctgagagatgaagacaaattcctgagggcatgaaactatgcctgaagctgtaacagttctggtatttttcagttaagtctataaattccctccgtgtctctttctatagtagtcaattagagttttgtttctctctaactgcaggagttctacctcacacatataattgtctggtctttcctctgtttcacctactatattttaggtttcttgagaactgagatgatttcttattatctgttttatgcacagttcttatcctaatgaccaacttaaatttttaataaataaagaatgaataaatacacaaatttccatagatatattactgtagttattaagtaaaattatcattagataattttttgtataattctcagctcaatatattaagttggcagaaaataaacatggtttttctcctactctgtcccatgggaaatcattatgaagaattagaattcaaattagaaaaatagttattaactatggtgtcaaatcatattgattaaataagatcagtattgttgtgtttcacaagtgatataaaacgacgtagaaagagatagatttgaacatatagtcctggaaatagctcaacatgcatcctctcttctctgccacagaagctcttgctttcgatgatgatgtcatcaaccagacattttatggtagaataattttgagtattattgctctttaaagcatctccttttggggctttttaaatttgtttttgttctaaaaaattgtgtattatgaaaagcatgtcctcaaaatagctttaacaattttaatattttgtcatatttgtttatatttcatttgtggtcatttatattttggtgttattttaaagccaggaatagatatcatgatgtctcatcataaattctttaatacataactcctaggaatagagatgttctcttacaaagctaagatgtcattataatgactaaaataattgtcaaccatttacaatgtaatatccaacccatattctaatatcttcaattgtcataagaatgctctttagaggttcctcttttagatagacagaagtactgcaaattgttgttttattatagactaacaagtcttttgtaagtgatgtttatatgaacaaatagattagatgatcatttcctgaatgttccccaaaatactaatcccaaaggtgacaatatttgctctacagaaaatagcattatgaagcaaataagtttttacagtagaaaatcctatacaaaactaataaatacttagaaatatgaaaagggtaaacaaacttgcacattgaggtagttgtagaaaatatcccaaactattcaaaaatcacacattaatgcttcctaaatgttcatcatccttcactataactacgaagagtccaaatgaaatgtaataagataagattaactagaaaaaaagagagatttcactgtaaagagtttcaaggatagaataaggacactgaacttgaatctgtctttagtgaagaagttttgcacaagataaagacttgatggaaataataattgggtaaaaaatgaatgcagcagaagagattgcaaaaaaagaattaaaacacaggctgttacagtaacccaggtggaaactgatgagaatagaatgtttgcttttaattcataggtgtcatttggccagcagacgccaagaggctcttgatgaaacagtggaatgaacacactagggtataggtactccaagtccttatcttagatctgtaatcagctgtgtgaccttgtgtaactcaagaagtaggtctattcctcaactgaaaatagaggaatgaaatagatgacaactaaggtacagctctaaattcctactaattccagaataaccttgccacatcagccatcctccattatacttggagctgcttgaattttgcaaatattgtagaaataaaagcatttatttttaacagaggttaaagagaactctagaaacaaatcatgagaaagtgataactttaatgtaggttgagttttctcttagtattatctttacagctactgcattataaaacaagtttaaaaaagcaacatgtgatcagaatatctcaaaagaaattctatcccgaaatttaagaattctaactatattatttatatcaggcacttaatagtattttatatgtacagactgtgatttaatttacgatagttttaactactcacctggtagcacttggactcctgctatagtcctagtgctcctcaatctctagcatttcaggtcaaatatgaatagaggccatgttttcaaggttatgaaacatgggagtgaaacatgaaggagggaggaagtcatgaagttaaagacttcaagttcaagtgaagctaggaccaaggagtgtacagattatgtaggagatgtcaccatccccaagaacatggaggtcatattttaatagcatccatgtaagaaatgcagggcttttccaagagacatgtaagaaatttggagtcccctactaagtttttatgagtaaagaacgcataacactgggacaatattttttttttgccaaagtatttttcttaagttttaatatctttggcataattaacttgaatctctgcctgacaaacatctcaatcaaatgtgtataataattcagtgccaatggtgtagcagtggcttagaccataaaagtgcaaggaatggggaacattaaaaatggtgaatgtagttgttacctcaagaaaattgtagtcttgttgctctaaactacatgtataaaagtgagcaataggtcctttattcagcatcccctagcaatttttaggaatatcagggtgtttgcacaaacaagaaaaatatatttctgttgattttcaatctgaaactttcaggattgcatttacttccctgttttccactaaatctgatgcacaagcaaatcactgttaaacatgttcggattctgcattaactccttcaaatcagattcttcatttagtcctttaatttatctaagtttttcctggagacttgaaagaattcgtgcacgttgcaaacacgaattactttttatatttgggaattggcctgaaactaggaaatatgatccttaaagactaggctcagaggtcaatgacacaagcacccatggtgccattctcaagatgctacaatgatttggaaacaagtgacctattgtctagtttctaccaatctagtgaaacctagtcactcatggcaattaatctatacccagactgattggatcttggtttaaacttgactctcattgttattctcagccatgtttagactacaacattatgggatagctctctgacatttaaatataatgcaagccacaaatgtgttctgcaaatgtcaagttaaagctttgtagtagccatatcagaaacataaaaacataatattaattttaataatttattttattcaatataccccatatattaacagttcaaaatgtcatttatatttttaaaacactaaggaataaatttttcttactaagcctttctttttttttcttgagacagagtctcacactgtcatgcagcctgctgaagtgcagtggcacaatcttggcacgatcttggctcactacagcctccatttcccaggctcaagcgattcgtgtgtcccagcctctcaagtagctgggactacaggcatgcgccaccatgccaggctaccatttgtatttttggtagagatgctgtttcgccatgttggccaggctgatttcgaactcctggactcaagtgatctgcctgccttggcctcccaaagtggtgggattacaagtgtgagtcacggcgcccggcctacttacaaagtctttgacatgtgatgttcattttatatttatgggacatttcaatttggagtagccacctttcacctctatagccatgtgtggctagtggctaccatttgagacaatgaagttacagtttcagatgttttaaacagtccaagcagagcaccatgagcttgaagattattaaaatgctctttgattttgatggtataactaaaaagtggcattctggaagctcagaatagatctcgctgaaatacgccagatttctcaatatttatgagcataatccctgtaaaaaattatctgtttatttattttagagatgtagtcttgctacgtcacctaggctggagtgcagtggtgtgattatagctcactgcagcttcaaacttccaggatcaagtgatcctcccacttcagtttcctgagtagccgggactacaggagaactccaccacacctggcctagtaacaggaagttttaataatactgaagttgctctcagttttaaattatttactcagaattacaaaataagaaagattacatgcttttaaacattggcttttctagatgaaaacccatgcttctcatgaaattcttattattcaaacgtgaaattattcaagttattcaacgtgaaattcttttcatatgatttgtaattattccaaatacataatcatggaaatggaaaaatgagtatatcatatcaacttcaggtgaaggtgataattcaaattacttatgtaattaattaaaacaatattctaatgtcagaattccctgagctgatcatatttatcctgtcactagagttttaaaaattgggctatcccttattttgaggtaagtaaatatatatatgtaacataaatatatatatgtatatatacacacacacacaaccatttttaagggtacagttatgtgatattaagtatattcacattattgtctaaccatcagcactatgtatctttagaacttttttattttccccaactgaaacctctttactcatcaaactaactccctctcttccactccttctcagccctagcaaccaccattctacctgtgtttctgcgaatttgacgactctaggtatctcgtgtatgtggaatcatacatttgtattttcgagaactggcttgtttcacttagcataaggtcatcaagcttcattcatgttgtagtatgtgtcaaaatttccttcttttttaaggctaatatttctttacatgtataagctacattttgtttatcaaatcatgcttctatggacacgtgggttgcttttggagcttttagttattatgaataatgctgctttgaacataatttccaaatatctgtttgagtcatgggctttcacttttattacctgtctttagtttggggcccagttatttttcatgcttttgtctcattaaaatggtattgaagttttctttcactttagaatgaaataaaataaagccattttgtgtgtgtgtgtgtgtcttgatagtatttatagtccttcttcctaatagaacagatacattcactcacgtggacatttaaattttttctgccccttattttctagttctgattccaccatattttctaaagtcattcttctttaatattaaaccacttcacctgtagaaatatcagcatactgaattccaaaaattaaaaatgtctctagaatattctaagctacagctcccagggtcccagataaattatcccagtgtcacattttctgtcagaatttatcttgtcaaatatcccaggcttcaatctttcaaccctcttcactctattaattcttctcttagctcccacacgtgaactattcttggtattaaaaactcatttttaaagcaatacaatttcaacaactaaaataccatgtgtgcttgattagggtaaatttagccctatgaaactgcaccttagcaattttgcagcatcagttaagtgcttcctctatctccaattcccttttattcccaatccacaactcactttccattgtgattccttcccctctagtaaatatgactttgagaacacatgatccaaaccaaggaaaaacaaataaaaacagtgaagcaacaaatacgatctaaaaataggagagcaaagctcttaaaatcctgagaaaaagtagacttttctctaactttttcaatgccatatttggaatgttcaaagatgtgtgagaggaattcagtaattttattaataaccagaactattcaaaggaccttcaccacctgaatttctaacactcggcgttccttgctttaagctatttttatttgcaagtcttagaaaaaaaggaagagatatatagataagcagtagtaaataatgcaacatttaatttttacttcaacttcaataaataaactactctcctatttagtatacctatgaggattgctcttgggaatgtcaagcaaccacataaatgagtaccaatgagagagataacatggaaacaaagtaatctgcagcacaacctcaggctagcggagtgtgcctgagagccaccagaattgatggctgtggagccctttagcagccaccagatattttctccccagagaacatttctctcctctttcttatctaacctttttgcttcaccttgtattacctttgtctcttgtagactgtatatagctgtatgttatttttaactcaaaattaaactgtatgccatttaatagaaaaattacatatatttatatttattgtaataacttactcctgtcatcttgctttatgcttttaagctgttttgttttatatgttttgtgatatataatgttttctttcattgaatcttttactctagtgattttttaaaatccttcattaacttcagtagttatgatccatttgttatattatttacacattttcattggtgttatctgaaaactaagaaatgaaattatttgcttgtgtttttatattatgtgtttgcttttgatgaacaattttgaaaatttctattctatcgccatattttaaacaaatatttacaatgcattctatttatattcaattttagtaattgctattaatcttatattccatacgttttctcaattctgtattttagtttattttctagttgttggaagaccatagtgaacattacaattgattcctcaatatttattccacccaagatgggtaatccaagccaactagagactggttcaggcatggtgagtgacccaattctatttaatgggatataaaaggatatccttcagagagcttccagaaaaagtgtcttctctcttaagatataaccacaagaaaagttggctcttttctttctctggacattggctacgaccattacaaccactttattaccagagtgaggtcaaaccagtaccaagaacagcaaaataaagtgatggaaaaaaatgggatttttaaaatgataacactgagctgtttttatcaagcctgaagcctacattacctctcccttcttgctgtatgaaaaaacacagagatatgtattgtagtcactttgagtcaggaattctgttattgtggctgaaaacattctctacaataagaattttttaaattaattttttattaaaaatgagtaatcttcaagatcgaaagacttatataaatgtttgggtattggtatctgttacattcatttatgaatggaaatgtgattgagctaagaattctggactcatttcccactcaacattcaactgacaaacgttatttttctctgaaaattggttctgaagaggtaaattatgaaatctgaccaaatattcctcctttagattacttgcttaaggtgcttgtaaatgttttctttatccttcaaattctaaaatgttatgaacatactctaggtaactttattcatttaacccttttgatcaacagaattatgctcttcttcagctcagaaaagttttattctaatacataactaattaatatttgtgatctattccttttgctcttttattctggcattttaattacagcattttatagtttctctaacctccatatttcttcttttttctaatagttaatccttttcctgtcattctacattattacacatgaaatattacgaattgtgaatgaatacagaggggtataaacaggaaatggattgatatagaaagtaagaaaacatgttccactttgtttttatgtttattgaagtctccttgtttccatctttatagtggctgcttatctaactgtgagtgatggctgtcactattcactgtgggacaggtatcaaatgtcagcaatctcttctgtaagtaaagtctgcatccagcgcatcccattcacagaccctgatacggaaaatgtgtctccagctcatcctctcttgctcatcctaaattagtagagtccttgctcccaggtccccttacagcaggtctccctgttgattatggcacacacaaaatatctcaagtctggatatcttttggcaaatccatttaacctatggggaactcacacatccttgccatgccaaaagatgagatacaggttgccccatttctgccctctctttttgcagctattcattccacatgattatttttttctcttgcttacataggtgctatggcacattacctaagtctaaccagagatctgacaaagagttatgtgccttgttctcttctagccatcctgatctctaggagtggctctcttggtgaccccatcccctgggtttagtgttggggatagagaacttcaaaccacagaaccacccaccaagcgggttcagaactccctcttcctccctttgattatttccttattcaacagcagcacaaaaagaggtcatgaggaggtcacagactgtgtacaatcgtgataagaacacattgctgggaacacactgggggaaagcattccctggaccagatctgttgggtaccaggggatggataaaatataactgctcaggtgaaactgaaggaagaatatgcagcttttaaatgtaaatggctcacgctgcaagctgttataatactaggcattgctatattttatctctgtagagagtaaccacaaagtcctattctttcattaaaaattatctcaggtgggcacagtggctcacgtctgtaatcccagcactttgggaggacgaggcgggcagatcacttgaggtcaggagggcgagaccagcctggctaacatggtgaaatcccgtctctactaataaaaatacaaaaattagctggacatagtggcatggtcctgtagtcccagctactctggaggccgagacaggagaatcgcttgaatctttgaacctgggaggcagaggttgcagtgagcagagatcatgccactgcactccagcctgggtgacaagagtgaaactcagtctaaaaagaaaataaaaaagaaataaacctcatgttccttttcattctccacccagactgccaatttgctgtttgtttttctcaactcttctccatgttgaatcctggaagttattgaaacaatccttgatcattgcttttagtctctagttgttgttaggcaaaaggatttgcggctcctcatcagaatagcaagtgaataaagagcatggattatggaatcagaccagatttacacttctgactgcatgttataactgtgccacctctctaaatcttaattttcttggttgaaaaaaatagcaaaaacaatactatctcgtacatttgatgtaacgattaaatgagatgacgagagcaaaggatttaacatgattttttacatatgcacgaatttaattattccaataggatgatatctacattctgtcaacactttgtaatagcaaaaataaaaccacctgtgaaccaacatatgctgaaaataacattgactttctccaggtacccaacatatttatgtaatgttattcagggataagctggtgagtttgtgttctctgctgctagttggacacactaatataaaaacttgcagattattaacacagttttctgtatgtaagatgtttcttttcataatatgcattaatattttatctttttattttcctactttctaatcccttctaaagctcagatccagttccagtttttgagatttcaggaaatagtctacactatattatataagggctaatagtttcctgaagtccatctccaggttattttgattagaagatcatcttcctcggggatcttgactttcacttctgataatattgcgttatggttgcccctaacacatgcatatatctgactagatgttattgagatattttagttacttcttccactgagagtgcatcccattgtctgaggaatgttgtaaagttttaatttgtcaatcataatacatgtatagttacaccagaataagaattgattggcaagtgtctaggctcaaaatttggttttagtttgaaaacaacaaacaaaaaagatgaaatctagccagatgctatgatattttttaaaaaatcaaacaaaaccaaatagaaataaaaacataaaagcttctaaggtattgatgacgataaaaacaatcagaatggtaacaaagtaatttaaaaatgaagtaaacattgggttttgatttgtaaggttgtaaaaatttttctctttattgaggcatttcatatatatgcttctacagtaatttactcatttttagaatttgaataagagttaggtcttttaattaacatacatttttccttcttgccagggaaatgcatgttttcatctaaaataagcacaaatgacacaatgtttagattatattgtcaaaaccaattgtctacttagtgtctatttccatatccctgccacagatattgacaataatgatatagcgcaaagtgaagtctatttttaaatgcttcctattgaaacatattaaagcaaatgtacatgtgcatatagaagcacacaaattatggcatgatgctgacagcaagaatcaattctggtgacaaaaaaaaaaatcagtaggcgtttcatgtatctgccaagcctaattctgactttctctactaggtgctaatataagagaaagcaacccagataccaactgggaaaaactccagattttctcttgggtacacaaattatgacttttgctaggaaaccatgataataacaaaatcccagaagattataatgtgaattcttaagagccttatacctgtatatgctcactgaaggggtccccttaacaactaagatacatttatttcaaaaacatcaagggccattgaataatcctcctacaagtgaccattgaaagtagtttaaaggtattttccagaaatataaataaaatggctaagtcaagggaggtcgaatttctattctttattaattcagatacttaactctgcctcctctaatgcacacagttctagaatcttgaaccagcaggctctgatgggaatggcagcctgcaaacataaagggtgagtgataaatagccaggctgtgtggcccactgtgttccccagcggaaaggagaaacagcccactatacttctgcaggtaccctttcccttctgcttcctgccctattgccacagtatccaaaaattgggtaaaactctgagtagaggacatgaagaaaggaactatagaacagctacgacataatggaaacagaaatgaagcaatggctgtttggaaaagaaaaagaactgaagaatacaatcacctccagtcagattagtttatcagtcaggattctaaattcaacttttagttgtgaaatgcaagttttctagtgaggagaagggaatgaggataaaggcaataatatgttaattgtagctgaatctatatttggactgctgtatgctcaaaattctacatattaggggtggtaggatttgaggaggagagaaaaaacgatagagaggatggtgttatgtggaagcaccgaggtttgaagtctgatttaagtgtctactacacaaataggcatagctctgcaatctaagaatgaatatgatagcaaatatttagttattgattatggaactgagcgtatcaaatctttaggctatttgctctctcctctacacaactcctgtgtccaccttccacttcctgctggttttctcttagtctacgccctgtcctttccagatgccaatgattcattctcttttcatattctatttattttttccactctcttccattcatctaatacatacagagtacctagtgtgtataaccctgctggataattgggacatagggtccctgcatttaagatatatgtgttctttctggataaataaataactttccaagtatataacaatagtgagtaatgataataattgctggctgggtgtggtggctcacgactgtaatcccagcactttgggaggcagaggcgggtgaacgcttgagcccagaagttcaagaccagcctgggcaacaaagggaaaccccgtctttacaaaaaatacaaaaaaacattggccagtcatggtggcctatgcctgtggtcccagctattcgggaggctgaggtggaaggattacttgagcctgggaggcggaggttgcagtgagctgagatcacaccactgcactccagcatgggttacagagtgagacacagtctaaaaaatgtaaaaataaaataataataataattgctagtactacatccctatgacacacatatggtactataattacccacattttacgaatgaaaaatctgagacacagagatgaagaaacttgaacaaagttgtatggtttgtagagttaaaatttaaatctaggcagttaaattccaagcccatgttcttaatatctataccatatatctttaagagtcaaaaaaaagtatatgaagtaaacacactaggtaaaatattaaaactaatagaagggtcaaataaatggcatagccaagaaatgcaatgaattccagagaccaagattggaataggtataaatattcagagaggttttttaacagccaccctccgccccagcaaacacacaatccatattgtgttttgggttcttttagggagagagatttttgaataaaagagaaggtaaagaaaagagaggtagaaattacaatttttttatctctcttttttagtactggcatgagactagctcattgtagtaggaattacctagtaacattcaatcatctaatgatgctttatggctttaagccatacttggtcaccttttatataaataatatagatcctagatcaataaaaaaaccctctaaaccaaatttaaattcatgttttttaaaaacaccttttagaaaatactactcctttattattataataatatctaggcaatctcgtgttaaataaacttggaatttagtaatgttttttcattattttccaaattgcttgtgccatagtgtattgtttaaacgctatagtatggtgtgccaaatgctaaaatcctatgcaacccctggcaatggtattctgcagtgcctcttattacagtgcatgcaacaattttcttgggttgggcatttcaaatcattttaaactgcaaatataatcaggaaattgtgttttaccatttatagtttccaaataattaaagttttacattagctaggcttattgcaaacttcaaactatttcaaattaaatcaagaaaagtacaagaaaacagcaaatgctctaaatgtcattggatggatagttggggaatgtttcatgtaagcgtgttatatatgaaatgctatggaggataatgctccttccttgacatgtccattctgttgggtttaaggcaagaaactctgactatgttaacccaaaattaacatagtgtgttttctcagagacagaactttgaaaaattctgcagcacaatgtggctcggtaattaaatcaagctggacccagagaactgcattgggtccacagaagactttttgggccaaatttcatagttattatcttagaccaggctttttagaaacaacttaggtatatacagtaaatatactgaattgtctgtcctctctaggaacatgtttcaccagattccagaaaggtctatgctcctaccccataatcacttaatcacttagagataaaaaaaggtctattcacatttaagtcaataacatacctttgactaaaaagggtaaaatcttaaagttagaagagtttatttttgtatcgaagcatcttttatcccctaacaagtttctttctatatatgaagactatagctattttttctatttaccctaggtgacattgattcatttgacccatacttattgagtgcctattatatattaaatgccatgtttatacattggatacatatttgtgaataagtaaactatcttcagaaactaaagatgatgaacacaaataatttaaataggaaatacacaaatccaatcacattaactgtgttgaagaaaatgaacagggtattgatgtagataatatcagagaggaggaacttcaagtggccaagagaggtctcatagaggggctggcatttcagccgaaaactgaaaggtgaaaaggaagcttgggaaaaataaaaataaaaatatattcagaaaaagggagcagaatacgacaagactagtgtggctgatcgtagaaggcaaaagaaagtggttttcagatgggtttgaaaggtgggccagagaacatccacatacgtcttacaggacatgatagggattctgaatagtgctttatgtacatcaggacatcaagattttaggcaggggaatgacatagttggatttatatttttcaaggaatttattggcctctctgtgtggaggacatgttggagagagacatggagaagaggcaagaagaccaagaaggaggatcctgtggtagttcaggaaagactggtgactgagcttacagtgggaacagcataaattaagagaaatggtgaaattattttagatagttgacctgctggtagttggtatgttgagagtgaggacaagtcatcttggatgcattaaggttgagtcataactttattttcccccaaagttatggaatgatggtagcacaaattaaaaatgcaatagcctaagggagagacagagatgtatttaattttcagtttactttaatcgggcagaaagggattaaataatgcattttttaactgttaaatgtgtaattccagtgagccatccaattgaagatgtcaattagacagctgcttattcaaacctgaaattgagaggagaggtttgggttagaaatatacatttggaagtcattgtcacacatgtgatatttaaagctttggaacagatgatcacagaggaaatgaaagttaagttttaaaagggaacataatccaggaaccagccaagatttagaggtcaggtttagaaggaagactttaaaaaggagaatgaaaaggataatcagatatagggtaggaaagaagaaattatggatctagaagcgagacagttgaggatttgggggagaaatgattggttactaagtcaaataatttgaagagctcaggtaatgaagttaaaactattgaccattagaaccttagccttaatagttttagagattgttaagagcagaagccagacagctaagtagaacagggagtagatatgtttggtcaagctgttgttatatgacaggctattctacagtgtatttagaggttgatagaatcatagagaaaataagaattgtaggtgtgggtctacagaatagaggaaatccttgaaatcaatcaactttagagctagtgagttgatagaaggttaaatattaactacgaaataacagatcaaagtgttagtttcttccacaattgttctaacaaacacaaaattgcaaattaaagacttgaacttctgattatgacaatctatttctacttaccttgttctttcatctcagaaatcagagatgtcttcaaatatatttttctacataatatcttaattataattggataattcaatccattttcagctgaatttaccaagcatttaacccaatttacctattctattgtaaatagtacttttaaaaaaaatttaagaattacatatatgtctaattatctcatctcatacaattacaaagagtctcagatatctttgtatgttaaaagaaaattaagttaaaaaaactattcaaaatttgtaaagaaacagtgagatttctatataaaataaattaggtagggtatacaattaggcaaattaatggatacagtattgaaatatgtagataagctacaatatataattattaattgatttttaagacctatttctgcttaattactactttttatttctaaaaccagcagattaaaaatattttctcaatttaaaaatttgatctctgtggtaaaactaaacatagaatgtttttgctctgttagaaattagcctttggagagaaaacacagttattgtaacatattattcaaggtaaaaatcactaagacatagagaatttcagattttttttgctaatttctactgagagaactgtttgggaaaactgagagaactaattgaaagagttgactatccatgctttaaaatgtcagattttaaaatctatctctgcactaaagacatcattatttttgacactgggaaaaagaaaaaaacaatgtttagaatttgttaccccaaacaaaataacagcaattaaaaaacacagcaatgaaactgtgattgaaaacatcttagaagaaagtgaggctaaaggtattacatttttccctgcttctccatatactgcaggttacctaaaaggaattcatatagcttttaaaaataaaatgtaatttcatcagttgcccttgcctactaatctatattaacatgacctgtatcaccattgacttttcttttagctctatgtattcatctgttctcacggtgctaataaaaacatacctgagactggatcatttataaaagaaagaggtttaattgactcatagttccacatggctggggaagcctcacaatcatggcagaaggtgaatgagggtcaaagtcaagtcttacatggcagcaggcaagcgagcttgtgtaggggaactcccctttataaaaccatcagatctcatgagacttattcactattatgggaaagagcacaggaaagacccaccccccatgattcaattacctcacaccaggtccctcccaggacacatggtaactacggcagctacaattcaagatgagatttgggtggagacacagacaaaccatatcgctgcataaccttgttctcctcattttttttctctctaaacagtaattgataaattacgttttcacgttaaaaatataataattttgtttttgccttttagaatacttgttttgttctgtctggctttagaattgggtaaggacctagaacgtgtaagggagaaaaagtaggagagaaatagaaataagtgagaagacagactaagcaaaagagagagtgggagatagatcaaatttagatattttgtgaaatgaaattaccaagttatttttattcctaatcagcattcagaaagctacattatataatatagttgaaaaaataatcaagatcctgaaaaatgttttcattagcctagacttaaagaaatattggtaaagatttgctttgtcacagcacgtcacaacatattttctgagctgtgatccaaggtgagttacatgagaaattagaaaatgtgttgtttatgtacatttacccttttaaaaattattaagttgatctagtctttgtctttcaagatcatagtatatgaagttgtataaaatgtcatttagaggtctatttttattgattacaatgttacataattttagatttttttgattattgtaataatataatccatcccatattgaccagtaccaagaaaaatagctgatttgctggacacataaactgaagccaaactaacaaactaatatgtacctaaatccatatatacatatttatctcatatatgtgtgtatatatatatgtatgtgtatgtatatatatatatatatatatatatatatatatatatatatcacatgtactaggtaagcagagatatatagagcattaatttatcaatactgttgttctatatgtgttcctgagtggtgtgaaatgtctggcatgcaattggcttgaattgaggagctgcccttcagagcagggctgtcttctagatcactggtccccagactttttggcaccagggaccagtgtcatggaagataatttttccatggaccagggagtggggaaatggtttcggaataattcaagtgcattacgtttattgtgcactttattctattattatttcattgtaatatgtaatgaaataactatacaactcaccataatatagaatcagtgggagccctacgcttgttttcctgcaactggatggtcccattggggatgatgggagacagtgacagatatcggatattatattttcataaggagcacacaacctagtcccttgcatgtgcagtttacaatagggtttgtgctcccgtgacatctaataccaccctactctgacaggaggcgaggctcaggtggtaatgcaagcgatggcgagtggctgtaaatacagaggaaatttcactggctcacctgcctctcagcttttgctgtgcagcctggttcctaacaggccatggtaccagtacaggtcagtggcaggggtattgaggacccctgttttagatcaactaagctctccataaatacgttagaaaaagttcacaatttaagcaaatgatccaggcaatttttcccttccttaaaattaactctctatgcaaaacaaaactacaagtgagctcttacctctgtattatatcaacaaatgataaactattaggaggaggattgaaggaacacaaacacggaggtcccttgggctttctgactaattcttgtcatttttgtcaattgcattaactctccaaagttccctttgaccacttatgggattataacttcagcatttctccttactgctgctgcctgaggcagcctatttgattttgcctacatcgctctggggcttgcacgaagtagcagtgttaaacttgcagtgaaagtgagccaagcctttaagtgcctactcaaacaacttggctgacctcatcatccttcttcttactaacacctggaaatggattcggcctgggagaaatagatccttttcttcgtggaagcttctgcctataacttctaattattccgtgggactctcgatgctttcaaaatgagtccatattccccgtcaatcagaactatcttaaacctctcttaaaggaaacactttcaaaattatcctttcttggaccagttgattccaggaattaccatactttatattttgtcttagtcatatcaaacattttcacctttcatgaataatttgaacttaaagcagaatggggcttcctggtccctatattcattttctttctttctatttgcattcctgttggaaagcagttttgctagtttgtagtttgtttttattataatgatcacctaaaagataatatatcaagagccagtatagcagagtgactaagagcatggattctggaaacagtccatctgatttgaaccatgaccctgtagtttaagatccctttgaccttaggcaaataaattattgaacttctctgggctttaatttcctcatcggaaaaatggcaataataataataagtactggcttggtagagttgctatggagactaaatgtgttaacatagttaaaatttaggcataatgtgacctataataataagctctttataagtgttagatattatatttgccatctaagatatgctctgagtgatgataaatatcagcatgtaaacactgtttgtcttaaaaatgcactactgtgaatactctaaaatagcctagtgagccatcttttgctcttaggggtacatccatgaataatggctagccctgaaggtacgtgatgctaaaacaatggcattgccagttttaacattgtgggactcaggcagaatggagtcaaaagactaagaatggtctacaagaagaaagaaggaagggaaacagaagaaagaccacccaaccaataaacaagtgttttcacccatcctgtgtattctaggtgtatttttgattaccttctcatattatcatattatttgtggaatgtggactgtacagggactacctttaaaacattgtgtgaactaataaatagcatgagaacaactagataaggcattacccagaatttttgacctgtggaatggtcacacctgaatccaagtatgccactgaaagtttcagaagcctcttctgtggcatttaaactgaataatagagaggcctagagcatttgcggggcagaaagacagggagagagagagagagagacagacacagacagacagacagacagactaactacacggagaaatctcaacctctagcagtggacttgatggaagaaactactctttgaaaatgctgtttctactccaaagtcataactaacccatattatgtatgtttatcagatttatccctcaaagaaatttcttccaggaaatattgggtcaaggagactgttacagaataacttatcccttatttattgtgcattgtttatttttgaaatgtggagacgccttatggagaagaaagacttatggggggtatggtttagtttggtggtctacataatatctgggtaatctccacacagatcctgtgttgtagacaatgatgcataagtagcatagcttctgctacatgtcactaggcactgaaaactcaaaatatttgtcaggctattgagaaagttatagggaaagaaaatttgaacaagcagtagatagacaacagaaatatgaactccgaaatgaatgtgaaatgtgggaggctggaatgtcagcttcaaggtggcttatggaggaaaatctggagaaacttggggaaggtggcagcaccaatgttttgctgaggtctgtgtgatcagtagtttataaagtaaatcttcagtagtttagaaaatgccaagatacatatgcaagttcttaacaacctagacaagagcagataaaataaatgcaattttgtgatatactagaaagttttttaaaaggacattagagaggaaggcttaggaaaatggaaccaattgagactcagttaagagctggtgggagtaatatatagcctagtgccaagctctgcccgacaacataaatctctccaagatgtctgagcatccctgtgatttccattaattcaaagagaagcaagatgggaagtcagaggttactgacaaccaagaaaaaaaatgaaatagttgaagaggcaaagatcataaatcaactcatacgatgtgtcttattgaaagctgacatattggtagatgccttagacagttggaataagaatttccaatcctcaccttcacgggaaggggcgtaacaacatgggcaagctcatgaattcccctcaaaacgacaccccacctcctgctaccagtactatctgagagagtatttagtacatactagtaaattatacttctaaggaattacttcctagagttggacaaaatgtcatggtattggatttgcttgggttctggcagtaacatactactagagctcctatcttgcaatactctgagaaaagtgtaagcagtctaaagtttctgcattaacagatgaagacaaattctggacaaagactctcaagtcaccattattatttagtccatttctgggcatcagcgtccacattttcccacagtgattattgacataacactcagtagtctgaatgtaggacattatctgcatctgggcaaactgtgctgaagagcccctgaagttgccagaggagatcagagaagtgacacatgtggagccagaacttgcaaccagactaatgttgctaagcaagaatgtaagtcagaagtttatcaacaacctagaaaaaaaatagaaatggttcacgaggcaaagatcataaatcaactcagatgatgtgtcttattgaaagctgacaggtgggtggaagtgttagatggttggaatgagaatttccaatctttaccttcatgggtaggggtgcatcatgggcaagctcatgccattctcctcaaaaaggcgccccaccttctgctaccagtgctgtctgcaaattctaactactttttggtattgacccattattcattaccacttatggaagaaagtgtctgacatcttatcatgctccccttaaatgcctttgtgcctacttgtataatcagataaaagtcagaaagtaccatgagaaaattttcagatatctcagcctacaggctgtcgggaaaagaagtcacacacaaagtataagcttctttgacactggaaggttttagatacccaagcacttgaaagaatctgtgacagggaaactagaagggaggaggaaaagctctctcatgttttgcgaaatgtagactcaggaacagtggagcaatatgcaattctaggacacctggagttttatcagtgaacactttaggaatgtctgtttctccaagatggattctttgagggattgcgtgaagcaatccttatgttaatggtgttatttttaaattctgaactccatgcttgtttgatcatactgtagataaggtaacaagaggaaaattaacacagaactctatgattatggcagccaataggagaagaaaaaatccttcaagatgccttcactagaaagcagctttggaaaagacaaaacatattattaattgaggggtatcacagagtagtgcctcataagtggcttgtggctacagttattgctacttcggaaatacttcccagaaatgctgagagcaatgcctcatgtctttgaaaccaagggagggagaaggcactggatatcatctgatacctaggaagagagaaggctctagagatcactgggcagtatttctggccccagaaataaaaaatgtttaaggaccattatctttaattctggcacctgcaaagatgagtatggggaggagagtggaaagtaaaatgtgccctccaggaaggtttatgtaaaatgcatctgaccagtactttttaaaaaaaattgtatgtgttgatttttttcccattagaaacagctaatctgatattagtaagagagttttacagcagtcataccaaatcatatcctatgaataatcagaatctattctctctgttccatggatgctgtgggagtttgttcattacagacttcctctttgaattccttctaaccaaggcagagcttttaagagcccatttctagagaaataatttaataggcagaaatttcaaaaaaaataccatgactattctctaatatccatagtgaggctgtaaaccagaaatatttagcagaactttgtaaatatctggggaactctcctttcaaagtcaaagctgtagttactagcattttattcctttcctgatatcctaccccaaagctttcattttccactgacctcagttttggggtatgtttcaagagacaatggattgccttgattcagtaagaaactaacctgaaaaatattctagaagtttttcatcatttggcagctgcagtcactcaaaaagcaacacagcctgctctaaagacactatgacaccatgtgggatatcaatggcatgctggagtttcattcacttgcaagagttttcaaggcattttacaaaagaagttactgcagctagattagggccatttgacctcttgccccaaattatttatttttctatgttcattttataataaagtactgaaaataacttaatgataactaatatttgtaagaaaaactgtgtgcacacacatgcacatgtgtgtgcatgtgtgcatgtatgtgtgtgaatatctgtgtgttaagagacttagttttttaaaatgaaatggaagaattaagactatttttcatggctaggttctattaaacacagcaattacgtgaattccccttcattcttcctggataaatatagaaaagtgagtaaatctcctactttgaaaaagtagggcacaaataagatgtatctgagaacctagtcatagggcaaagggagaaaaataaacggtgagagaccaagacaaggagacttctgtgcacaaatctgaggatatatttacatggaccaaaaggcaacctgatggggaaatatgtattttgattaccttctggacactgataatgatgctaatggctactatatgctaatatttattgaaagataattctcaatgtttccttcatgtttctgtacatttcacaagcagaagcatctacagcctatgttccagactgtcattccaaggatgtttttgtagtggacaaccttgggagacagagattataactctcctttgagcaaaaagaagatgtgtttgttgtgctttataaaagactcagattccctaaatttggggatttcctcctgacacaactctctgcttgtgcagatgtgacctggcccttttcatgtttcccaataaaactaaagtagggggacagaaaaaaaacatgaggtacatgctgtttgctatgacataattaatacagttctttgtctcagagccaggagtctcatgtcttctcctagcatccgaggatctgcagcaggctatcttattacacagttattacagaaatatttcagaccttccacagtctgggcaatggtctttgttgtaaaatgcctttttgagtatcagaaaataatcattgctcctaacggatttgaagataaactacgcttatttacgttccaagaggtaaaagaagaaaatcagaccactataagcagaaggacatttctcacatagtctcaccaaagcaaattgcaaaattcaataaagaatatatctcggagaagccaagatatagaactatagaaaaagaaaagatagtagaacaataactcagtacatcctaataataacaacgaaagcaataattaacttacatatggtggtttgcagtttacaatgcatttccacacattattttatttgggtcttataacgacctttgaaatagtcttttttattttcttaattacaccgttgagaaaattaaagtttagaaaaggttacataagttgctgacggccaaaactaacaagttaaggaaataaacaattgatatagactcaagcaaactgaataaaaccaaaaacaaaaatcaagatttggccttaggatcacaatcttttgtcacaaattatttcctttctgttttaaatcttccacttgtcccctgtgaacatgtctttctctcctatgcagaagaacaaaatccctctatttacactgtttactttagttataatccttccactttgttttcatggtgaaattatataaagagtagcttacatgtgttctctctgtctttcctgttttccatccatttcatctattattgttttttaaaaaaatccatattaaaatcaccagtggcattctaaatgataaagactcgggatgcgttttggttattatctcaagttcaatctcattttttgaaaacatgtttcttctttggattgtggaatactttcaatcacttattctcttctttctttctggttacaatttctcagttgttttcatggagatctcatcttccaactgtcttataaataaatctttctagagtttcatctccatccttctctccttgctcaatctgcttccactaaaacatctcatctatgcccatgatttgataactactcacaatgcaaaggcacacccattctatatgtctggctctgatttctttcttgagctccagatatgtatttccaagtatcgaatttatatctcaatctgataacctgtgaacttaaggttcaatatgtccaaaatcaaaccactctactttccctctaaattatttctttttgttttcctttcctggattgggtgagccacactgacttacttctaaaagctgaaatgccccatccttcttccttagtctccatattcagttggtgattgaattcggttcattctgcctctagatactccctgtaacatgtgcttatctctctgttaacaatgccttaaccttcatggaaccccacatattcaataggctgccctagtaaaataatctcctaataggtttttagtctccttttcatcaaagatacaatttatttacttctttctgaaatttaaatcttacaattttgctatctccagaattaaaatcttcaatatcttcagatattttactacctccaaaattaatattgaagatattgatttatgtttatgtctttatgaagatttatgtttgtttttatgtttatgtttgtgtttttatgaagattgatttgttaataaataggttcttaatcatgtttcaggaataggaaaagctagactccaggatttggattttaacatctccacaaggaaaggggagaggggcttgacttcttctcaggagtgtattcatttcattgttaggcaatgttgatggataatattttatcaatggcatctaaagacccactttttgtgactattgctaaattcttcagccttaccttcagtgcttagactcatgcccatgtacacacatgcatgacatgcatgctcatacacaaatatgtctatacaccaacacacacatcaagttcttccctgatatgtaacagtcattcctgcttctccacatgctctgataactgcttggagtttcttttcttcccccacctctactcaatactttctattcaaattaaaaccccattccactctcaacttctatccatatgcgcagagttaaaatctctccaagaatcttgcatacgtaacattcagagaatgcatttcattgctttgtcatcatttgccactggatctgtctctccgaacaggctgctgaataatgaatacagttaagttcctctagcttgtgtactctatttattatttactgtggcacttcctataataatgtggaaagtggtaactaaggaaacttggaaaattctagtgaatcacaacctgtaaaccatcactgagttaaggataaagtatcaacttaagatacataagccttagtgataatttttgttataaattgttataataatattactaacaaaaataagagctatcattttataggtagggattattatcttcagtataaactgaggggatgaaatgaaagtataaagaaattgtgatgacttggctaatgtcccaaggtaaatggtaggttctattttactcctgtgataatggccaaattagtagttttcaccaaatagctcagttctcccctggcactgggcagatggaagaaatgctactcccttgaagttaaatatggtcatgtgaattgcttaggccaaagaaatattagcgtatcacttgcagggagaaggtatcagagccagcacacagtcacgagtgctctctctctctctctttctctctctgtcacagcaactgccaatttttaaagctcatggctgctccatctgactgggacttcactgtagacaatgtgagatgaaaccacttgctgactcagattggaaatgtaatatgagcaaaaaatgaacttctgttgtgttagcccactaagacttcgtacatttttcagacatggcatgatttggctcactttgaccaacattccacagatgccattacttcagtatcaatgtttgcttgaccataaattggactcaaatggattttttggggggaggtcaagtctgaaaagagcttacccaaagttttgcatctttagggtacgaaaattatgggagtttagacgttcatagttacttttttcttttactattgcaaaacttaggtattgaaagatttaagacatatggacacagagaagccaccaacaggaaattgtgtctgaagcagtacaacaaataggaaccagagccagagatgaggcaaaagaatatatgaagccaacatatattctagaaatataatctgggtcagagccaggaactgctgagttaatcagtgtgaatcagaagaaagagtcagaaatgagagacatgcactacctaaaacagttgcagattcaagtttcagaccaagtgtcagggtaaagtcaagacatttctggtaagtcaaaacatttcagataagtgttttaactgaaaaggcttaaatattttaaaagtccacatttcatattcaactgcctcagccaccactatcacaatcctaattataacagtaatatattaaattccaagcacttcacatacatttccatatttaatcagcaaggcaactccatgaggaaactgaagtatacatcacagcactagccttcaaacccagttttgtctgacatcaaattatgtgttctcagacactgcgaaatggccctgtgccatttatccttctgtctcatacaaagagggtaattatcaataagtggctgggcttcccaaaatagagccaatctaacacagggctcaggacagaagtaaaagctaatctcagcatgacaaacgggcaagagggctagcgtgtgatctaaatttgcctaaaaataaattgactacacacctgtgaggaggtcaagtctctctctctctcccctttcaggaccgagatatcgtattatctgaatcctggattctagcttttcctattttggaaacatgactaagaacctgtttattaacatatcaatcttcatgaaaaacataaacaaattattcctgttttgacctttgttatcacttattgtgccacagttctggtccagctactctgccataaacagcaataatttgtctccctctgaggcttactgcgaggattaaatgagttaacacttgtatactatttacagtaaggcactgaaaatccattatttagtatgacgctgattatagtctcattaaatcctacaacaagattttgaggtgggattctactttttcaagtgagaaagctgaggctcaggtagtttatgttacattacgaaggccataccactaataagtagaaaacagggctgggattccacaccgtcaaatatttgcctgcaaaaccaaagctctttccactaagtcacaccacatgcctcactgcaatggaagaaactgcacaccaggtccaaacattatgcacattcgtccttattgaaaagaacaaattcactgtaattttgcaactcctcacaatgccagctgctataaactgtatgaaatttatgaaagtttggaaaggttcccaccataataacatagtatttttcgaaaataatttgcatgctatataacacacattatatatagcaaataaaaagctaaccctaagtgacaatacgtgggcagataatgaatcatttggaaatatcacgtagatttcacatagaaaatattgttatccatgaaaagcccaggagtttcttaaccctttgctgtgacgtggaaccacagcagaaagcaccgacagaccaataatgtgataagcttaattctctaaagggcaggagtgagagctttctatcctataacaacagtttggatgactttatatcaagagtgaggaagaaaattatactcctctcccacatatcaagggaaatgcttcccatggagtgactcagcctgaaaccctaaaccggagcacggtcacagcatgctgtaggcagtcacagcaggctccgtatcagctgccttcggcatttgtagggacaacacagagcggaggctgccaattacaccagaagcttctaccttgtgagaagagtctaatctagtggaagaaaaacagacactgactcttcatgctccaaactgtggctcttttctacttgatcatcaacaatatgttcaaacagccagaagaacacactccctctctagtaagataataattgtaaacagtcatatcactagcaatttgccaggcacggctctcattacttcatatatactaattcatacttcatatatactgattcattcaacttaatacttatagcactggacatatttttttccatataaaacacagatatattaagttacccaaagtcagatatctgaagtatggtaggatcagtatttaaacacaagctgtctggtatgctagatacctatccaagaatactgtgccagtatcaccctacttatccttaattatttttaagaaaagcctagcatttaggagaacaatcatagttacagggtgcattctggcaattgtggaggaaatgtaaaatcagataacttgagacaattatctttatggtattctctaggtccaacattgaatgatttggttttgctggaattggtgtcccatgagctcactcatcttgcccaatagttccacagccccaccttattccaagaaagcaaataaaatacttatttgatatataccaaatataatcttagcatgttgcaaatttaactttaaatcaataacttgattttttatacttctttaatgtacataaagaaattcttattaaaagatacaaatcaaactcaagaaagtgaatgcattgtatcatttttctaatagagtatggaggaatgtcacttaccaatactgcattgcaacatgaaaaatctaatctttaaagcccccgataaactgatcatgcatattgaacagcatgaaaaatgaatgacttctataatcttcaggatgatgtttgtttcctgttatattttggcactggcaatttattacacaagaataggttctaatcatgatattctttgcttcctaattattcaggaaagtccttggagcaggaaatctagcacttttcatgttgtctttgttatttaaaaatagcgtaataatcatggaattggcactatttctttaaaagtcacagctaatctgttaatttgtcttctcatagaatccattttaataatgctcttacactcagtgtgacatttcatactaccaatttactgaacaaccattgatctttgtctcagtatattatggattttatatttatgataatttttattaccacttgttttaggaattttcacaaatttattactgatttgtgtattcttatgatataattaaatgtacctccatattcattagccaatgaaatacaagtagcagcctataatacactgaagaatttagtagaaatgtctttcttctaatcaattcaaatggaatttctatatctgagcaatagcaattatgaataaaacattagctatcatagcaataatttatatattttatagtaatgtttcatataatacaggaacttttcttataagtacttaaacactggaaaatatattttaataaacaagccaaattcaacataacctaagccaaactcaatgctttctttacttgacagatatcaccataatcccttcttttaaaactggaggaaaatttcagatcactctctctcttcccctctctctctctctctgtcagttgttgtattttattattttccaagatatcctctgttaatttcaatattataaaatctgaatccccacttttccagtcgtctttcatgatctacgttatgcagtctacaccaataccctactaactagtctctagtctctagcatctttccatcaccatataccatcttctcagtcgtcaaagtaaacttctcgaagcataacattgcttctgtcactctaccacttataactgtacaatgacttcattgtttgactcaagtacggcatattttgatatgcttgcattcttacagacttcactcactcccttcaattgtgatgggctaaatgtgcctcacctcccttcctcaaatttatgccaaattttcctttttatccatatcatttcctttgtcatttaccttaaacctaatttttaaatatttgtttcaaatcctccctcttgtacgaagacttccctttccgttcctatctccaatggaattgtaaaaccccatataaccttaaagtctgcttgtatcacatacaatattctggctagacatagaattatttatctattagtttctagccttctttaaactataaattccttgaatggaggacacatatctcttcatatttgcatctcctgcagcaccaagcagaaaactcactctgaagaagatgctcagaaatatttacttaatgattggattaccacagcagcaaagagcagagcatatggaaatttgaaatcataggcaaatcaatttttaaccaatttagaaagtattgagtataagactgcaagtgataaagaagaagtaggccattctgaactaaattttctttactcttcttcttctttttttttttttttttttgacagggtctggctgtcagccatggtagagtgcagtggcacaatggctcactgcagcctcagcctcctgggctccagcaatcctctcacctcagcctgccaagtagctgggactacatgtgcatgccagcctgctgggctaattttttttttttccatagagacagggtctcactgttttgcccagtctagtcatgaactgctgggctcaagcaatccttctgcctacacctccaaaacctaaatgtaaatattcgtaatatgataaatgcatatattgtacattcagaggctctacacagttttgagtgtgagaaccataagttatgtcaaaatttccaaatatcatatattttgtaatcatatttttattattattgactcagtcaatagtcatagactttttttagttttttaaaatgcctatgaaattatagatttggaacttccttacaaatacccagcagcattctcataccctcattcaatccacagactaggaagcttctagaatacctttgaaactggtcttttcagataatatacatgaagcatttattagtgttcctggctcataatatgtactctataattaatgtgagtgatagtattcgctattaccatcacatctatcttcatgttctaagtccctatatgtgtttaacccttttctctgcttctactttataatatcatccaactaattcctgatacacatctcttatatcccacaacatctttctgcataagttgaccagatgccttaatttttacctcgttcactatcacgtgctgtttggttctttttctcctttccacttcttgcattttattctccctgtcaccatgttattctttccattcttatcattcttattgcattctctatatattgctttttctgtactcatcattttccaagtcttttggtgcctgctattaattagttgtttctttttctctcttcaacacctgacccaactgctgttcatatttatagttgaaagtcactttatgaaatagacatattcctgaaaatctagaataaaaacaaatttcttataaataaaatcttactctacatatgcaaagaaacaatattttctttttaaaacttacagtgaagtgaatgatcatagcctatcacttgtatcaatgcacacactaaaagagttgtgcggtcctaacttgaggtcctgacacctctttcttttacaacctctgattctaattccataatgtatctatgactccctgcttcctactctcttttaacacacacacacacacacacacacacacacacacacacacacacacctctcccttttccctccctcttgatatctatgagtcagaccatactgtctcaagcacagcattgcttttttctcctctttttccttccttctcactctctgcgcccgtttgtccttctccctgtctgttacagtattaccactctccattttgccaggctgtctcatcctctgctttatttctattacagctagagtgttttccaagcctaattgtgcacctaacattttagttcctttccttcaagatgtaatacttgatttaatttaccttttcctttctcttgtgtcaaaaaggtagtctcaagtcaacctgacttgtaaacacaaaaggcagagctggatctatccccatgaagaacaggatctatgatccattcttataaataaatgatactttgtctagcacaaatgtcaaataatctcataatatcaatatgaatacttacactcagcatatttctgaagttgggaaaattccgaagggctgaggtgggcccatttttcctggtttgtcatggtggtggtgagaagctctgtcacataccaggtaaaagattctttattcaggtgttgcgcagaggtctatgcttcaaagattccacatggcatgtttcatgataaaatacctcaggctttcaaaatatgcaatctgtccacatgaaactgctttggatgcttgtaatttcaataatgtgttaaagaa
